United States Patent 10,724,096 (METHODS AND COMPOSITIONS FOR INHIBITING AND TREATING NEUROLOGICAL CONDITIONS) - sequence listing, part 77

SEQ ID NO: 1541 - DNA, 336398 bp, Homo sapiens
tcgcatggattccctttattgaactgtactagttactgcagtcagattaagtcacatttaaaagcagaccatccagttgcactgaaaccgattatattcattacatagttttaatcactgtccggtgaactggcaaatccaatcaaagcattagtctttaattaaaaaattaaaaggaaatattcagacaatagccaagcaatcacatcacgatgcacaattacctagaattgcaattaaaaagtagttaaccgaagggggtggggggtgggggggaagaaaaacaagaaagaaaaaaaagaagcaaagaaaaaaaatcacactaattcttttttaaaaactatcaatataatacatgaaggaacaaaggacaatagccttaaaaagcaggtttctctaactctagaaatgtagtctgcggcggaaagtctaaaagcacactagctgtagcaggacaataaaaaatactgagcatggaatacttttaatctctgccattaatattcatttccagctgcttataatagcagcgcctcatggccaaatcattagagttttacatctgggttgcaaatgacactttgattggatgtaatgttcaaatggccctccccacggcgtctccggcaagccttctgcggagaggtgtcctgttgagcgatccctcactgtgcgtgctggctcatcgtgtggttctgcaaaggcgaagaaaggagacacacatgaaggagaagaatggagagcatgctcgtccctcccactcagtgcatttacgccgggagccgcagaaaagcgtctcgattataacaaaacaaaatgcaacaaggaaaaagtgctccagggacgcagctgccaagacgccacgttgatttggggcttggggataggttcctgttactgccaacttggactccctatatgttgttttttggctttttttttttttttttttttaaagaccattcaggtcttaccggggggactggctaggtggagggaaaggggaaatgccggggaggaggcaggaattaaaaacatccctgttcacctctccatctcccttttcctctaatgaagaggaggaaactctgatcgcctgcaggctgccctcgcatccccctctcagtcttccccgtggctgctccgagcctagcagagggagacagcagatgtgctgtgcagctctccggccaagaaacacccgagcgggcacaggcgtgctgaggcagtgggcggccgtggtgcctgcggcccaggcaggggacaggtcacccggcaggaagacgcgggaggagcctctgctgctgggctccgggagcctgcctgcttggtcacatggcaatggcccaaccagagacagggactcagtgcagtttggccgaatgcacctaggaatccagggcccaggtgggaccctgtggccaaatgtttccctctcattacagtcaatggcatttcctccccctgccagccagagggggccagcagggttgatctgtttcacaggagccagcggcctgggactgggggtgggatttggcatctgaaagccgtctttttgtttcttttcagtggttcgtgttccaaattcagacccatttcatcaaagcctcaggtggtgctccacctcatgacacctggagaaaggaggcaacatccaccaggtgtagggtggccctgtttggggccgcacaggaccctagatccccgggagaggctccttctgggcgccccccagggcccggcgactcctgcagctgtgccgctgaccgccaggggtcagcagaggcaccgcgtctctcctgggctcgggtccgcggcgagggcgaccaggtgatgccagtagcctcgcccggaggccgaggccggggccggggccggggccggggccgagacgggccactcctgctccctggagcagggccccgcgcagtcccttcccgtgacgggcactgcgaaggctgcggcccccgtggtaatgtcaccgacccttcctgcgagctcccggccgggaagaggcagcccgcgcctgcctcccagcagatgcccacagcgccaagcgacagcctcgtgctcatgcgggcggagcaggcgcacggccggggcttggtgggcatgcgtgctctgtgccgtggcaggcaccgctctttcaatcctcacaacagccttgcgaggtgggacttcttaagatgaagacaccgaggcctaggaaggcaaaaattacaggcccaaggtcacccaggttggaagcaccgggcactgaaccagatggctggaatccactagagcaaggggattttcaggggagccaggcttcccagggcctgcaccccatgggcaccgcagtctgcaaatcacccgcattctgcaccagacacagtgccacctctgccggccgggcctgacacctcggtcgggggcgtcagggacccagaggcaccaggcaggttgtctgaggccacagatgggatgcaggcggtttccatgggaacccgcaccctccagccgtggcacctctccctgtacttgtgcagggacagccagctagtcctgtggggagccgaatccacactctacacagccatcctcctgctaccttcaagcctctgctgactcagttcccgcctcccttctcctccctcccaaccaagctgctctttgagtcctctaggcacatggatcacttcccatccctgcagacctctccaggcacctgcagcccacctcccacacagccacgcacctctcatgagctagactgacctcctttgctgagctgcacacagggtggcggcacctcctttctcaggacccagggctgggcatgcactgtcctgaccatacgcctgggcctccaatccccagcaggcacagctgcccaggagcaacttggaggtctgcactttcacaccctgccaaccgccagtcaaaaacccctgctatcttggtgtgggtgggtcattctttattagggggaggacagggaggaggaagagaggggacatgaggaagggagacatggacagctctttcttgtcctcaaattatggttcctagggcctggcacaaagtagacactcaggcagtatttgtgaatgagtcaatggaaagaaaacgaatgaatgtatggataggatgtggatatgtggaaaggggagagggcattccaagaggaaagaatagcagagacggaggtgtggagcctagaatccaagtggcgatgcaggcacaggtcccagcacagaagtcacaggaaggctggtgggcacatggcctacggacagtggaggccttgagtaccaacaaacatggactttgttccacaggccacagaaaaccagacatgatattcgatctccacaaaatccccaaggaccacccactaccaacatgggcacagggggtgtctgggatctctggagaatgaagcagcctgttgccaggatgccaagaacaggctcagtgtgacacacatggcccacactggctcaccagggcactgctggtgcagacatgatgaaggctggaacccacacctgggaccactggtgaggaaaactccagaatgcctatgccattccccaggaaaagccacagtgtgcctgcccacttaaatagcagtagcagggggctctgaggttacactcaagaaagaacttcctcctagagggttctgagacagaaggataaaacttccttccctgaagttttgtgacaggaacaaaagcccaggatgtcacagcagatggaaatgtcaaaacttgatgccccaaggggaccaggcaccagaattcactcagcactacattattaagcacctgctggatgctctgctctgcactggcacagtgagggggaggggaagacaccagctgggcctacccctcgaggggcctgatttagaggggctagacacagacacccaaacatttgtgggattaatggtgcagctggcagctcagctagggaaactggtcaaggtcacccgatcagtttgtgtgatggtggtggggagcccagaggtgcccaggtgctcagccaaggagggcattggctcctccataggccaagggcagtatctcaacaggcagaggaggtggtgggacccctgtccccaagacttaccagtcgcccaacaccaggacacagagcagctctggacagctactgcaatcagcacagttcaataaccgtgaaagaacccgtggtccgtcccccacagctagaagctgtggtttgaggaacgtggggaggttcagcaaaccttcttaaagagttctttccatccagcatagttctcacaagggcattcagccttaatgtctctttctctgtttatgcctgtgctatatttagcccctttagagaaggaagaaaatcgttttttaaagatgctacccaccccacagatgaacacttcccaccaccataaaggctgggggtggagacaggggcccagggaaggactggaaaatgcctagagggaggcctggcatccactcggcctcgctgcctgccagggagacacaggtgtgggccagagaagcaggtgaggaaaataaaacgggagagcaggagggggtgggcagcaatggtttgcagcctcaatccatccactcagcagagctcgtgtgctctcctggatggaggtttctggtacagcctgttttgggggcctctgcctggcacacggggccagggacacaagacagtgatagccaaggggatggcatgggcccgggcacagaaacctgtgtgctgcctatgctgggggcaggcctaccctgggtcctggtgagacccacaaaaagagccctctctgtgcaaatcgtcagcagagcactcaggaactggttccctgacacaccctcagcctctggaaggaaagaagcccagcattcatttcatggttgctcattcattcattcgtctttgagccaatgagccactatgcttgttgctgggaattcagcagcaaaatgatcctgatcctgaacccaatccagggtaatgttttgtgcatggaaggagcgggccagagtacagagcctggtggctacactgtccttcccaaagcaccgccacacactagagggaatgggctccttggaggttcagctggggtctgatgctggttttgcgcgccccaggagggggccctggctcagcccacctccatgcccaacacagtcacaaacaggaacactgtgtgcctctccctagtgtgaagcccaggattgcttctcaagatcttggctccattctctgttgcttaggcgtgggaccctgcctggtctccctttgatacctatccatcaccatgtcaagtgggagagacgtgaggggcttaagcatgccagcagcataaagcaaaagagcttctccacacaccctgctagctgcctctcctggctctcagctactctgaggacagtgtctgtaaagtcctagcaccttgccttgtccttggcaagtgctccattggtgctagccactgccctggtgacctcaaggtgggcaggaagctttcgtgggccgagatgggctacgccttgggtttgaatcttggctctgccacttactggccatgtggccttgggcaagttctgtgacctccgggttttgggggtggttaataacacagccctcttcctaagatgctgatagggtttggatgtttgtcccctccaaatctcatgttgaaatgggatccccagtgttggaggtggggcctagtgggaggtgtttaggtcatgggagaggatccctcacggacagcttggtgtcctctgggcagtaatgacttaccattagatctgcttgttaaaaaatgtctggtgcctccttgcaatctctctctctccccatgtgacggactagctccccttgccttccatcatcattggaagcttcctgaggcctcaccagaaacagatggtggcgccttgcttcctgtacagcctatagaactgtgaaccaaataaaactgttttcttcataaattacccagcctcaagtatttctttatagcaacacaaaacagactaatacagatgccctgaggactcaggagataatgcctgcatacgtcccagtctggctacggcaaatgctccacagatctccatagtggtgtctgtgctggtcttcctgacccagcagggtgctctgtggcatgaggactgtcttctggtcttcctgacctggcagggtgctccacggcagagggactgtttgctccctgccacttctgtgggaccaggcacgattggggcttacagtgagggcctcatagaggtttaatggactgaccagctgtacccctcccccttcccctctgggtgtccaaagggctggcaaggtcttaagaacaatcccgagatggctgaactttggatggtcctgcccttggaacaacaggtgtcattatcccctccccataatcccccctggctagaacccctgtacccacaaatcactgctttctcctccccaccctcaggaacagaatgccatgtctgcaggggaggacagcctcagggagactccacaggggatggaataggtgtgcactcatccacccatccactcacccatccatccatccgcccatctattcatctatccatccatccatccatgcatacatttcttccacagatgttcactgagttcctgtctgtcaggccctgggctgggcactgggcacagacaggttgagaagctccagcgccctcccgtgaggagctcacaatttcatggtgagggtgccgatggccaaactcatagaccctgaagaccattaagaggcaaaaaagaaggcttggctcttctctggagactaggccgtggttctggcccttgagtctttgagtccctatagcatatgaaggcacaagaacactcagcccccacacccagagcatcccaccctgctctcccggccccacctgcagagccacccggcctgcacatcacctcactgtgatttccggttgggaaagaggttgtggccaatcccccttctccccactgcccaccactggccactccctggcaggttccagccacagtggctctcacaaggctggctttacaactcactttctccaggagctagggccaagcccgagaatgcaccttaaccactgagagattccctttccaggggaagaagtagcccttgaggctgaagtggcagccatgttcgtgctcagcaggggtgaagttgggtcccgttatttgttcacttagcaaacaaggcacctggccctgtgcagtagacggaagagagcaagtgaggcacaatcctggccttttaaggactatagagagaggacttccaataggagatgcttaaggaagaagctggccttttagctgccctttaaggacagcccaggtgaggatttgcactgggtgtgtgtgtgagagcttgagagatggttttccaggcagagtgaacccctggacaacagcacgaaggtgggaatggcaccgatcatgatcgctgctaacactgatggtaggctcactgtgtgccagacaccattcttaacctccacccatattagctcatttaagcctcacgactgccctgcgcattaaatactctcatcctccctattttacagatgagaaaactgaggcgcagagaggcccaggtcctgccactggtgatggcagtgctgggtctgcacccatgcagtctgtctgcagagcccactcttcaccaccacactgttctgcctgtgagatgtgaaaagtgcagcatatgttgggggaacaatgaataattcagcttggcagaagcacagggtatgtgccatggagaccagcctggagaggaaggcgggggccttattgatgaggctccttgatgccagacgaggcagcttgcccttaaatctgggccatggggagccatggaaggtatttgagctgtggagttacaggagaggcaagacacagggagaagctcatgcctccagccaaaaaggtgtgtcagcagggccttctcgcccatcatttccctctgctcccatcccctgttccctggaaaaccttcccctttcctcccacactttacttctttccctttgggaagggtatagatacaggcagccctgcctcccctatctgctgtgtatcacctgggcagcccctctctgcttgtgagcacttatttttagaagaatttgacaatcgtccaagggtctaagacgaacagatggcctgtcttaaaggctcatatgttcgctagtttgcacttctgacaaacggtaagcatactcgagagcacaccataaacagcgccgaatgaatactcagaacacaatttagctaatgcatgtcattaaaattaggagtgagtgatggccaaggttccctctaaatgcctgccctgtgatgcagtcaatcccccggggcccaggctatgacgtggacacacctcacttctcccatgacccccacccagcaagccgaggtttgcctcatttacgcagatggcagggcaaggtttgcccgagtgggtgtgacacccaaccctggcctcagagtgaagctggtggcccactggccttggacaaagccctgagatgtcctatggcagagggagcagcagctcttccatgcacgggatgtgcgtgaggttttcccgtccctgcctgccagacagtgaggcagcctgtcgtctgccaccccggagcagcaggagatgagtgttgcaacgctcagccagggaagctgtctctcatgtgagagcctcaattcatccggaactcccggcctagagggagattccaacttccagggagcaaggggattggctttggggtgggggttctgcagcttccttgccgaaccagtagcagaagcagatgcagcgacctgagtcacctggggtaacatttgagaaagagccacatccacacagcctctgacccagactccttttattgatgccaaccggatccaggttttccgtgttcttgagatgctctatggagccgaggcggggaggagggtgccccccactttccgtgaaccccctcttgccaggacacaaaagaccaacgcaggtggcttggtcaacaatcagttccatgagcaggaaactcttccctcgcatgaaaacgtgggagaaaatattgtggggaagaaaaaagcccaataaactcccaagagggcaggttctgtactgctgtactttggaaataaaacccaccaggggatagattattaggagggaaccgaagccttctattaggaacccagcccgtaaacaggctcccattcagagtcacccaacaaaacaaggggactaataatacctgcctggagggacaggggactcaggggagctgcacttcagaatgcaaatgggccccgtcagtctgtttgtgagcagagaattgggtgagcggtgagactttagatagcagccgtgcaagggaaaatgagagttttatggctgttgtcacaagcaaaggaagatggaatgcttccagggctgcttatagacttgctcctcctcagcaacagagtctatgcctgactctgaggcctgagttaatgtgacccccacctactgctgctgtttctccaaagaaggtgggggtaccctgtggctaagccccttggggacagggtacctagcagcagattcaggactgaaaatcgggggtcctagcaacagtgtgccaggtgaccacaagttcacttctgtggcctttggccccctcctgggtagaaatgctgcactgatcttgtcaacctgtggccactgcaaactccattctaaccacagcagcctgcttgaaaccaggcccccgtgggacagctcatctcaaatatgaattagtgcacagtcccctgccctaaaagagcctgaatcagacccctaaaagatggggccccaatctgatgctgctgggccaggaatccagtcaagtgcacctcttgcaaagccttgagaagagcctggggtggaagtgacgaaactccataaaaaatggcactggagctgggtgagtggctcatgcccggaatcccagcactttggaggctgaagtgggaggatcacttgaagccaggagtttgagatcagcctgggtgaaaccccatctctacgaaaaaaaaaaaaaattaggtgggtgtggtggcgtgtgcctgtagtcccagctactcggatggctgaggcgggaggatcacttgagcccagaaatttgaggctgcagtgaactaggatcatgccagtgcactccagccacagggtgagacctcatttaaaaaaaaaaaaggctattgggtggacgggttctcaaaaccaaaaaagggttcacttcaaagtatatctgttgctcttagtgtgggtcaaagaagatcatgcacgtgaagcagtttgggaagacggaagcacctgtcagcaggggtaccaatgctcagaaaatgtttatgtcatgaaaaagagcgggtgaattccaggagatctgtctgcagtggggaggattcctctgaccacatggaactgcatgtctggatggaggcctcaagattagagtgtgggtgctgtcaggttcacaccatggacaagtgcagcacaggccaggtgcaaagcagtaagacccagtggggtctgtgtcagccccaagaactcaaactttgtcaagaagaggcagcacttgtcagctctaggcaatgactgccacatgcgaatataggcccagtgttgcttccggttttgcaagaaaactggaaatttagatttgtttaaaatatcagctttcttagaggaatgcttatacactgttggtgggaatgcagattagttcagacactgtggaaagcagtttggagatttttcaaagaactaagaattgaactaccattcaacccagcaatcccattactgcagatgcatccaaaggaaaataagcattccaccaaaaagaaacatgaactcatatgtccactgcagcactattgacagtagcgaagacatgaaaccaacccaggcgcccaccaagagtgggttggataatgaaaatgtggtacatatatatatcatggaatattatgcatccataaaaaagaataaaatcatgtcctttgcagcaacatggatgcagctagcagccattatcctaagtgaactaatgcagacacagaaaaccaaataccacatgttctcactcataagtgggagttaaacactgtggtgcgcacagacataaagttgggagcaatagaaactggggaataaaagagctgggagggagggaggggacaagggttgaaaaacaacctatgaggtactatgttcatgacctgggtgatgcattcagtcataccccaaacctcagcagcatgcaatatacccatgtaattaacctgcacatgtattcctggaatctaaaataaaagttgggggaaaacggaagtaaaataaatccataaactttcttgatgtttaaagtactatgcaagcccacgaaaacatatctgcaggttgaatctggccctcgggccaccagcttgagacctctggggttggtgagggcctcgagaagccccagacaccctgaagtgaggtggggagtggtgtcattaggcagcagatggcccaacattagttgaatcctcagccaaggggctgggatgtgggactcggtgtggttaagttctgacaaagagggtaagggtagaagatgaagttctgttaagacagaaccatccatatgtcctgggttctgctgcctcatgggcattcccacccagccagcccaagtgtttctgggtgcgccaggtgctggcaaacctgggagaccaaggagcatgtaaggagaccagaaactcccactttcctagagccacccaggaggctcaacacggctgtctcgggggttgtccgtgggctatctggagagacaagcgccagagtttgccacatgaccgcattcaaaaatctggaccataagtaacccccacaccttccttgcttcaaaggacctgagatccctcccttctaccctccacagtgtcccatggggaataggagaggccaggcatggtagaggggcagccccttggggtgcttacgaaagcagcctcccaaggcagcgttcctattactgtgcacacaccactctatatgcatgcacacacacaaatactctagacacacacacacacacacacacacacacctgcccccgtcatgtgcccaccctccccacacacggataccccccaatcccatgtgcccacacacataggtccccacaatcccatgtgcacgcatacacacacacacacacacacacacacacacatggatgccccacaatcccatgcacactcacacacacacggataccccacaatcccatgcacactcatggacaccccacaaccccatgcaggtacacactcatggataccctcgaatccccccccagaaacacacacacacaccccagtcctgacactaaccatgtagtgctaagcggtcagaggccagttacttttactttggccttctgtctaccctgtgcggctaatctgccccacgttcaccccactgctgagtccctccagcagccccacctgcccaggacgcaagggccccttgaaggcccccttcctggcaaaggaaagctgagaaaacaacgtgaagcacagtccgggttgtctcctcgaggaggcagagctgtagaagggtttctgctttttaaactccctggcgggtcccacccacacccggaacacatccggactctgaccacagcccagatggccctccatggtctggttcttgctggcccacagcctcagccaccaccttctgccaggcccccaaacaccgcagcccggaagcccctccccctcccagcagcactcccgctatccagagtgtcccccacaccccagttttcctggggcttctccacatcggagccatcctcctggagcaggcttcctgtccgctgaccacagactcccatcacaacatcgctctgcaccttgcagaggcttcaactctgcatgtcctgcaacttgcagtgacctggttgttgacgcaccatggccaactgcccctcatgacaccatcagcgcaacaagacagggaccttgtctcagctctccactgtaccccattagctcagagcctgtgcttggtaaaaactcaacgagtatttctgaaatgacagcctgcaagctactgtagcaaagccaggcctccactgatagggtcaagggagaagaagaaaaaatacagttgccccgctccactgtcttccccataacccttgccccggccatgcccagagcaggttatacctttttcttaaagctgggatggatcctttgaggacactaggccaggtggaatgaattattatatgatttctcttgtacgaggtgcctaaaacagccaaatcatagagatggaaagtggaacagtggctgctgggggctgggaaaaggggaaatggggagttaatgtttaacaggaacagagtttcagatgggaaagatgaaaaagttctggaggtagatggtggtgatgattgcacaacagtgtcaatgtgctgaatgccactgaaccagcacttaaaagtggttaagatggtaaattttatgctacgtgaatttttacaatgaaaaacaggccaggcacagtggctcacacctgtaatcccagcaccttgggaggccagcactttgggaggccaaggtgggcagaacacttgaggccacgagttcgataccagcctagccaacatggcgaaaccccatctctaccaaaaatgcaaaaattagctgggcatggcagcgtgtgtctgtaatcccagctactcgggaggctgaggcaggagaatcacttgaacccaggaagcggaggttgcaatgagctgagattgtgccactgcactccagcctgggtgacaaaatgagactctgtcaccaccaccaacaacaaaaaagtgggcaggatcttagaaggtaagagaaagggttgctgcaccaatagctaagacactcagcgacattcctggctggaaggtgcacagatcatagcagcccgagacatcctcagctgggtgggagggagccacagcatcccaggacaacatgccaccagctgagtgcaagcagaggggctttctctgtgctgctggggctgagccatccactgttgtctacagtgtggctcccagtgccagctagtggaagaacagaagacctcaagagacttgtggaactgggagctctttcccctatggaaaggcctcacctgcagtcataggccagtccagcaaagggggccctgatggcttacaaatgctgcaggaaggaagtgtctgtgtttgctctggcagggcaggtgggaggcaggaaggtgagcacagggcacacctacacatgacatgttttgccaggttggaaaaaaataagtgggagaaaattttttctgactctgcaagcctttaccactttaaatatttattcatcaaaatatgatgagaaaaccaagatccacatagagtcaccatattccacaaaccaaaaatcaggacaaacagccaagagctgggatggagtacttgaaatcaggactgtactggaaaatctaggtcacacggtcactaattatacagaacacatatgttcaggtccccaaactaacccagtgcttttaggatttgcaaatgatataaggaaactttgatcgtgtccatttttactttcttccaaattttggttaaaaggaaaactttcctgcatcctcaaaatttctagaaaattaagtcctacagactaagaactgttctggcggatattctgagggggcctcctcagaaaacatggcccatcaacccccaagaatggcccccagcccctcatggcccagcccccttgctgacagacccccaggctgcagggcagaagcttgtaaggatggacctaatttgctgtgataaattgtgtgcacgcaccagtgatcaaaactgcagctgagaccgattacactttatgattgtgacggttcttgggaaacacgtaggtgtacatccttgccagtccagagagggggtccaacctggcacccagcaaagggtgatcccgtcacccagaaaggcagggctccatgggctgcccactctttggaagctggtcccactgatgaggctgaagaatgctgtggcctggcctcaaatgcctcgtctgccctctcatacatacccagcctccaaccaaacagtgggcacattgtcactgcccagatacctgccccacaatgatcaagtgggtctgccctgtgccccccacttctatcaccaggcagaagtcactggttttcataatgcaaaccaagaattatctatatcgccagtctgtcccatcccactcatctcaccagaggggtgtgtgctttcgtgtgtgtgtgtatgtgtgtgtaggtatatgcacagttttaaagtaaggagagggataggtaagagtgaagtgtgaaattaagagcacacgaagaaggcatccgaaaagctgtgtggttcttgacacgtacctcacactcaatactggagggtgatgatggtgaaagaacgtgtagctggatggatagggagatggatggtagatgatggatggatggataaatgatggataggtgggtagatgggtatgggggaatggatggtagacggatgatggacagatggatggatgggtagatggaggaataggtaggtggaagatggatagtggatgaattggtgagtgggtggatgggtggatagataggtgggtaggtggaggagtgggtggatgacagattgatgggtagatgaatgaatagatggatggatggatagatgaaatggtgtgtaggtgatggacagatgtatggatggatggaaaggtgggtggatagataggtgggtaggtggaggagtgggtggatgacagattgatgggtagatgaatgaatagatggatggatggatagatgaaatggtgtgtaggtgatggacagatgtatggatggatggaaaggtgggtggatagatagatggaaggatcagtggacagattggtgagtggatggataggtggagagatgggtaggtggacgaatgggtaggtgatagattgatagacagatggattgatggatgagtggatgggtggctggaggatggatgagaggatggatgcatggatggatggatgggtggatggattggtgagtggatggatgagtagatggattggtgagtggatggatgagtagatggattggtgggtggatggataaatgtgtagatgaatggatgaatggtgggaggaagaggagtgcatgaataaataactgggtaggacggtaaacgttgatgagttgatgagaagacaatgggctttggagatcaaatcttgccttggctaattactgtctttctgaccctagccaagtcactcgcttctctaagcactccttcactcacctgaaaagtaagactaataatatctacctcattgccttgttagaagcttcaagttagataacatatgtaaaaggttttataacatgtaaaatgctgtatggacacttaatagggtcataactaatactaaccacagggctttgtcatctctgtcaactaaaaaacatggatgatcccacattttttttttggtagatacggggtctcattatgttgtccagcctggtctcaaactcttgacctcaagccattctcctgcctcagcctcccaaagcactgggattacaggtgtgagccaccacgcctggccaataccacatttttgatgtggcagcttctgaggcaaagatgaggaaacaaagatggcgccacaggtcagggctgcagctgtctagactatacctccaggtgtggcctcagctgggaaactggtcactgtgcaggaagcagagagcctcacttgcctcctccgctcaaacactcaaacccaaatgagtagaacacattccacaactcccaccacaagccccacttctctctgccagtatcctactttaatgcccaggtcccaagcctgtattcaagtctacaaaatggtgagagtcaagagcatttctagtggcccctagaatgttgcagaggcagcaatggttgcagaggcaccaatgagataataattgcaaactgtgaagtgtttcaacggggttacaaactcacagtgcaagttggtaataagccaggtaaggaaggccagttgtgggctgtgttgaaccaggaagcacatcccagtatccaaaggggtcacacagaaatgtcggccaggggctgccaggcctgatttatagaaaaatcaataaatccagccatttagtgtggtggtgaagaggacagaagccggggctggtggcctgggtccagcattaaccagctctgaggccttggggggttagttgacctctctgtgcctcattttgcttgtcttcatattagaggcattgtgaggatcaaatgtttttatgcctaccagtgctaagaacaatgccgggcactcaaaaagcactagctaaatgactctttatgatgatggaaattctctgttttaaaacacagacaaccagctaggcgcatggctcatgcctgtaatcccagcactttggaaggccaaggcagtaaaattgcttgaggccaggagttctagaccagcctaggcagcatagtgaaccctatctttacaaaaaataaaaacgttagctgggtatagtggtgtgcacctgtagtcccagctactcaggaggctgaggtgggagtactgcttgaacccaggagttcaaggctgcagagagctatgatcacaccattgcactgcagcctgagcaagattctctttcttaaaaaaaaaaaaaaaaaaaaaaaagtgaaaatagaatatagagaaccctctaaaagttccacaatccccaggccatggactgtgagttttcaccctctgctctataaaagtgttcaatgttataaaaacagtgacttctccttgtgcgtcccttctcccctatgtgaggagagaccgggttagattgttctggatgctcctgaagtcagggagggcaggggcaggcatggttccttatcctactggaaatcccctccctgccctagacaattttagcatcttgctcctcaccttccaccacgcttcccaccaacgctgtattttatttaccctagaaccccaaagagcataagatgctccagtattttatgtatcacaacaaacaaaaaatatgaccaattaaactacagcacacaaatgaggtattgcaacttaatgtaagagaggctctaaggaggaaagctgtgtatcttaaaatacaaccgtgaaataaggcaacagctcccgtatactgagctcctaccatgtgtcagaaactggactctctgctctttatatattatctttacttctcccagttgttcccgtttgaccgatgaagaaattgaggctcagaaaagcaaagtggctcgctaagtcgtctagctggtaagaggtggtacatagattttagcccaaatggccctgtcctaggatgactacctccttccctctcactgtcccctgccactcccatccctgctgtcccctgggacgcctaaaggagacaccaaactgaaactgtcactttcccttgctcatattgcagccacacagtgaatctcaatgcagccccggacaagccccagtccgtccatgattgattctgtctaaacttcagaagcagaatgagtggagccacattattgacacagcaaaattaattttctgccatctcctcttccccatgcccggcccccagcacctcgcctctcctatgagtattggcgcacggctgctgacgggtgctcctgaaatgccaacttgcatttctcatcattaatttctttgtaaatgtcattagtaattgttcctgcttgaccaaagagtacaatccaggcttccacccagagcaccctggtctctcgttgatgggggctaagacatccccagccatgccagaccccagcctcctgatgcaggcagccatccccgctcccaataagtcaggatcacaggctgctgtatcaagaaagttctgacacaaatggagttcagtaacacaaaacatcctgcccttggtgttaggacaatggttgtatgttcaggctgcctgggttcaaatctcatctctgcccaactatgcctcagtctccccacctgtgaaacggggataacagcagcactggcttcataggtttgccctcagaatgggaaaaaaatcaaggcaaaaggattcccttagtgcctggttggtggtggtgctaccatcgtccttcaccttgcctcttaccaccagggttgcaggttcagctctgccacttaccagccgtgggacacgacatcaagcgagtggcttaaactcgctgttgagcctgcttctcccatctgtgaaagagggacagtgatatccacatcaactctgccaattccacctcagatgttgcctcctccatgtggccttcctaggggaccaggcaccatgctcgatgatctacaagcatgatgctgcatccccacagtaaccctccaagaggggcactggcagcccactgtccaggtgacgacaatgagtcaccgtgagggaggtcacatgcccaaggtcacattgacaaagcaactctgaggcccccaaacctcatttctggggggtggacgttgactgtgctccttgtccctagaaggcccaggacacaggcctgaacccttcgccgcaaagcagtaaaaatgaggcagtgcttcctgagtgctgctagggacctcacagcaagcccttcccgtgagtagcttcttacgacctcacatgagtgtgtctccttgttgtaaatgggtaaactgagactccccatgtgggcagagctgccaggaaagcagagctatgagcccaggtggtctgacaggagtgtctgtgtctgtgtctatgtctggggtcttcccctcaggccccaaggccccatgtcttcccgtgtgagaggctccctctttgtctgagtcaatgcggggcagggcttacagggtgcaaacctctgtggatgtggagccggtgaggcgccgccactcgcagtgttgtcactgttactaagaaactgaaggcatgtggtcccggctgaggcagcgccggggaggggttcggctcgccacacacacaatggccaccggcctgaggctcctggcagctcccccgtgcccatctgtcgagatggcatggtgccctctaaagttggttggccccctgccctagggcatgaatgacaggctccaatgggcagacgggcagccggaggctgattccaagtgccatctctgcctggagctgggccttgaggggaggccccccagtccccacctgggcctccacacacttcattgctcaggcgagctgaccctcaaggctcacgagggtatctgagcacagctggacacagacttctgtttcaacactacccctccggtgcccgctcctcactgcgcctctgtggtgaccagggagaagccattgctcacccagggctgtccagaccagcgacagtatcatgccccgggagctgcatgcagcctccatgtcaccctctagaacgcctgcctcgctgggaggtgaggcccacttcgagaccctgcacccagagacctacccttggcttctaagggctttgagagtcatctccaaccccactgcctcagcccgcaggctgcgaacacaggcactcatgtcagactgcctggcctcacatttctccacgctggcagctatgtccacatggggagcctcagtttacccatctatgacatggacctcatgcgtgaggtcctaagaggctacccacatgaagggcttacagtcaggttcccagtaagcactcaggaaatgctgtctcatttgtactactttggggtgaggggctcaggcctgtgccttgggccttctaaggacaaggagtgttgtcagtgtccaccccagacttctcccaaggcagaccacaaactgccacacatggcccctcaggagacacagctgcctccagtagtggcagcaataataatcatgtcaatgacaacagtgatgatgatgatgatgatgccacaccttattaggttgggaacacccttgccccacttgacagtaaataaaccaaggcttagagacacagaccaactgtgctcgtaacacagtaacttacagggagcaagggcaaagctcaggctccacagtgccccttaatgtcacatgggggcccaactgtggggctctgttttgtgtagcacttatgttgtatttagtatgtagtatgagtgatatggtatgatgcagcactatactatactatactatatactataccatattacatcacattatattatattccacaaacacataacaaaaattctgtttgtccttattagcttactttcccctccctgcaacatgtgaggggcttagtctatgcctctgtttgtccccagcacctatgcacagctggcacagatcaggtgcttagtaaacacttgcaggctagattgagcacgtccacacatgattgattgaatgagtcaatgaacgcattaacagaaagcccaccacctccagaccacaggcagggcaatgactagggctcaccaacctttgactctgacccagacccaatgctgggagcttttcaggcatcactgccttcagctaccccagtaccaaacaaagaagggctcttcaataaccctggtctcttgaaagcaagagaatgccggtgacttgcttatggtcatggagctgcttggtggcagggctggcatctgaggccagactgtgagctccacagcatgggcatggcatcgccacaacatgtggtcacattcagtagaattcaggctgtgctgggctctggtttcctaccctagtggggaaggcaggaagcataaagtgatcctattggaaaagggccacaatgaccctcagcaatccttctatcctaagtgctataaagtgctttacacatgcgaactccatcttcacaacaacccgaggcagcaggtcttaccccatttaacagatgtggaaactgagcccagagaaatacaacatctgcagtaggaaataatgggcggctgggcacggtggcccatacatgtaatcccagcactttgagaggccgaggcaagtgggtcacttgaggtcagaagtttgagaccagcctcgccaacatggtgaaacccctgtctctcctaaaaatacaaaattagccaggcatggtggtgggcacctgtaatcccagctactcgggaggctgaagcaggagaatcacttgaacccgggaggcggagattgcagtgagccgagatcgtgttactgcacactccagactgggtgaccgagtgagactctgtctcaaaaaaataaaaaagaaaataatggggattgggagacttcggggggtcagcagccagcccaactctcagccctccccaggctcctggcctcacaagtggctgactccagcgtgagcaacaggttctcactccctggaaccaccactgggtgtcagccagcaacttcaggccacacccatctgggccctggtctcccagcagaagtcaggttgacaaggatggggccatctctaaagcaggaaggaggaagatgccgctactcacagaaagcgcagccagagtcaaatgctaagtatgtgcctagagcacttttgatttttaattattattagttataattatctggctggatccaacagcagcagtacaaagagacaaggaaactggctctttggttacccatcttataaggaccagggattttaaaaatgggctcccggaatctgtgggtttccccttcttccttttcctcctttcctgcttgtgttctctttccgactttccaggagctcaaaaaatatgttaacacatatggggatggatggatggatggatggatggatggatggatggatggacggacggatggcaaagggtgtcttcactctccaaaaactcacgtcagagtggagagtttggtgtagacgtagtgacttacaatccatatggccaacggaatcaggggggttaaaccaagggctggagaaaccaaaggaaggagaatccgagaggcttctcaggggaggaggcactggagctgggctgatgcattaagagaaagaaagggtacttcctgcaggcagataggcaggtgtacgtgcatctaggaagccccatcttgatctcactgggtaggcgatgcgaggccagcccaggagaataatgcaggaaggcagtggccgtctgtcctgcttgcccctctagtccctctgcctttttattctgttctgagaacaccccaaatctgcttgggcctcagatacttggtactggctcttccctctcctggaggatcccccagctcttccccacactggctctgcaacctccaggattgagctgaaatgccagcctttcctgaccacccaacacacacacacacacacacacacacatgcacacgcacatgcgtacacacacacgcacacgcacacacacacacacatgcacatacacacaccactctccatcacagtacagcgttttcacattctgaaatcccctagttcatgtatttactgacttatcatcagtgtctcccaaagcatgtcagctccatgagaatagaaaccctgtctccttgttcccagttctgtctcaggctcctgaggtggtgccgggagtaggtactcagtaaatggaatcagggcaagggctgaatcaaatgttctcaagggctaggaaggaagggtcccaagggagctgagatcccgcccctgtctcagagagctctccctctggccgggtaccaggaccctgcctggcagagcccggctcaccctatcgaaagggctccgggttgcttgttagaatacctagctctgcttttaatcaattgtaatcatttagctggaagcagcatgattaggcacacacaagcaaacagcatgagctaatcctttaaatgcgcccgctcaacgctgggctggccgctttgccaccgcgggcccggctcacggaatcacttcctgcagcccctggctttgtcaatgagggagtcaagattccagggcgtggcgctggtccaacaccccaaaaccatcttcatcaaggacatgtgcatgtgtgcgtgcacacatacacgcgctgtgaactctgacatgccctggcaggcagtgccccacagctccaagatcccagaagttctatgtctaaaaagacatctctctagttcaagttctattcccccatgacaggaccaagcaagtcataaaggggagaaaggtggcagcaccatgaacctgaggtcttaggaagtccctatctccgtgacgagaatgaatccttcctctccccaagcccagcctaagccaaacccatcctgatgctcatttgcaagcaacagggtttgcagggtcctggcctcgagctgcagcctggcaaacgtggccatgcacagccctggccccgcgcgcacaggccccatggcgttcccacctgggctcacccaggagcaatttttcttgcatcccctgttactgctacttgtgctacctgcttggcccaactactaaaatagtttctgggtcccctgacaacgaaagctttttatagttcagcactgcaggcctcatttaaatctattagctcatataaatggcaatttatttaaactttggagggtttctgtttgccttggtggcaaagacaatccagctttatgtgtggctctgccatttgcaaatgaccctcggcaaaccgcttaacttctcagagcctcagtttctgtatctgtaaatggggatgagagtaccttgttcatagggctgtacacaatccatgcaaagtgctcagaacagagcctggcccgcagcacagacctagggcccaggggtgaaggccatgagaattgtctctggtacaatttcaggggagcttgtccactgtctaactccagccctgtatggctggtaagccgcatatgaccctcatgcacgcatccccacagtgaggatgaagaacaggaagcagcaaggctcttaggatggggagatggaggcaccatccgtgcccagtgtctgtgggcacagaggtgcccatggggatgcagagacagctgggctggtgggcagaggcgacccctcccctcagggtggctaaccgctggcatggggccgatagggccccaggccttcatctgctgaggcctgaggctgggaatgcaaggccaacagctctgacatttgcgggctgtcttgcacccccagtcaaatctacataccaccctccacggcgcccggacgtggctcagaaatagagggtcctaagaaaagagcccaggtcaaaggcgctcagagaagtaggggaagggggacccgaagccccggccctctggcctccattccatgccctttatgccccgtctcactgccctgggcacctggctcctcccaatgccccaatgtggggtctcctgtgcccacagccctgaggcttggtgggatgccacacaaggaaggacttggagtctcactttgttcaaactcaggctggaaaccatgaaagcaaagcaaactccaaggagagggaatccccaaagccatctgatcctcaaactgcccagaagtcaatgtcaataataatcacaggcagcgtctgctacatgctctgtgtgccagccactgtgccaagggccttttgcaactgaactcttaagtaggaactactcacacccctgccttacaggtaaggaaactgaggcttacggctggtgcatgacagagcaaggttttaaatacggagctgccctcacaaagactgggccgctccctgcttcactcttggcagcatttcagacacgtgcattgtttgcacacttctaccgacagggacctcagcactttccatttctggacagttttcccgcatactgcaaatgctcagtgtccatccaggtcatgcaccccttccctgaaaagcaccctgaacttgctggtttgtatcatatgatcctacccccagccacagctcactggagcagggtggacagctgacccaggctcacctaccagattccccctccagggatctagcacctgttgcctgagggctggctgccaccgctgtcactatctctggggtttcctgggtgttccttctggctacctgtgtcaccaatcctcacactaaatcctctctgttgagctacctagggtgtctgtcttagcagaattgacaggagctgtggaaccttgaccaccttcctccttgtacagaggagcccagaaagtcaggctgtagagagagaggacaataaaagccagaaagaggcagaaggcagggaccaggcagtcttagagaagacagagtgtagctgccttatttaagtgacacttggctccgggaatagggctgccaaaaacccaacattgcttcctgctcttagcatccaaaatccactcatgtccctacagcttaatttcccttctagcttgcgccaactgcagagagtgatgcctgagccatgactatccaggaccaaaacccctgttctgagttggcgcccactgccaaaagtcttggagccacctgaagcaataagaacccctccaggacccagagttcttaaaatgctcgaagacaactgtccctgcatttcttctgcaatccatccaagtcttctcctggttaaacagacttaggacagactcctggaagcacctcgaggtcagactggatcccctactgcctgggttttcaaggtgtggggtgagcgtgggcaggtgtatatgtgggtgagggtacaggtatatggacaaagcttagtctcccctatttctttttctcttgctttcaagtcataggatttattttgttttgtgaaattgaaagctttaagccataacaaaatgagagaaaactttttttttttcattgttagatcaggccagttaatggtgagtttcttggtaatatcctttctccaccctatggcttcgaagttatcacttgggctactttaactctgtgactcgttgttgttcctgctgctgtcttctgagatagatatgctgcttactgttcccgctttgctccaaaatctcttcattttattccatttaagactaacaatagcaattaaaatgagcaaaggtaaaaaagaaatgtagaaactgatcaaaagaccattgtttttaggagcagcacgtcgttttggaaacaaggtacacttttttctaccgtaagctaaaatccatcattaacacttcctcctggtgatgatattggcggctcacaatctggaggagcataaccaggatcacactgacaatggaaaagttcattgcaagccctattctctctgcaatttatgttatatcttgttatatttatgtcactaagatatttgcatccttggaatctacataacctgtgttgaccacatgcacttgtagcttctgcataggtcccccattattttgaaccatttcttgcatgtgcagacaaacatacatgacccccaaggtaagtatattgtatatcaaagtctgtcattgatactgtttctgaatgtgtccagtgacaatctttccacaaagaatatcataaaaatgacaacgggaaccacagtttccaaatttgtcatttagaaaattcactttttctgtacacagaacactagcagacttagaaaattttccaaataactgtgcgcactgtctgtccctatctctgcattctcctttaaagcaatatctagtcttattgctgcagtattctaaatcagcagctttcacatcagttacacaaaactcagatgttccattgcaaaaaaaaaaaaaagtctcccctatttcttccctgcaactccgaccttcagccactgacaactactggtctgttttctatggcgatatatttttacctttttccagaatgtcatgtcaataaaaccatacagcatggaaccttttgagtatggcttttgtcatgtgacatttgagatttatccatggcaccagggacagtggctcacgcctgtaatcccaacactctgggaagccaaggcgggaggattgcttgagcccaggagtttgagaccagcctgggcagtatcatgagaccccacctataaaattaaaagttaaaattaaaaaattagctgggtgtggtggtgtgcacctatagtcccagccactcaggaagctgaggtgaaaggatgacatgagccccggaggttgaggctgcagtaagccatgatcacactcctgcactccagcctgggtgacagagccagaccctgtcacttaaaaaacaaaacaagattcattcacattgtaacatgtatctgcagttgccttttactgctgagaatgtacacatgacctgtaccaatgtaacacatgaccccatctgttacccatcctccaaataagggacaacgagcaggcctccggtttggggccatgacaaagctgttatcatcattcatgtagaggtattggtgtgagtgtaaattttcctttttttcttgggtaaacactaagagtgggattactgggtctaacggtaaatgaacgtttaactttataagaaactgacaaatattttgtcacatggccataccatcttgcactgccaccagcaatgtgtgaaagttcctatcccgccctcaccaactctcagcattgtgagtttttcatttatgtgggtggcatcaggctatggttttcacttgcccttccctaatgactaatgatgttcattttctttggtgagacatctgccaaaagatttttgctcattttttagttgttctgtgtcccgtctcattatggagttttgagagttcttcatatagtctggatacaagtgctttattcgatatgtgatttgcaaatattttctcccaatcagtgacttttcattctcttaaccatgtctttcaaaagcaaacttcttacattttgattcagggtgtaaatcagataatatctgtcccctgcttggtttcccatcatgatggagataaaatccaaagtccttcactgtcctgaaaaccttgccatgatctgggctccactgcctctgccccaattcactgtgcttcagctgcactctgccttctgtcatcctagccctggcacccagtggccacagggcctttgcactcacggctctcttccacacaatactgccttcatgccatcgggcctcagcttgcatgccacctcctcggggaggccctccctgaccacacttaccaaggagtgtctgacttcaacctcccagcatgctctagcccattatttggttttatttttttcatgtcattggctcttattggaaagtgcccatcaatcccctagaatgcagaccccgtgggtatttcttcatcttttcaccactgtcttctcaggtgctagaaacagggcctggcacatcatgggccctccacatacttgcttcaaacaaatgaataggaaagctagttccctctcatgttcctaattattcggttgtgaatttgcaacagtttgtctaaactcctttgaattaatctcagtcttttgggcagagccctccgaacttggaatcaaagaggactcacacctcccttatactggcaactgtgctcctgttaacgcaacctaagaaaacattacgtttggagggagacatgtcaatgttgacagagaccaagcctgtcatggttcagttctacctcctaaacttctattcctgcagcagcacttcctggtcctgcagtgagctcaatcctaagcctagaatcttctcaagacctctcagcccatagtcccttgtgcctgcaaataccaggtgcctggaatttccgtgcataacctcaaactacacaaggccacaagaaaccagcaaggatagaactccagctggccttgcctcccactgccccacccaaacccccagctcattccaagaaacaacagcacacttgcctgttccacccaaccagggccttccagccccagcttctgtgtagggacaatgaacactccaatgcctgaaaaaccctcctctcaaaaacgagaaaattgctattcaagttacttaacgagagccattatttgcatagatttggcattgcaacaacacttccgtatttaaacggtctataattaaaatcattaattgcagaaaatagtgactcgttaaggctgtaatttagcggtttctcagtatttgaggatctgacttaaagcttaacgggatgacccaggaaaccaccagctcacatgaaccgctctcaggtcaagtgtggcccacagctcgagataggtgggatcgaagcaagatccagattgaaagcagcagcctccctccacctctgcacttatgagctaggcccccagcccagtgacaccaatgaagctcaaaaacgtcaggatgggaaaccttctctgggaataatcttgaggccatcagagaagagacctcttggcatttgggacaatgcaggcgagccaggcaggagctgagcaagttcaaagtgtaaataaatcgtagtttatatgcactcacgggtttaaaagaggcctgacctgttgggctatagaaagcctcctctgtcaggatacccaggcctattttggtagctgggccactcaggtaaggcaggtaggataaggcggctgcatggactgcacttgggagagggtgcgcatccagcacacgagcagggaggcttcttggatggcatcaacgcctagctgtcgccccacacatcctaagcacagagacatcagctcagtttgtggatcaatggggagacagcagtggcatggtaagggtcactagctcagtggtggccttttggaagtggaaccccctctctgggccaggtctgtatgattggtttcataactctgtcccacgttgtgacaatgggataaaggcctcatgtacaatacacaaatttatgagcaccgtaaggatgaaaagaaacaggctttccaccacaccagctgggtgctcctcggggccagccctgagctcagcctacctagccctggcatggggccagcctatggaaacaggacttgaccatctaatggtgaatccccccggtccccacaccctccaagggcctgtttgcatatcctccaggcaacagccaccaccagctgtgcagacaggcgggcccaggcctggcagtgtgggtgggccacagcacagtaagaagggggccccctacaacaggccacagctgtgcccctctaaccccagagggggaggcaccactgtggccattcaagtgactctgcatggtgtaagtggccccagccttgtaacctgggtatgtgggagattgctgcatgcaggtgcagcagtggcatggggatgagggagggtgctgctgggtgtgtagggtcccccctggagggccaaactggtgtgtgtgagtccttagggctcccttctccttccaggcagagggtggaattccctgcctcacccgctttgaggttgggcatgcccgcgggacttactctagtcaacacaatgtgagagaaggtggcgtgcatcatttccgaggggaagcttgaagtgctggtagagaagtcaccacctccctcttctccctgcctcagtgactacggaaacgtggatgggcatggaccctccgtgggcctgggtcactaagtgaatattatgaacagagtctcttccccatcacctgcttggatatgtcacatgggcaacaaataaaccttttgttgaggacacagagaccgagaggaggtttgttattgcagcctaacctacccatatccttcccgacaggctcattcttggtatgtgacatttcggcatgtccgtctatgtgtatgtgtgatatatctgtggacatgagtgtggtccttcttttgggggtgcagtgttgtgctgcatgtgtgcggtattcctcagggtggatgcagtgttactctttgtgacatctctgggcatatacactgtgataggaactgtgtgcgtgcaccttccctttgtgtgtgtgatgctatggtccaggtacagtgaatgtgagatttttctgtgtacgtgtgttgtatttctggtgggcatgtgatctctccagtgttgcaagaattttttgcaaaaaccagtgggagagaaagcagtttcacttgggcacagatcttgttccttggaaaaaccagtaacaggtgaaatggggccccatgggattccaaggcaggtggctgtgaatgcctgggaagaccgtcacaccagcttcctttcccaaggtcctctcagttaccacaggctggggatgaggatgcaaggaagttggctgaggcccctgtcccttacctgagggccacatcagtctcaggacctctggtgactgcctctaagctggggcaatcgggcaccactactcttcttttctggcttttatggacaaaactggaggctccaaggccccagacctaactcctgttcccacacagccccaggacccagccacaaagacatcatgggcttctagccacagaaccaaagctcagtgaaatatcattttacaatagaggtagggaaattggaatccccaagagcagacaggacttgccacgaaacacctcaaatgtaagcttctgactcctgctctgggctcagccagtggcagttggttcttttgagaacgctgggctggcagaggccagggggctgaaactccatgcctgctagccaggaggtcagcccctgattgcagacctgccagcataagactccaccagcttgccttaaccctgagaccgtcggtgctgacgggggaaccgaggaccatcaggcggcgtggtgcagcggatgtgggcacccacctgcagctcggtctggaagaagaacttctgagggcactgtgagcagtcgtagatcttgtcctcctgcccgtgcacggcaaagatgtgctgctgcaacttgttggcctggacgaagactagacacagacacggctgtcagggccaagctcaggacaccagcccagcctcctgtggcagctgcccccacaacactcgcaggcagggatcactgtggcataggtacagtcagccaaacagtgggctactgggagtgttcttagcacatactagaggaggctcaagttagataagctgagctccggtacttagtggctgtgcaaccctgggtaagtcacttaacctctctgggctccatttcctcactcaaaaaatgaagattataatatgtccctagctgggtggctgggaggatcaaatgggatattgataaagtgcttaaaagatggcctgccacagacaaatgaatgctgtcttcctcgtccccatcatcaacagccagacacctacaggggtgagcttcttgaacccctcccaggcctgtaggacaggtgctattatccccattttatacaagagaaaactgaggtgccaggaatgttaaatggcttgtccaaggtcccactgctagcaagtggcagagcctagacttgaattaaataagctcagcacagggtcttgtacaagaagttgctcaaccaacacaaattcctatttttattgttgtcagcatcctcgggcccccacacagaggcccccatgtcctgggttggcagacgggcagctggggcccttcagtgccagcctcagagtgtggcagtgacagatgggtgggggctcctgcgatgagggggaagatggcatcagggtgctcaggggctctggggagccccaggggtgtgtgtttgggggatttgccccagagtggacacccctgggcctggcatggagaaggtctagccctggcttcccagtggcaggagttctgaggtggccccagccctgagcgcacccaggaggtggcccagagcagctgtgtgtctgggaggtgagcacttcagagataccctcctgccaggcgtcctccccagggtgggcttcctgccgtggcagacagcagatgtcgggggaggcagggaaggccaggctctcccacgcacaccggctgccatctgggcagcaggagggggccggcagagcccctgagacttgcctcgggctgggacagccattcgcctgggccggcagccagtctgggggctgggaacttggccggcagagctgcccttgacccctgcatcctggagcatggatgggagctaggtaggccagggaagggggaaccaggagtatgtgaagctgggagccccagaagtgctgaatagagctcaaggctcggggagacaaacacagggcccgggaggggaaaactgccgcagagggttgaggctgggttggacaaagggcttctagctcctgtgtgcagagggcgaggagagggtgccaaccagcctgctgatgaggagaggccagagagcactgaaggagggcgcgtgtcagctctgaactgagggacgtggggcaaagggcctgttaatccctcagggtatccccaacggagtcctggtctataacaggcctgccaaggaaagaggaagagcacacactgggatcccgcaataacagggcagggctcctgtgttcatctctctcccctgaggggcacaagctgggtaccttacctgtgaaacacacggggcatttgaaggtgccgcccatgccctcgaagctgtgctcaatgaggtgacagaggagcttggccggggagtcgaacatctggttgcacagcttacactcgtggttgatgccttcctctgcaaggaaaacccgtgaccagtcagtgaccagcatgccatgtcccccagacaggtgctcacaaggcctcccatagaccccagcactaacccccctccaatccccagcaccggggctggtgaagggactgcagacaccaagactcatcctggctccacatggcctcacccctagaggcttacagaccccagaggaccggctccaaatatgtggcccttggaggtgccatttgctgtgatttctcctgctgatcaagcagccaggtgtgcaggccatggtcaacagcttgagtcccaagactgggtcactgtgcagaggcacccaggatgaggtacaggatggagaaggtggtccaaccaggattttaaaaaatccaatcaaatatttattgagcatgtactatgtgccaggtactttgctctaaggattatttaggcaactaaacaaataatgtctctgcccccactctggtggtggggtagacagatgataaacaaaatcatcagcacataatgcagtgtcaggaggtgatgtgaatacatggcgagagcactctaggagaggggtgggggcagggccctgaggtgggtccatgccatgctggacaggcttgaagcccagcatgggaacacagtgcctgagctcagagggccaagagtgaggtcagagaggccacagggatgcacaagaaaagccctgtcagcccctggaggactttggaattttacttcgagactgacgggcagcatggaagatactgcaccaaacgctctttttatttgcttttcttttaaacaaatggtctatgcagtggatgatggacaacaggcaaactcgccatcctgcttcagaccagaacacagctcctccatctccccacctgggagccgctgagaccccaaaccttcacccaaaggcgccgggggacacagagtgcctgagcaccagccttgccaatgtcgaggaggctcagagctctggtgccctcactcacaatcaagcagcagcaggttcaaattctggctcctcagccccacacagcatgctgtgggcacaagctcatgtgcagtaagatggggaccacctgtcctccctgcttcccgggctgcaggaggacagaggggcccaggggtcagtggtggggatggggaatcccctggtttgagcttcacatcacctggggttggaatccgtccctccccttactgggtgatcttaggcaagtcacacaacctctctgtacctcagtttcctctgtctgaaacactccataacagcttttctgttatagttgctatgagaattaaatgagctaatacatgcacaggggtctggaacagaccctggcacacagcaagtgctcaataagtgtttactgccaggcatgtcagtgttggtgagagtattatctgggacagccaaggacacgggttcccctttgggctcccccagggaaccagcctcactgaaggcgccaggtgctctgatttgcccttaaaggcaagaattaggtagcagaggggttctgctggtggcaagacatgaacacagatgggctgaggctcctggcgagtccctgggtccctaggccctggcaggggctggcagagacagcaggcattccccctggcccagccatcccccgcacccccgggcaccccaccgcagaggcgcacacacacacgtgcacacacaggtgggtctgccccacatagcccactggctggaatctaccgggtgtttgtcatgcccctggagccctggcaactaggccacatacacccgacagagactcaaacagatcttccatttatactagcagaaaaggaattcattgacaagttttgggacacagggcaggctcagcacgctcgccctgcaggccccacgcacgtcctccacctcccttggggagacgttcatcataattagagatggcctccagtgtggggggctgcctcaaaagaccccccaatgcatcccctgccccctgcacaaacaacattgcccagtgcctggcacagggtgtaggatcaaggaaagaaagagactccacccttacatgtgaccttattagaatgaggacaccccgtggacattaaggagggagggggtatgtgaggttgacaactgtgcagagttttctgtaagaatagtttataacatatttcaatctcagaaataacccagcttacttggaaaactgcatttctgggaagaagaaatgggttcggagaattagaccatttactcaagtaacacagccagatgggggcggtgcagaagaggatacaaaacctttcctatatgcatgtacccccgccatcgtacaccaccgccaggcagcctgccctgacttgtacccctcattgtacatgacctccaggcagcctgccctgactattccagttcatgagcacacacacgtgtgcatgcacacacacacacacgactactccctcactaggcacaatgacccttgattcatgtaaccatgtgagattttctgggcttgcctgcaggaggggcttggaaatactcacagaggagagacgtccccaggctgggccctctctccctgcccagctaggggctctgggggctgagacggcaaacaggatttaccgctctctgccgagcgggggcctttaaccacttggctgtgaatggcgacgggcccatctgatacacaaacaccgagaggacaaagaagcctcctgcaacttataaatcagagaaatcatgtctgacagtcactttccgttctccgagtgccgagcaattcatcagctggtcccccctgattcatagccgcagctacacccagcgcccatgttcataaatatgtgcacagtcaggcagccctggagctgcaagccgtccggggcccaaacggctaccatttaagcagatcacagccccaaaccagtgtcaaagtaaggttccaggctaattagatcaagagcccaacagaccactgtgtgtctcgggaccctttcctctctctcccccaagtgttttaagagagtcaaacctggggaaagaggggaggagaaataaaacaagcaaaaagtgaaagtgaagggaggggatggaataaagcctgaagggttcccgcagagctgggactcgctcccactcaaggcaagaccttttgatttgcaaatctttctgaagacgaggccttctccccactggaggggttagaggtactcccttgggtgtccattacgtgtatctctgcctatgaaaccatccaggaaaacagggggagggccggggaggtggagagggcggggaggggctgccctagttagtgtgacaaacactcctttgcgtgctggtgacccaatgtgagccagcccatggatattgatagaatttgctagcaccatcactctcaccccgcaggcgctgacaacctctcgttccaccccaagatgcagggtccgccgatagtggcaccctccgagaatcactttcctgaattatataagatcgcacagtgctcggccgacaccttggagcagaatgacaaagctgtctgggagcctgcaggcccctccaccccagcgtggggactggaggattttgtgagttaagacgcacaattgcttcccttccttttctgtgccttttttttttttaatagcacatgacaggcatccataagacagacccacacaactcaagtgaattatgcagccccgctcatttgtaaagtgaaatgcagatttcacctgctgaaattcagatcttgcctcctgttccccataagtcgaggctggcacaaggaaatctattgatttattatgattaaaaaaaataaaaataaataaaaactcaaactgccaaacaaacaacccgccaagcaggaaaatcccaaagtccctgtctctcctttctccctcctctgctcaggaataagtgttaattttacacttcatttctcaaaaaaataataggatgtgcttttgcttaaaaccaagtcagcctgctggaacctttcaggctgaaactgtgtcagcccaaaagaggagcagagggctttgtggaagagcatcgtgccgagatgatagctccctgtaatgtccctggtaccgacttttgtctccaaaagcatttgatccctggcagacacatacttatttccatacgggtcttgggggaagccaggaggagagagagctgattatcagaatcctgaaggtgaagctcaggtgggccccactgatgtcaaaggcaggcctgggcacacattcggaggccataatttgctgcctgggagggaggagcggcgggctgcagcggggtgtggacggggcattgttctcgggctctggtgcactgagcgtgacctgctccagccacaacggatagtccctgcctaccccctctcttagcaggaacccccctcgggaaagctgaccccagagtggcatcattaatgcacacacctgtctaggagaagaccaatgacttccgcctggtgttgactaggggcatgactagccacctacatccaggatgtggcaatgaaggacacaaaagctagagccgggaacacttgggtttgagccctagttccaccactcactcgctgtgtggactggagtaagttactttgcctctctgagcttctgcttctgccactagaaaataggcagagtcattacggggcttttgtatggcagccaagcagtcttatttggccacaggacatctgcccttgctgagacccccagaccatcccacactccttccctcactacactcaggggtctgcctaaaggacacctcctcagggaggccttactcgagacccccatctaacacagcacacacccccgtcctttccagcacctggcccacctttaattcctggatagcgcttactaccacctggtatattacagggttcattgtttaattcattctcattccctccgtccctccctccctccggcacacagacagagtaacataaactccatgagggctgctttgcccactgctatgtcaccagtgcctagaacaggatctggcaccaggagacgcttgacgagcaggaaatgaatgatttatgtaaagcacttagcacagagtttgcggtagggtgggagtgctggtaaatgccatcactatgcacccatggtcacccctaatctcacaggactcggcttgtaaaaacctcaactccagtaacgctttctggaaccccacggaacaacagcctgctccaagactgagggcgtggagaggctccctcagctgacagaagaggaagggacgcttagagaggcagggcccctaacagggatgtggcagggcagagcagggcagagcggggcagcagcagccctgctgttcacccccagcagccctctctggctttagaaaattcaagaaacagccacaagacctaaaacctgggacccagcaagccacccctgctccctgatcacccaaaaaaatcctggtcagaaggaagacagagccgccctccgcatctccatgtttgagcctggggggtcccctcgccagcacaagcgccggttggcagcagggctggggctttccctgaggaaggggaggaggtagccctgcatgtgacagcgtgggacagtccaggctgcacctcctctctccaagagtgtgtctgcaggtggaagcaaggcagggaatacacaggctgcttggccaagctgcggcccctccactaccagccccagaaataaatgccccagactgacattccacagcaccagggacagcctgcggcctgcgcatctagtatcaggtcaagtcctgaggtcctggggctcagacacacacactgtaaatgggcgcggtaaatggtccttggagagaggaagcatgggagcaaaggccccagcactcatccaggcaaatcttgccaggaggcaagagggtgaggtgagggtgaccccaggagaggacccctccgacaccatccccatagataaccacaaatagcgcagaacaggagctaggaacctgagctgtgggagactctgtcctttgtttcctgtaagaaacaaagacccccaggcagaaagaggagggcaggtgataatatctgggcagccagattgggccgtttatctattgatctgtcattaaatgccatgaagaaattaaccagtccaggctgaagggaaggagagagtgacatttaggctgggagtcaaccagggtcataggagaactcagggtctgaggagtgtcccttgtcaaaggctgggcaagagctgggagcaggtgagtggtgatggaggatgaccatgggagccccaacacccccagctctggcagcccacgggaacccacttccctgccaagcagcccgggcagcacctgggagcttgagagaaatgcagagtctcaggcctgccccagagctgcagcattttaaaggtgcccccgtgtttggggcgtccattaacgcttgagaaccactgagcgcgatacaaggggcttagggacgctgatattgttggaatcctgctgtcccgaagctgggtttgggagctgtcccactgctttgaccaatattctatgtggaaggatctcttaaaaggcaggaagttttctagtcactttttgtccacattttgcaaaagactgaaaaatcgtcagcaatgaaaaatatttcctgtggttactcctgggatggaaatgatgcgagtatatctttgaagaggctgctggagactctgacggtgggtggctaacactcccccaaaccatccccgcatcacggctgtccccgacccccagtgccaggggctctccacccttcggtgtcctcctcactcaagaccgctcagccatggcttgaaggcacagcccaccacgctgctcccattttgggctcacattttcctaattaatgctggaggatgggctgtgcccttcctcctccccctgggggcaccctcccaggccattctgcccagaagggacccatcgtatggtcccctgtgtttcacaaaggcttctaaatgagctctggcagcctgaaccgggccccacgggggacccagagcctcttcaaaacagagccctgacaattaggcagtctgagttttgaaaggcttgggattgatggtgtggacagtaaaaacatcacctggggagctgggtgtagtcctccgagggttgcctgaggtcagttgccatggcaacggagaatgagctcaaccttgtaactgacccttatctttttttgatctgtgggccacttggggccagggcttgaaatcaactggaaaataatccggtcacatatcagaaagaaaactatttatacttatttacccaggtacccaccaacgtcccccttccacaatgctgtcgacaccgcaataaaccgacatcgcatgtgcaaacgaacgctaccccatggcaggagaaagggggagaccgaatgccccatctgggtagaatgccaattccacgcatgggcacgtgggtgtgggtgggaagggtcaccccccaccctgcagcctcgcccttcatcgctactgaccacagcaagactggactctcctgccttccagcatctggtccaggcccaccaagggacggcctctgcgatctgccctctcgcttgctatgcaggcatgtggtttcagcctggcttgatcactaggttgtcttccttgattccagcatctgacaagtctcccctctgccagaggctggacagagaggccaggtggaagttcatcactttctacacctgggggtcgcaatgggattcggggaacgaaggctaagaaaggaggaggacagaggccttccttcctggtcccacacccgaggaagggctggctgcctcaaccaccccagcattcaccccagggtttccatggcaagatcggccatctggccaaagcctgtctccaggacacagctctcctaagttataagtactttgctcgctctctccttctctgaaactcaaatcagaagactccagatggttccactgaccaactgctcccaagagccatgtcagatggatcttagctaggggtcagttaagcttgagaatgatttctggtaaactccctgtgagatttcccatcacagcaaacaggacagctcagcggacggcccccgactagcccttgtttcatcaagactagatccttcagggagtggggaaaaacatggccaagaaccaggctgcgcggaggagaatcctggctctgctgcagatgcccagggtgacactgggccaagcgcttccctctgtgtctcagtctctgactgtgaaatggggagaaggttgtccacctcacagggctgttatgagagtaaatgagagccaagtaaagaatatgaagcatgacccccggcacagtggcttacacctgtaattccaggactttgggaggccgaagcaggaagattgcttgaccccaggagcttgagaccagcctggacaacacagtgagaccccatctctacaaaaaaggaaaaaattagccaggcatggtggtgggtggtacactgaggcaggaagatgtcttcagcccaggactttgaggttacattgagctatgaaccattgcaccccagccagcctgggtgatggagggagactctgtctcttaacaagagcacaaaaaatttttaaaattaaaaaaaaattaaagaatactgatcataatgctaccaccacaactattactgctattgttacttctccttctttttttttgtttttttttttttgtttgcttttgagaccgagtttcactcttgttgcccagctggagtgccatggcacgttctcagctcactgcaacctccatctcctgggctcaagcgattcccctgccttagccgcccaagtaggtgggactacaggcgcacaccaccacacacagctaattttgtatttttagtagagatggggtttcaccatgttggtcaggctggtctcgaactcctgacctcaggtgatctgcctgccttggcctcccaaagtgctgggattacaggagtgagctaccacgcccagcctgccattgtcacttctgacatgactctacctgaaactccatgctcaggcctggtgacatggcacatacaaacccgctgtgggggccatcaaggcaatagaaccctgctcctctttcagggcatatggccagccatgtccatgcccctaccccagtaaatgtttaaagacccttagcacctgggacattgtgtgttctctcatggcacgtcctatgctacttccaccttcaaaatgcttctgtgtcagctttcttcatctccctcctcctctacctccacaccactcccatatttgcgatggcgaaactcgtgtccagattttaagcccttttgttcccttgtggctcgctgcagcttcctacttcgggccatatgagttgactttgcctcccctctgatgctcttggacccaagtttcccatttctttatggttcttcttgcttctctctcttgaaattccctgagattttcatgaaggtcagagcagggcctgactgagtcaggggcgtgatcagctgcatgcaccccccaaccccttggcccttggccagcccttccccatagctgggcccatgcagaaatctccctaacctgaaaggcctcagagcccaaaaaccgcagagatcggggcccagcctggatgggattaccagtggaggctccttccagctctgagagctgattccacactgccagggagctagcactgaggtgcaagcagccctgggtggttaaggagaacatcaccatcacagagggtcctgcttgctaacttcctatgacgctggcggacacatccacctcccgcctctctgagtgatcagcaattgctcagagacacatcattagcagacacatccaaatcccggctctttgagcgatcagcaatcatgacgggtggtctttggcaaaagaaaagacaaagatcaggtcccggacataacaccaagagacaggaggtaactatctcagcttcttaatagaaagagaatggatgtctgagtgatgaaataaaccacacacaagagaacaagcgggacttcactgagaaccgaggaaagagaactcttggagttctatacaactcagaacttctctgcctgcacattttcagaaggcattccacagccctcctcacacacatccccttttacctgtaaagaactgaaggctgatcacctcagaaaatgaagattccactacatcctggggatccactaggtaaaagcaagtagcttattctttcttaactcatcaaacacctactgatgtatatcactgatcttcagattaaagttttcaacaagacgattgcctaaacatccatcatgttaataatcctcagattaatggcctctaataatacacaattaacatgacaggcaggttgcaaaacccttattgtcaccgaccctgccagggacacatgaattacccctgcttctactacaagggttttctctactgccgacatcattttttgtccccaccaagatcattttttaaaatgagcaacagcaatgtgtcaaaaagcctgacagttaccaacgggcacacacaaacacaacacacacctgcagaatgcaagaaagcaacatttttcaaaagttccccatccaggtaaatacagacagaacttttcctgcagttactagtactcaaagcaaaaaacccccagagttcagcttggaaactggaattcaccactttctcaaagtccaccttgacctgggtcactggacaccaccctccagctgaaaaaaataaacaatgagactagaaaataatgactgacttctattgaaaagctttaaaaagtagatccacactgtcaatctagtagttactggccacctgtggctctttagtttctgggtggtttttttttttttttttggttttttttctgggacagggtctcactgtttgcccagcctggagtgccatagtatgatcacagcttagtgcagcttcaaacttctgggctcaagagatcttgctgcctcagactcctgagcagctgggactgccagagtgcaccaccagacctggctagatttttagtagagatgggatcttgctatctttcccaggctggtctcacactcctggcctcaaatcccaaagtgctgggattacaggtatgagccactgtgcccagcctgtggctatttaaatttaaattaaagttgaatatatttaaacattcagttcctcagttgcaatagctaatgtggccagtgactaccactctgggtagtacagaatatttccatcattttagaaacttcatttggaaagcattgtgttagaatacaggcaaggtgagggcaggggctctccctgtcttattcaacactgtaatcccagaacctacaacagcgttgggcacataacaagtgattaacaaatatttattgaactgtggaatgtgagtgtcaaatattatgaagaacacctcagcccttttgctgttagcacttgcttgcaattgcaattgccctgcctgagaaaccacttagatgtgaacttctccaacgttcaacataaacctacaccctgataattatgtgggcactttgcccaaagtgggtaagaatatgacgaacacaggaacactgcagagccatgaagtttctctgaaggatgtaacccaaataccataactttgaaccaacaagtcatatggtggatcaatagcacctgggctcctaaccagtcaagaagcccaccggccacagcactactgagttgccttttaagccggctgagccctgtggctcatcgaggaaataaatgcttggatttctgatgctgagctaagtggtctgtgtgatttctcagctctgcttctgcaggctatgtctcagagagccgggtttttgctgtgacccaagtaaaatgaaaattgaagctaaattggaaattcaaacgcaacatggaataaatgaatacattcaaatcaatgatactccttccaagtagtcacatgattgcgacgctaataccagtattgggtctactctggggaagcgggtctttcttcagttcggctgaaaagtcacccaagatagcgaggcttatggtcacagtgcacagggccctcaaaaggtcttttctgaggtcacgtcttcctctcaagtctactcacctctccccttccttcactcgctcccctaacaaaataccaccttcttgaggccaagcccagtgctcggcctttctctcttcaacagacccaggactgagatcaaatgaggccgatgggatgccccaagctcacattagcttgttgatgtgttcagctcccagagctgagccctcccataccattttctcagatggtgtgggcccagcacacagggaccagatggggggtctgccacctctgggcggcttagaccccattgccagctcccagagcccagccagccctcctgtctgcccttggctgtgcctcccacctgccaagcaggtgcctgcagcctaaggtctgggctgatcccatccagcagccactcctgacccacagaggcagagcttactgacagctcctgacagcccccaccaggagaggcagggacaggcagagggggactgggcaggtaaagaatgggctcattgctgagcagcaggggagtgggggtggaggccacctccacacagcctccaactctccagcgaggtgcagcgagcagaacagctgccattagctgtgatgagatgtgagcagtgccaggcccacacaccatagcaggaaaacgccccaccgtacagctctggctggcatcttgcctttttcctacttggaaaagacatcttcatagacaccttcatcaaaaagcacatgcgacagacacctggcaattcaccctttgctctccgctcctggccccacctcatcatgactgctccagcctcaccccctgccacattcagacacactgcctggataatcctccccaggctccacagccatcatttccctctcctgctcaagaacctgcagtggctccctttttcccagtgcaaagctgcactcttctgccaggtggccctggccctgcctacctaacacccctacttttggccgcacccagcttcctcctggcccaagggctgcactcacagggcctcactcattcctgagggttagggctagggttaggttacggattctgtacccttattcaagtagctctcgatgccttgcctctgtcctccaggccacaattttccaaaaaggagttttcgttgcacccaagttattcatagctatgtgaaataaaaaggtagctttcaaaacattccttctctttgcttaagctaacttgattttctgtcaacttccaaccaaaacaatcctggctaatacattatctgaggatgaaaaagcaattctttcacttttctggtatttcttacagagccagacaaacacgaggtgctcaataaatgctaatagtttgctgtgcacatgtgtgtccatctcttgatcatgtcccgtgggaagagaggtgtcatccctatagaccatgcccttcagtggcagcaggcacaggtccctcacactgtcccctgatggatagagtcctgcctcaactacaccccccacggctctggacaccagccctggagcattcaggtccaggtctcaacaccatcccaaatgcaggaacccagacatgtggctctgggtccacagatgccactcttcatgtccgggagcaaggcttgctctgtgggggtgacgcggtggggctgcatcttcccgggaaccccataccacctcagccaccatgccattctcagggctggacataccccctcatttgctcatcggctgcattcagctatagctttctggtggcacagcacatgaacagaagtgcagcctcggagtcagattgcacaggttcaaatctcccaccaccatccactagcagtgggatcctggaaccccacctccccgggccaatgttccccaccatgtaaaatgagaatgattgtagtgcctacatcataactgttgggagatgaacaggcttaatagcttgagttattaatatcactgtcatggttattattgaccctgaggcaggcactgtgcaaggtggtgggtgtggggggtgtgagtgtaacagagaccagtgagacactgtcacacccagcttgcttaggaggagtctgggaggcctggccaagggacatactttgtgtgaaaacacagtcgcccagaaatcctaaaaaaaaaacaaaaccaagtcctttgggaccccagagtggggaagcagagctccaggggaaatgccatggacgtctgggctggcaggagttggaggcccagcagctcagccccgcctgtgccagagctgtctgtcctgcctctgtcatgccacagaacagcctcagtgacccagggcccaggatgcaggagccgctctaagagggcaggcagaagggcagagaggaccagtgagaggggccaatgttctggtgccactgaagggcttggtctagaggggtgatacctcccttcctactggacatgaccaagaggcagacacacacatgcacagcctctagaatgctggcctcagctggggaatctagctcatagttcactgctccagaacccatttcaaggtcctgcatactaaggaatttccagtaagtacctccagtcacagcaaagactgtggccctgaatcccatccacaatgtttttgttttgttttgttttgtttcgttctgtttttaagacaggctagagtgcagtggagcaatcacagatcactgcagtctccatctctcaggctcaggcgatcctcacacctcagagccctgagcagctgggaccacaggcacaggccaccatgccccactcatttttttttttctttttttggtagagatggggcctcactatgttacccaggctggcctcaaacttctggcctcaagcaatcctttcacctcggcctccccatgtgcttggattccaggcatgagccaatgcgcctggcccacaatgttaaactcagattttgggggaaaaagcaaatccaaagccgattactctgctttcacctcatgctttaatcacaccctgaatgcacaagggcaggaccttagtgacaatttagaattccaaaagccagggtttagtgaagcctgttgaatcccacttccaaaacagactgtgtctccaatccatgcctccacaccctcaggtggggacctgcacccagccctatcctggcctccatgtggatggctcccttctcctcatccagagctgagaaaagtaggaatccaagacaccatggagagggctgtgcatgtgctggtggaaacaagctccagcatgaaaatgggggtcccagtggccctctgtctagttgacaacagaaaacacctccccaacttcccatggctgagcccctcctgccaagagcaggatgtcctcagaacccggctgaagaactcagctccacaggcacactccctgctcacctgcccctcatgtctgccccatcagggactcccgctctctgcacccagaacctatgcttccctcccctagaacaggtagggaggaaggatggaccaccatctctctcacactgcttaggcatttcccagcacctaacaacctggcacacagtggcactcagccaatgattgctcaatggcagggggctttctagagacaaacaacatttagtctctgtccacagccctgtggaccagagacaaacgtcttctctaaaaaggcagactaacaatcactcagactaacaatctcccacttcacccacaattaagtggaaatacacaaaaccaggtagtaaacacaatgctattttggttaagaaagaaaagtgagggaaagaagggaatgactatatttgtgtgtgcttgtgtgcgctgagaaacttgctggaaggacacacattaaggtgttagagggtcatctctggaaggcaggatatgtttttcttatttttgcttggctggattttctggttttcctgcaatgaacatgtatagcctttgtaatttatatggtttggctctgtgtccccacctaaatctcaccttgaattttaataacacccacctgtcaagggcgggaccaggtggagataattgaatcatgggggcagttccccccatgctgttctcatgacagtgatttctcacgagatctgatggttttataaggggcttccccctatgcttggctctcattcttctctttcctgctgccatgtgaagaaggacatgtttgcttccccttctatcatgactgtaagtttcctgaggcctccccagccctgcggaactgcaagtcaattaaacctctttccttataaagtatccagtgtcaggcagttctctacagcagcatgagagcgaagtaatacactacaataaaagctttttaaaaattttaatccactgactagtgatggagacaatgttggtaatgactaggcctaggtctctctatctataactggaaatggttggaccagagagctccacagcccctctcagcccctgccttgcagatcttcagaccagagattcccagtggcagtgactcttcactcaacagctcttgctgggctgaggcctcagcagatctgctttctggtccctgctgggtctctgccttcatgggggcaaattgctccctctggccttgactctattccatcacctgtcaagtggaatggacaggccaattttcaagcccgggctctgccactgagtgtcccggtggcctcatcagtaaaatggggatataattgtgcttgatgcataggattgagtgatcctatgcatttgtagagcttggagtgaatgcacctgctgggctggtccctatggatggccctgaaaagatgtgagtcatcatccactctcgtacctcacacagtgttctgtcccatgtgagctggaatgtgcctgctgtgacacatggccagaaggccagaggccaggaggtgtgaggagctgggaggcgagtcagggacagatgccagggaggcctgggaccccccatgaggaggctgccacgtgatggctcccatagccagttcagacactctcaacaaccactttgtctggctgggtgcaggctgggccccagcccaccctggggaggaggcagctccacaggctcacccggccagatgccgcctgcccagatctgcgtcctccatgagattgaagatgacaggctctgggggtggggaggagccaggtcagcggaaacttggcaacgagaaaggcaagaggagcagctgagctcagagcaccccgtggcccccacccttccaagggtgcagcgagaggttctgtctgcaacccctcaagtcccctagtggagtggaaatgttcttcatctgaggctggggtctgttaccccttcccagcctaccagcttccaaagagacagcagaaagtgatccaaagatccaatatttgtattttgaatgctaatttgacatagaggagtgggcatggggagtgtttataatcagcactccaataagcccacaaatgacgccagtattttataagcttgttagaaacaaatcaccccctcagctgatatttacttactgatgaatcataaaagggctcaacacacaaagaaaatccaaaaagaatgtctttcttcatcccatgttcggcaacaatgctgggagcctggcctgggtaagcccaagcagcgggccttctccagcaccagtcctcagccccccaatccccacagcctccccaggggtggcaaatcatcggtgccagccccatctccgtgcccactccccaccacagcccccacccatcgactggcctaatctgaggctcaattcagcgctccagaggcagctccgtccttctgctgcccccggagtcctctgcgggagcggatccaatccagctaatttgcataatgatgaagccctccagtgcgggctgggtcttaagagggttgggaagaaatatgccctgtcctttggagaggcacacagaaggctcagtgcagcccgggaggaatggggcgcctggcgggtgggcgggggcagcgtggaacccatcagcttccccgccaaggacagctcagccctgtcgcccgctgagcctatgtccagctggcccaactgaggaaggactgcccagggctgtaaaccagtgggaactcaggcacagagcgccagctccagacgcaagccggagtcatatgaccccggtcacagcgaccgccactcacgggctggctgaccttgggcaagtcgctgacctctctgaatctcagtctgctgatctgtaaaaacagagggagatctaccctacagggctctgtgaggaccagcagaggtgcctataaagcactgagtagagtgggctgatagaatgcaacaactgtcagctgttaaattaacaccgtcattagtctaatccctgtggtactgggtccatccatgcacacatccacctgtccatctacccatccatccatccacctatctgtttattcaacaaatgccaggtattgtgctaagcagtctggagaagagagaatgaattagacacacctgcctttaaatcacctctagcaacaaaacgacagtatggtccagaggtgaggccagtgcttgcctttgagggaggcaatagcaggaaggagtgcagggagctaccagaggccactgggttcgacttctcgatctggatgtgttctatttctgcaaactcatcaagctgtgcacttaagaggtgtgcatctctctgaacgtacgctatacttcaacaaagttttaaaaaaccctcacgtctaattagggagggagatcagctgggtatgcacataagcattacaccaggcaggaaggggtcagctccttaagaagggtgaataaaatatttgggatgggggtcgaggtaacaccaagggggaagaaacttcctccgtgacaggtgaggatcaccttagcacatgtctggtgcataggtacctactgaatggatgagtgaatgaataacttcctgaatgaggtggccttggatgaacaggctgagatgtggaggcagagagggcgttccaggggagggtgcttgcaggggctgaaggcttgggagggttttcctcactgagccaggtgctggcatgcagcagtgacctgggagccagggcttttgcccttgctgggctcacagtctacaggcatcagacatcaagacgtaactccaggggatcgcatccttcttctattctgcagaaactgagcgcccaagcgcagggtgcagcattgggtgctggtgatgtgcagcagaacaggacaacaggacctctgacctcacagtgtgaccagaggatcagagctgaagcgaagccagctttacacagtcacttgctcatcacagtggcactatggggccggtgccgttattattcccactccacacatggagaaagtgacactgggtgaggtaaagtgattgtcccacgtggctgatccaggaccgaaatgcaactcttaacctctgccaacaatggcccttccccttggcctctacggaacactttatccccaggtctgtttctcagccatgtgagtaagctggatggaggtggcatttttcgtcccattctgcaagttggaacactaagcttctaagtatcaagttgaaaagatagtaagtgacagaggaagtgaatctcagggccctgactccttgtccagtgctccttcccctgcccattgctgttggacaggataatggggactgtcatgaagaggaggcgccgggcaggcttgacaagggcagccccatcacatctcaacatgtgcaagactgggccttggctgccacatgaccatgccaccccatcaaccctgctcagagcctgtgagctacacaggtgtcatgcccagccctgccagccagggtgaccccccactctaactgttcagcaccgagcctccgacagaaaagcaaccccagactgcagtggtagctcatgctgaaacaattctcccaagctgctttaaatggagattttgcagtttggggtacaaaattattgtccacgtcacatggggagtgggcagaatgtatttgcctgtgctgagccacagttctgtctcccaagcaaagctgaacagacactagccaagactgggctcgctgagttaataaagattagctctcctggactatcttggaggcattcaagtgctaactacctgccaggcattcagctaaacactttacatctgggatgggctcataaaatctctacgaggaggtcatgatcttgtcctcactttacagtaagtgacagcgcccaggcctttcaaccacagagctgtgctcttaaccccagggctgtgctaacttccttaccattattcataatcgccattggtagcataaggatagaggcaattaaattcaacacttaatttctgttatgtgcaaagcatagagccaggtgttgggaacataagcagaatgagaactgacctctgtctgcaagaagtttcagatttttatacccacaaatgcaagacatcttttcactaaggttttttttaatgatcaagcacattgcccagcatcttgcacaataaatgtcttctgactacacaaacaaacaaaagttaacattttttaaggagaacacattttccttccctactggctgttctcaattccatttcaacacccctccatccacttaaactgtgactttcttcacttccaaacagtacaaacgctttcattaagaaactactcggtggggtgtccttgggtaagttggtgccttttctgagctcagagacctcatttgtgaaaggaggaggtaggatttgataactcacaaggtcactcggggatagagtactaggatgttaatggccagtccccatcctaactgtagaggactttatcagatagttggcggctataaagggatgagcatgtgagacttccattacaaagttcaagatttaaactcgagggcaagacatcagaaggaggcactcatagtgagcgcgcacagcagctgaagctatccgtggaagctcgagatgtcatcagggggcacagaattaaacgccaaggctgaaccttaatgcttttcgaatattccctgcacttcttatcagtccctattgtcctgtgctcctcagccccaccctgatctgcttgacctcaaaggtcattgagtttgtgacccctgtgaaagagaattcattcttcaaaggcaaagcaagagagaagaaagagcataacatttgttaactgggggacgtcaatgcctggtgcctggaagctgtgtgatcttaggatagtcacctaactcctctgagcctcagttttctcactgtccagaatggacaaaagttttatctacttgatactctttccagaaaaaaaaaaaaaaacaatcagccagctttcccacacttccaataccctgcagaaagttgtaaactttagagaaatcaacaaagacctgtgtattaagatagggaaagctatgttgtagtaacaactcccaaaatctcaaggggtgcaatggtttatttctcatttgcccttcacatccattgcaggggtttctgcttgtgaaaaacactcagatgctgagagtgccccagggaaagagagaatgctgaaaggtcccactctgttggttaaaggctccactcacggctctctggccagaattagccacaaggcttcacccaacacaaaggggccacgatgcgtgatcctcccacataccaaaagacgacactaaggataccacgttaacaagaagagccataaggctcagcagagcactctaagaatctcaagggaggagtcagggacataagaaaaaagatgaaacctgaaaactcaggatggtaacaaaggttctcagaggatgtttgcattcatcaaggcccaggaatggtgggggtgagcagctggcagcatgctctccaactccctgggtcagctccacagtggtgagtgggccctggcggggaacctccaacccccacgccctcttctgaaggcggagggtggcacgctccttccagcactccaccacagccacccagctctccaaagagcacagcaggtaaatgctgggcgttgtcctggggcttctcgcaaaagtcgctcttgacgataatggctttaggaggctatgcaaccacacgcctggcatctgaaacatcatctgaggccaggtgttgcatctctaattaggatggggatttttttcaccccacacagaatttacataattgggaaggaggttacaacgaggaccatccccaccaattgtgcgttttccacggcctccttccactttcccttgcacacctcaaatttaaggcagaaatgaatcgatttgaattttttgaaattaattatcatcattgccatggaaaatgtatctgccactttccctggggagttgagagaggaggggtgatctcatgtggaggagtgctgggagtgccacacatcacccactgtcctcttaaggaaaaacctccacctcacccgacctcacccagtgggtcctccaagcacctcccagtttggtctgagcattcttcagaattttttttagcaccaaaattaatgctttaaaatgtcacttgctacagtaaaatttatcaacattattatataccatagaaactgccatcccagacaaatgcacgacattaaaatttggtctagagctccccagaggaaacgtttgctgcaatttgtataacagtttatatatttatgctatttaatggtacaaagcaataattatgacttcattcactgataagcaacggcattacataaatctgatgcggatttagaacatgccagctctgacaccagtgtactagttgtaaattatgttgccgttaaaaaaaaaaatccaagcaaatatgaaggagcagcaggaaactaataatgcatctccagctgttccagttaacctgcaaatgtggccatctgcacctcgggagaaagagaaggggagagagacggggaaggcggagcagagagaagggagagaaggagacagccgccttcggggaagcacaaagccttcccctgacatcgaaccaatgaccttgctcctcgctgccaggcaagccgtgcctgaaccaggaaaagtttcccaagagcgctgggtccattctccactcctctggcatccacacccggacccacactcctgcccctggccagaaaggtggccccagtgtcatccctcctttccctgcctctctagagactcatcttgaaccttccagttcctagttactgcaacactggtctgaccaggcagcttcctctacaacttcatttctttctttctccttttcattttaacacaggcctatcttgcattttttttcttaagtgggatgagtggtgaaaaaaagtagttattgtcagatgtgtgcccacttcagatggttcaaaatggagctacagggttcaaagactcgaactattgaatgaaatggaaatgctcagatggtggcagatcacagatctgcatgtgaggacttccactgggctttggattcctggggccgtggggctcttggctttgcctggtgaatggggggcaggagagatggtctcggggccaccaaagactgagggtgggaacaggcaggagctgcaggctgggggtctgggctgcaactcaggccatgccccaccctgcctgcaccccccagagcagacaaaggtcccatccggcctccagccagatggcagggaagagctctcaccaggcaagtgcatgattctgcttaggggcatgggctcccctgtgaacctccccacatcagctgcagctccctgggactgtccctgggcccaaagaacggaggcacagcagacccatttcctctcctctcctccagaggttggctgaccgagaaggtgacaggtctgggaccacacctccttccctaggtagaagggtgcatctacagcttcagcaacagcagctaacatggagcatggattgtgtgctaatgtgctgaatactttacataaattcacacatccggtccttgtaacgtccttttgtgctgggaactactgttattcccatcttacagataaggaaactgagtcacagagagattatgtaacttgctcaagatcaacccagccagtgaactaactacatttctgaaccgtaaggcttagaagaatgtttatataagctactctgtacttttcaaatatgttttgttttttccttctttttttttttagacacaggtctcattctgcttcccaggcaggagtgcagtggtgcaatcaccgctcgctgcagcctcgacctcacagactcaagcgatcctcccacctcagcctcccaagtagctgggaccacaggcacacgccaccatgcacagacaatctttttcaatatggacagagtcttgctatgttgtccaagctggtctcgaactcctggccttaagcaatcctcctaccgtggccttccaaagtgctgggattatagggatgagccactgagcccagcctcaaattgtttaaactgcaacccacagaaagaagcatatacatgatgacctagctgcacattaatacacatggaaaccaaagcaagtttcatggaaccacgtgagagcttactcaggaggatggattctgacattacccttcccttttcccttttcgtccattctcttccattctgtgttctgctccgccctactgtttcctctttcatttcgttggctgtggctgcctaagttgatttcatgatttgctaatgggttgcagcctgcaatgtggaaaacactgcctatttcaattccctcattttacagaaggaaaactgaggctcggaaagagaagactgcttggccaaggccacacaagtctgtggcccagccagaaccaaagcccaggcctccagctctctttctacaaaacctgcagtcaacgccaaccctaagcctttcctgggcctactcagtgcccctttctaaccacactggggataactgggtccttggccatagcgtggggacatcatttgtggataagggacagccgtgggagcaagggacagacaagggaatgtaggtctccccaaaggggctctcaactcatgccagtaatgattttggggatgtggccggcccaacaagtctagctctgagggctgcttgccaactgcccccagcctgctgggcagagcccatgtggtcacacacagagaaggcgaggcactgcctgcctgggagtgacctccatcagggtgggcctcccttcgcaggtacctagagggcccctttgtggctgggtttgcaggaagctgctggaccgatgaagagacagaggaggaaacaggtgattctcacagggccacaggcagaatcagcaccatctctccccactctcccttatcatcaggtcccaaacagaagagctatctctatgccccttccaggtgggccccccacggaaggccctcaagctgggacactgggagggatgtgtgttcccaccaccctccttcccactcaaacttcctatcgtgttgacaaaatgtttttgcaactaagaaaacagcatttcttggctattttaattttcacagattcaacctcagttccaacatccaacgctccgcttttctgccaaaaagtttcaaaagcctccattggagatttttgcaaggtgcaaggaattggttcctatcagcatctcaaaacacaattccatcccccctcccaaaatacacacacatcagcttcttcaagagacacattctaagtacccaggatacggtctttttatttttatggtctaagcagaatcaattccaaggactagaaaaacaatccctcagtgagaacctattcagtgacactcccaggaggtcccgaggccaaactagtagctctgtctccttggcagcatgggggcaaaggacaaaccaggcgggaggtgggtcagacctgcacctgctgcaaaacacgcagggtgcatggaagctgggatccagagaggaggattgcttagaaaaggcctcctttcctcccaggaagggtgaggagaccctcgggggcacagctgagccagagtgggtgggggctggaagacaaggagctggaagggacaccgaaaacgggcccctcaagtctgtggctgggacaagtggaacagccaggaaggcatctgacatggatggaagtcaaggtgtttggacacctggaccaagagagtggcctcccacttgtacactgtgcaagtcctgtaccatcttccaactcaaatctgtggttctgttttagggccacatgggtgtgtgtgcatgcactcatgcgctttgtcattagttgccaacatttaaaatacaagaaatttgtattaaaatatgggcttttggcttctcttgaaaactcagaacatctggactctcccagatgcaattgcctgggcagccatggaaggggtgtgggctctctgcagggtctgcataaccctcactgtcccacgtgcagctgttgcaccaacttatgttaatgcttggcccccatagacacagagttgatgacccttgaactaggagaccagggtaccagctccctctgccactgactcactgtgtgaccttgggcaagctcctgcccctttctgagcctcagtaaaaactgtgcaatgaggagggtagaaatcaactctcttatacttgatgcctccctgatgcaattttaggcccctacaaatagggggtgggccaggagcaattttcctggtgagaagacagggtggaggggggcaaggggccagcgcagcccctgcagctgtccccaaggatgtgctgacgccactactccagcttgatatgaatattgtgtcagagattggagatattaagaatgacaatgcattattactgcagagggaaatctcgggagtcctagagataggatttctaaatcctcagccaaaaatcaatagtaatgcccaagaatttataaaagaagcacgtcagtctgcatttgagatgacacactttcggtttccagctaaaccaaagggacaagtgcaagcgtgtcattcaggaagggcaagaagcaaaaggcaaaaacctcacacagggtcctgcctgggtgatggaaggcagcttgtaggctcttgctcagaggccgggccatgatcccaaaaggcaagcagaggaaccagcggtgctccccaagggcccccacccctccaggaggggatggggatgcagaagagacccgaccccacctggacccgctctaccctggaaaccagcatttatggtgcaagcaagaacaaacaggaggcccagggcagagtcaccagcagggctattctgggctgtaaaatgggtacagaaaaatggccccagctttctcctgggatgctgtaaagatcaaatattaatttaaaaaaaatatcaaacaagctttctggggtgttaagattcaacagagcacagactctgaaggcagaaggagctgggctcaaatctgcatgaagtcactggaaaaatgataataataagtcttaccctacacagggatgttagaagggttagaggtactacctgtgcagtatctggcagaatactgagttctaataattacgacagtttcaatattatggtcatgattaaaaatgtaaacattataatttatatatatatatttcttttcttatattttatttttttgagacaggctcttggtcttgctctgccacataggctggagtgcaataatgcaatcatagctcaccgaagctttgaaatcctgggttcaagagctcttcctgcctcagcctcccaagtaactgggactacaggcatgcaccacccccacgggctatttttttacttttttgtaaaggtgaggtcttgctaggttgcccaggctggtctcaaatgcctaggctcaagcaatcctcttaccttagcctctctaagtgctgggattacaggcatgtgtcgccgagcctggcctatttttatttttttttagatatggggtctcactctgttgcccaggctggagtgcagtggcatgatcaattttatatgtatttcttaataacaaccactcttagtagattagatgataattttaagtctttttatgaaataacgtctttccctggcatagggctcccctgtttataagattctctcataacattttcattagggttgctcagaagatgaagtgaaagattctccattagatggggaactgaagccccccaaaagtgatatgactgaaccaaacaaatttgccaagttagcaacaggaagagcaatgcctccagcccaacacagtcccgccttggaggcagaggggactcccaactgcccctccagtgcccattcctttgctgggcttcatggtccccccacaacaatgatatcttttctctcctgacactggcactgggcagacttagaacaggatgcatccatgctggagagccccagagtcaagcttatccagctcccaactttacagaccccacacctgaggccacagctccaactccacattcaaaccaggagtttgaagcatgcctaaggacttcctcccttccccaatcctagatcctcaggtagtaacgccgggcatagcagcccagggagcaagtgcactaagaatgagcattctacctctacccatttgccatagctcggaggcaagacccacaccaccttcacagcccaccttggtgaccacaccttgacccaggcccccaaatcccaactacctcctaaacaatctggccgaacatcctctccctactttgtccagtctaaaccatttcaacagggtgctctaaatgccaagaatcgactgggcagtgggtggtgagcacccagggtgtctccaggaccagttgttctgaaaatgccaactcaatgttctccatttgttttcagggactcattacattaataggcccctatggtatcactttggctattataaatggtggttcttctgcttgactgtgagctctctgatctccctgaattattttcagttggcttttctgatatggaatcattatatgattattgtaggaaatttgcaaaatacaaaaacagataaagatcgcccttaattctacccctgttagaaacccactgtcaagattttggtctgtttccctctgaagatataaatcttacacgagaccttcaggacaaaagcacctggcacagtgcctggtacacagctggtgctcgacacatgtagcttgaagaaatctgtaagaacaatcaaagaatgagtgaatttggatgtaaagtgctttaaaacagcactttaaaattaagagcttggtcaagatggaaactgggatgtagacaactcaccaaggagtatcattttcttctgtatttcatgggttcatttcataattaaatgttaaaaaaaaattaagagacctcatggacacatattaaacacacctacatcaaaaactaggatttttccccctaaaacaaaaataaaaacaaaatacactggtcattccttaatgatccttaatgcctatgtcagtaggtccctcccactccaaaatcctagcccttgccacaaggaagaagctgggaaggaacctctccagtctatacctggagcaccagtaattcagttcaggctgtgcagggtggcatccagcctacaggcatcactcaataaacagaggcaacatttactgagcccttaccatgccaggcactgtgctaagcactttgtgtgtagtatcttatttaattttgacaatgagcttctgttgtcctctgctattttttcccattttgtagacgaaagggttaacacacgggttaagtagctttcctaggacataatgctagtaagtgttgaaggtaggacattaattcaagaaatctgactgcagaatccttgcttttgatccatacactataatgtctcatggattatgaacagatagatggatagatggtggatgggtagatggacatctggcaggtgaatgtaaccatggacaggtggatggtagatggtagatggaagaatgaatgagtgggcggatggaaggataagtgtatgggtgaataaataaatggatggagggatggtgcatggatggatggacagatgaaatgaagaggttggtgagatggagagatggatgtgtggatggatggattgatgggatgaggaggttgaaaggatggatagatggatgggtggatgtcaggtggataatagtcatgtgtcagtccagatctgcctcctttccttaacccaatgcctcagcactggagcacacacaagaagatgatccacaaggctgctcccatcaaaactacaataacatgagaaccacagacctgcttccctcccattgtacctaggaattatttccactcaacccatcaaagggctgagttttcaagcccacaagatcactggtctcttccgaccttcggagctttccaactgtggacagtagagaatttaaagggcatcaggtaaaggcaagccacatacagaaagaggcagtccatgcagcttgcccaaaatacctgctctcatgctgaagactgactttggttttgttcacttccaaacattccctgtggctctcatcactcttcaagtcagagcagaagtgccccctcttctccaaagccctccctctcaccctaggcagaatcagatgccccttctcagagctcccatacagatttttctatcccagcgtctctcacattgatttgctagctgtcctctcccatgggactattcacgtgagagcggagatttctgccctatcaactcggaggcccccacagcccccagttcagtactttgcacagagaggaactcaataaatatgtgtggaattgattccaacatcccaaactgagacctccacagactctgcagcctccccctacccctcttggccacaagtaaacaagagttcagccactgggctgcggaatttagccacctgcagttacttctttatccacaagagagcacagtgtcttgaagctcagcacaaattcttttgtaaatgcctcgtgtacttatagaacactgtataactcaaaaattataattaaaatgtcttagctcctgtatttatagtaacatttaaactactgtgctttcttgaagtcagtcatttacttgagaacagcacactttacggtgaacagatctttgaaacagtaccacggggatctagcccaggcacatgtaactcaatatatgtcaacagctgtaaaaatattggtgggagaaggcaggaaaaaaactatgagcccagatcaagtgccctgtctctcatatctgactgttttcagctgctccctcctcttccaaataattgggccattttggtgcccgctgtcacacaaggcgggccctctttgaggctggatgatcaaaaaggttataaatgaaaatgatttcgatgttggcggcctagagagtgaccagggcgtgcagggcggcagaggggctgttctaatcttaccaactgcacgccgccatcggagagtattcctagggcgcgagcagctccccagggtgaggccacggtaaattctgcctaatcccttctgcatacaaatgagcgcctggcaggaggagggaggggggcagacgccgcagcccctgcccgctcctcctccccgggttggctgtcttggctgaacaaacaagccagcgacagtggagagggctgcagcctgggtggaatgagaaggaggaactcccggggccaccagggctaggggaattacatgaggggatcctaggagcaggtggccctggggcagtgttctgaccctctgaccccagggggtggtggtggggacacgggtgcttgggtggaaaacgatggcatggctgcaggcccctgatattggcccaggtgagagaatgaaatggcagcagaagcagcctctgggctggggctggaggagctgccaggtgatggggcggtttgggtgggaatctgtccttctgaaggcacagcactgagttcacaaagatgcagaaactcatctcccatgaaggcctcaaggatggtagaaggcctcctcccacccacaggatgagcacgcaggaggcccaggaaaggccaggaggaagagcctccatcctgagcccccttggttccagccctgcaaggaagtgatcaattcaattctggcagccagatctagagaaggagtctgggcctgggcacctggggcccccaaagccagagagggctggctccagaggggctgagcctcaaacagggaaacagcccacagaggggaaaagacgagggtcccaccacagagagagccaacagacagccggactggagctacacagtgtcatcctgcagtgctggaggtttctgaagccagttttgcttgcagaaaaacagaggcaaggactgtttttgagatcaattctgaacctggtggttaactctccagggcaggcgttcataacttggacctgtggatggagcttgtggggccccagaccccagcaatggtgggcagatttcacaggtgcactgcatttgattgtcacaatctctgcacagggctaaggagtgacttaaatgagttaaataaaggatgcacagcacttaaactctgcttggcacacaagcaccccaggagcattagctagtattaagatgtttacttgttgggggcaaggagagaaagttccatggcatgaaaaaggtgagttgccctggcaaagatcctggccccagccctgggtcacttcccaacttgaaagtgatgcaggataagaggagtaggcccagaagtggctgtaggggccctccccagtgtgcaggagaaatcatgtcctttgctaagtaatggacccatcaagaggcccaggtacctgcacagatatgcaaatccacacagctcaaaagctagcatcagcccaattctgctaagggatccacacacacccacacacacgcacacacttgtacatgcacacacatcccacgtccacatcttccatgaaatcagcaggaattgcacattttgaggacccaattaagctcagtgtgtatttgacaacctttcaacctccagaagacatttatttttacaacactctccagctgagaaattactaggtttctgccctttcctgaatagtcttggcattgggaagcaccaaggtgtacctggaagcgagcggggttttgggggggtcccacctggaggggcccagcaatgacatcagaaccactcagtaagggggtctcagaggcagggatgtccgaggtgggggcaagtcctgagctccttaggggccacaggggcttccctcaaccttggacatccctggcccaggcttgccccaggcatggcctgagtcagctgccccttccaccttctcaccatcccctggactcctaaacaccactctgaaaggcagttgtatgtctggggtggggagtactctccatctcatggacagagaaagcgagtcccagagaggtctactgacttatctgtggcttggccacacaaaaggggcaaagccctgggatattgccacttcccgctttgtactttcctactcagtaccaaagggggtcagggaacagggtacagtacgggaaataaaaagaaaaacagaaaagcaaagccttctctgctaatgaggtatggtgggctggagcatcagcatggggccagatggcgagagatttcccctaatctttctaggaggccccagggaacatcctcaccagtctccatccatccctgatgaaattcctccaactctctcctgctgcagaatgagtggttggacccaaacctatctcaacatcactgacttatctctgccccaagaggatgaatcttcccccactgaaaagaccaggacttaatatccttgtcaaggaagaagagttgatgacaacatgttttcctgtgggcggtctgctcctgattcctggctctttggaccttcgccaagctccatcttttgtgcatttgaaccaaggtctactgtctacatcagtatcatcaggacattgctggccaatgtacccagatgctagaatttcatgggtatttcatagcagggtcccatattcactaacattttcaaacaaagatgagtaaactgaaggcacgatcccagtcaagaaagcccacagatgtcctcccaagagaggtgcaaacggtaccactgcttgtagatttacccagcacacatctatgatttcaatgttagtctctctttggtctttggctgtctaaatgtcatggtgactttgccagggcaaaaggtgtgcccagaaaattgccaccctgtcacagtagcctgagagcagggtaccgagtagaacatatgctctgtatggctttgtttgcacctctgattctgctatctcacaagcagcaggttggcgattaacaaaatagcaatagcatcgaagccggtgacaactgccatcatcacggcagtgacgacagctgtcaccaggagccagtgagcctgctccttcccacccccagagtccccaaataggcaggagctctgagcattttagggaaacttggccaatcatttccgtgaatctttactgcctggacagattaaacccaggccccaagtggctctcccagttgacaatttttctttcaaaaaggccgaagttgctgtgagccaagttcttgcagccgaattcctggacacagtttccaacaattccaatcagccagctctgcggttgggctgggatttcaagcttgccacagtatgaagtccagtttgggctatattcccttccctctcgcagcatgatgaaggtttccccgcaaaatcaaaaggcttactgtcaagttttcgattggtctgggcttcgtgctatcgtgtgtggtgtgggaaggaatatgaatgtggtgccggctctaccatggggccttgaggcctcgtccaagccatccagggaccttatgaaagtggaacggaactcttttcatgtatattccaactgctgaaattccccagacacgccacagtgtgcaaactcggtgtaaaaagaacaatggctggataaaaaccgaggcgagtcggccgagtacgctgaagacaagccagtgttgctaatgcaagggaagccaagcctggattctccccctccttcttcacctcttcttttcttcttttcttttttcctttagcacgtggaacttaatgaaaataaagtcaccgtgtttccagggcaggaggctgctctttacttgaataaaatgtacatgcaaattcactaaaggaggctggcacttgggaaaacacagagatgatactcagggctcaaactgatggatagcatttatgtctcctttctttttttcttaaaccatagagataatatgtgtctgtctatatgcacgtacatgtgcacatataaaacagggctgtgctagagccagttcatactgactcctgagagccaactgtgcgtttctcttcccaactccagattcagcgaaatgatattggtagactgaaattggcccacagtgggagtatttacaccacagaaatcggcaaaggctacaaaatcaaaattctgttttttatcggacagtgagttattaaatatttaccaactatattgtaactacatctactttactgggggtatgtgtgtatatagatgtatagaggcatatatagatatatacacatatatattacatatatgcaccagatacacagaatacagatgacatgcacgtacttttaacctttgtatactccccttaatccataacctctctttattcttcgaaagcaatatgaaaaccatggatctaagtgaatctgtatgcttttatcataaaaaagcatgaaaaaccaatctgctcttccaaaatataaaagcaatcactaaattgattcctttttttgccaggcattaactttctcctattactgcaaatttgctgcacttgtattttcttccagccccagaattaaacacacttctaatttctcacttcaggtgcattaagtgcggtatagggcacaaatgaataattttattgataataaattttataatccatgcagcacttgctgaaaaatggatgtgttctggatgcattctttatttctcctaatttgaagacgccaggattgcggtcgccctgctcactgagcctttggtaattgctggctattttctactgctttgagggctgattgacaattcaggcacgtgctctgctttacggggataaattacaataaccagtttatcagattattatttttattaatttaagagactagacaacagtagtgagtggcttctgtctcctgcagacagaatttatcctactagtttaatggtgctgtgagaagctgtagacataatatctcacaaaaggtaacatccctatatagtctccccaaatcacgcaaataaaacatcaataggaagaaaccattatgggagagtggtctgactgcagttgagaagggagaagcagagaaaaacaccaaagaattagctggttctgagcttgcttggaaaggataatggttaggacatcagacaggtctcagtcccagccagctgaactggatccgtgtgagtcttaaacaaattaactctctgaccctttatcatcatctgtaaaatggaggcaaaataacatctgtctcttaggacacaggaggatggatgagatcatgtaggtaaagtgcttggcgcagtgcctggcctgatacacacccgatgggtggcagctgttaactgttcttgggagtctatactgaagaagccaggaaagtatttgtatcaggtgagaaccaacaaaaaagtacagtctggaaactagatccacaaaaagttgtctatgattgattgtaatgggtgagttccccatcatgggaggcattcaaggaaagctgggcatttgtggaagagattcatgaacggattctagaatcagaccagatgatttgaggttctaggattcttgtcaaactattcaagattatggaagaatttgtccaaatagccaacgttcattgggtacttaaatgcccagcatagctgtaagcatttttttttttgagatggagtcttgctctgtcgtcaggctggagtgcagtggcacaacctcggctcactgcaacctccacctcctgggttcaagcgattctcctgcctcagcctcccgagtagttgggactacaggcacgaaacgagccaccaagcccagctaatttttttgcatttttagtagagatggggtttcaccatgtggccaggatggtcttgatctcctgacctcatgatccacccaccttggcctcccaaagtgctggaattacaggcatgagccaccgcgcccacacagccagctgtacgcattttacatgtcactatagtttggatgtttgacctctctaaatctcatgttcaaatctaatccccagtgtggtcgtgttgggagctgggatccagtgggaggtgtttggatcacaggggaaggagcgtgagtgagttcttgttctgttagttcccatagagctgattgttaaaaacagcctggcacctcccccctccctcttgctccctctcttgtcacatgacctctgcacatgctagctctcttccctcttatcctatgagtggaagcagcctgaggccctccccagatgctggtgccatgcttcttctacagcctgtagaactgggagccaaataaacctctttataaatcacccagcctcgggtattccttcacagcaacacacaaggtctaagacaaacgatatctcacttaatcttcacaacaactctctgagagagatgctgtcattatcttgattttatagtcaaggaaagtggggcagcctgtccaaagtcatagagccaggaaggggcagagcccagactcaaaccaaggtggtctgcctcccagagccacgtctttggcctctaggcctgtcggcaccatcccaaccacacccttggaccaggccaatggcatccacctgcacctctccctcaccccctgagacccctccccatggcctgctactgaaacatacacatcccactggtatggccagctcaggaatccaagaaaacatctgtgacctgattgctcatcaggcaagaaaccacgagaattccatgtctgctcaagagcctccaatcatgccaccaatgggcagagcttatttcccaccatctgatgggccaaggtcatgcacagcagctttggaagccaggcctcttcccaacataagactgccacagttgatgtgtgataccagcaggctctttgcctaggtttgtgtttccttgatgaccaactgcacctgatgcttagagccacatctgcagctgatggactgcacagtagcctgcccaatggcctgcccgagtgaggacacagcaaattgttaaatggatagatttgctatagatgtaccacaaacgccactgccactgaattatggccatatattgtactatttataatcgcaatgtagttaagttggatttattccttttttcagcaaagactcacctgacccttaaaacaggaagtattttgcttattgcaaaaataagtacatatcaaaaaaaaaagaatatttccagatctctcttttggcatgctggctaaggatgggggtgtgctagatatgctctcaagtagcatctgtgacaatgggaaggaaccccttctgtggccttgagtcagactcaggggccaggacccaatccctgccaagagcctttctcaacacaagagaagacatcccttaaacatatgaaatcaaaacagcccccatgttgtagccaggggaaagcgaaggacagctggcagcaggtggctctacagagaaatttcccaggacaaaagtagatctgtgcagctccccagatccaagaatcaccctaccatttcagccaggggggcctgagcatggtgtggtggcactgagctcctggagcctttggaagtagtgtggaaacacccagatgtccttattcacccaactcccaagacagatgcctggagcaaggcacaaggagggggtgctgtgcccagcccttggtcccccgccagcaacagcctgtttgttccctggccccagaaatcacagctctgtacaaagttcctggtctgggcaggacacctccaccaatctcctcctcgtcctcatcttctaaattcccggcattccacgggtccctctccccactctcctgattaacagccggccacctcatttagaaagctaacttttctcagagttccatcctgttcttgaggtttcggttggaaacttggcctagatgacagctgtgtgggcctctccccagctcgacccagcaggagttctaatacacttcattctggggctggttgctgcttttaatctatcagcacggcgccgcagctgctgtaagctagctgaaaattgtctgcatacgggcgaaccatttgtaacccttttcagtgcaaacccacacttcggcagaaatgcactgtccagctctcccacacctacgaaacacgtgggcccagagtggccaagatcttcccttaaaccaagaggttccccacccgaacaaccaggaaactttcaaaaagcctgaatacattattggcttggaaatttcactctcctgacccaacttctcatcccaaggaaagccaaaaggcttcttcaaaagctcaagcctgagcgccagagcaccatcggcccctctcactagggctctgcccaggactcctctgccacttccctttgattctcagtaagagaaaggggcttttctcccctaaggaagcaggctcagctttgtggaagccctcccacgtgctgcccaccctcagaaccaacgaggacctggctcaaggcaacaccacctgattctcaaatctgctggtgccatcaactcaaagggtctctagtcgatctactcagcaacatcagacccatcggggctccgtgaacaggggagggcaggagttgaaatgcttgccaaatattaatagttacagttcttacacaacagccagtacccttcaggcatccaacacaattttagatgtcaatagggaaagagagaaaggaagaaaagtaggaaaataaaatggaaaagataaggatggaaggagagaatggagaggagagggggagggttaagaaagggagaggaagggaggggagagaaagggaggggaggggtgataggaacaaggtgggtgctcccatcagaaagcaccatctatccatccatcaatctatccttccttccttccttccatccatccttaacctgtctttgcaaaccccctggtggtcagtggtaggaggcctggtctaaccccacttccagtggagacattcagaggagaagttgactccttacccccagacttccatcaccagcggaggagacaggcttcctggcttctccacctgctacagaggcccccaaacagcactcatagccacctctgctgcccagtggggagagaggcctggagagggtccttcctcttctaccactcaaagaaggcccatggctcctcccaacctggctcactggtcattagatttctctgcttacagagcagcacccataaaagtctgggtcacccaactggggcaggactcacaccctgctcctggagcagatgggtgcagcctgcctagactctcaccccacctgcagcccagccccagcactggctgggagaggaggggctatgaaagactccatggcccaaagaaaagaagggctgcaggaggcctctggggagggatgtggagctgtgtggtgggggaggccacctcccaaaatgagtccaactaaaaaatccagtcttccctcagaattgatacggcagcagctgtatctctttcatttgagtaattatcatataattaagtgcatgaattacaagagagccaaggcattaaattaaaatatttaatgcttgtaaatctgaaaatgattactgtgctgatgcgcagccagtgagaagggagactaatggcttggcgggcagcgcggggaggtggtggcagcctcgagcttcaccccagaagttagagaaggggaggggaagagggtgtcagggaattttggggagggggtcagcagcaaccttgagacagggtagcctgagcagaaaactcacagctgattctctgagtagggagagccatttgtcctaaaatgagagccatgtgttcctaagctgccagcaacaatagcacagaagaggggtaagacggggtcctctcactgggactctcattgggacagaaaggaatgggcccaaattgatgacatcactcgcgaattaagttttacccctcacaaagtgttcatgttcctgtgtggacaaataaggaattcaaggcacagaaaggaacagagacttgccaaagatcacaaggcaagttgcaagcagggctgaggctaggactagggactctgacaaactgaacctccccacctgtgaagctgtgatgagctagctcacccagctttagctggctttgatgtgacccaggatggcattagctgatcctttcatttcccaagccaacctctctccctctcaggacaaaagggagatacaaagctgccactgcgatgctcccatgatgctgacgcacagctccacaatgtggaaacaggggtgagctttgggtttctgtccagaaaacactatgcgctgcccagatagaatcaggctagacagaccccagaagggttcaaaagaaaaaggtctcccagtcagacccagccctgccatctcggtcgccgttcatgctggccaaccaggaatcggacaacaagcggccttaacaaaagctcccattcccaccctgaaatgcactcaccagggaaaagggaaggcattgaaaagagcccagccccagtagggaggatgcaaatagccgtccagtgcaggtgcaaggaaattaggtgcatgagatgtcaagagaggctagggcctcctctgcccatgtggcctccaccaggtgtggccattccttggcccagaagaccctcccttcccatggacccagccctctctgatggccagctcctgacattccacttgacagggtggacccagctctaagtactcattccactcattcctggaggggagagccggcctatactcctccggaagtggaccttgtttttattcccgccagcatccattctccctccttttgggaacaatgacccaagagtcttttggggaaccaccatcagagaataatggcactcctgaatcataggtgagcatgtgattcaggcctggccaattagtgtattccatgtctctggataaagagactgggtcagggatgagcatgtgactaaggcctggccaatgagtgtatgccatgcctctggataaagtgattggttaaaagatgaacatgtgaccaggcctggccaatcagagccaattgtaagaattttctggtattatggaggttaaaggactctcctgtcatggaacaccatggaactgccagctaagggggtaggatgtgggcctggaggggctggtggccattttccgtaccatactgcaagggttttggcagagagggaggctaatagagaaaaggaggaccaacagctggagacacagagggcagggctgggcctgttgcaccttaagaagccctagtttcagcagcagtgagcccttccccttgttccctagaccagctggaggcagggttccagctcttgcaactcaaaaaacctctgacaaggcatacaaggtatgtatgcctcctaaatcttcagtgcctcccatggagggcttttgtccctttttgtccctctgtctgtctcccttcctgcctccgcctgctctcctgccccacagtattagtacatcgatggtctgaacaaatgaatgaatgaatgacaaatgctgtctgcgcaagcctttgggtccagtgagggctccccaatctctcccacacccattcctattcactaaaattcacagcccacccaaatctgtggaatagctggtgttggatgtcactctgcttgagccactgttggctgcaggcctcttgtcccagcacacacggggagctccttgaatgcaggaaccttctcacatcctcctcgtctgctccccaaagctggtcccagggccttcccaccgccagacctttaactcttcatgtctctactgtgtgaaatgactccatccctccttcaggagtcagattagaccccaccagccccttctagtaaggtttcccagaacaacatccctccgaggaaaacccccgcctctaaagaactctagcacctactgcgcatgccactggtgaccaatcctgttttctccacaatctaccctctcctttccacctctgctaccagcatccttcttcaggccgctatcttttccctcctggatgacaaaatccttctaaccagtttccccccttccagggaggatgagcctgtcctatcacctcactcaacccagaatgagcttttcatggactcctggagaaggcaattcctaagggtcagaatgccccatgggggtcaacatacgaatcctccaagacttctggataatccactgagactgcagatatgaaagtctgcacagagcagatgcccagttagggtcagggttgggaggtgtgttttcctgagtggcagcatggcagagtgaaaagagagccgttttggggtcccataggcttgggtacaaatcctagccctgtaacgtcctggctgcctatatggcctcagctagattactttaagagcctcagtttcctcctctggatgatgaaagtaacagcaggcttgttgcaacagccatggagaatggatgttaagcacctcctctgggccttccactgtcacatggtaggcacttgataaatgggcactgctattagtctggggctggttgtgtggtgtatccctagcctaagtagtggagtgcccgtggaaaaaaagactggcagcttaaacgggccattctttaaataaatgaataacaaaattgacatgtattgggagttttactatgtgtcaggcactgtaagtgctttccatttgttaaattcatttaatcctcacagcagcctaggaggtcagtaataattagtgatatcccattttacagaggaggaaattgatgtggcaggggcgtaagcaacttgcccagggaattcagagctgctaaaggaggtgctgaactagcacttgaagccatctgaggtctgcattctgaccctcctcacctatggagcctgcctgctctgagctatggactatggctgttaaacaaaatgaaataggagagtccttatccctgctcccagaaactcacaaatgacactggcacactcgtgagatgcatttggtagaaaaaggacttctaatctggctctgactgacggagcataaatcatccagcctcaatgcacccccatgccatcgtgaccctttagtgaaggcctgctttgtgcatggaactgtaacaggcaggctctttctttcattatctcattgaactctcatggcaaccatgtgagatgggtgttaccatccccattttacagataagaaggctgaggctcagagaggttaattgcaccatggccacagagcaccacagagctaaaaattaaagcccataatggttccaataaatcaagctatcttcatttatatggtgagttggggggtatttatttaattctttttcttcctctccctcatttttagctcgtagggagtcaagagaggtgcctcctaatgaagaatgaaacagtttgctataatttgctccaaaacagtatgcttaattaccacaacctcttccccaaccaaaccacttaattgaattcagatagcatgtttgatgttatatataatatttggcaacttggccctctttggggagtgtattgattgaggaggaaaacagatgttctggaagatgtttccagatcatagctggaccagacggctctggagtttaaaagattacagaagtgcaaagagagtcgtgataccaggggccagaggccagggcagcctccatcccatcactcaccagaaggccacccccagcacaagtgtgtcagcagaggtctctagggccccattgccaccctcctccaggtcctgcccgtgtgctggggtagagcaggcaggagggtcaaaggcatggccatgcatggcctcctgagctaacaggaaaagagcaggagggctggatggacagacagatagtatccctggtctggagaaggcctaactggaagagtcattggccaggcttttccaacaaggtgctgagccttcttgatttgcttgggttttttggtttatccaacaagaatttgctaggcatctatagtgtgccgtccatttattcattcaataaatatctactaagcacctaccttgtatctttttttttaatccatttattcattcattcaaaaaacaagcatcaaatgtttactgtgcataaagcctcaggtctgggtggtgcctgcccaccaggagctcccagtccagccagggaggaagatattcaccaactgtacacacgagtcaccacctaactgcagcctgagagatggatgcccaggagggtagacaaaggggcagctgctccgagggcatcaggcctgtgtcttggcaggtctgacacgtggagcgcaagtcccagaagaggaacagcatgcacaaaggcctgtggctggaatgcagagtgaggggcaagtgtcagatggaggggaggggaggatgggggtgtctgaccactctacagagacttgtggcctacactgagggtctctacctaaggacaatgggagcgactgaaggctccagacagggagacacattcagaaggccacttccagttcaccatagagaacagatgagtggttgggagcgtagaatagaccagaagagcagagaggatgcaggttctgactgcaagttcagaagtgaaatgcacagcccctccccactcgaacccataggtcactccaaaacagggacaagggaacaggcagctgccctcctagatgaccaacactgcagagggcaagttgggttttgaatttttactattattcttgctttctttgctccatatttattttgaaattacaaacattaaaggagaaggtaaatattttcattcattcttccatccaaaaaatactgattgagcacctactatgtgccaagcaccgtgtgtactaaggggcaaacaacattcaaggccttttaacccaacagtcagaccccagtagccctttctacaccatcttagacacatgtaactaagtcctgaactgccgggttcagaaacagcacctactatgtgtcaggcactggacagtgacctggagtggagacaacacagacctgcagctgcctgaaatctgctatgagcaggagacttgcaaacaggagccagaaacatgacaattccctcggcagagggaacgtcccatcccagtgggacacaaggacagaccccatgagtaaaaggagggagaggcattggagcaggaccacagagagtgggaaggattttaactggggggagtgaggcacatgaggtgaaggtgttttccgcaggagatggcatgcacaaaagcatgaagccaaagcacatgccaaaaacagtctggaaaccaaatcacccactctggctgcagcacaaattggaaaccaaagggccgtaacattgatacctagactgggccaagcacagagagcataagatagctgagcaaaacagtgggcttctttctacaggcactgaggagcccactggagtctttgagaagtggcatgatcaagtgtggtacttccagattgtgagtaacggcacgagttgggaaaggctgcttgtggggagaccagctgacacgccactaccatagctcaaggaactgtgaggaaggtgtggatggagcaggtggtggtgctacaaaggacgagaacatgaggcctcccacagtgcacactggagagggatgctggcaatgggaggaatggaagagcaggtcctaggcagagctgtggagagactcaactgttgtcataatcctggctcaatagtctcttacagaactcatgtgaccaactcatgtgacctgggttaacttaggtttctactggttgagaatgatatggagtgcatagtacatgtaggctctccataagggagagcgggaaggtttggctaactagtggacaggtagatggatgaatgggtgcggagtgaataagcaaatgggcgagtgaatggtgacttaaatatttggatggatatatgaacatgtggacgatggatgatgggtggatgaatggactgatggaaggtagaagtgggtagaggagtaaatggatacatggatggaccagtggatgcatggatgtgtggatggactgatgtatgtcctgcagtaactcccagcagaacatgtctagaggatgctgggagactccaggccagtgaatatattctgggtttataaaccatggggtatctccttggcttacctaatcacttccaattgaaacctcttctctcccagctccattgtcttactccattttctgttgctataacagaatgccacagacaagtaatttatcaagaaaataagtttatttagctcatgattctggaggctgcaaagtccaagagcacagagacgacatctggagagagcctccttgctatgttgtaatgtggcacagggcatcacatggcaagaggacaagtgtgtgcctgtctactcaggtctctcctcttctggtaaagccaccagttccatcatctgggcctaccctgatgacattatctaatcctaattacctcccaaaggccccacctccaaatgactcaacatacggattttgggattaaatctccaacacatgaaatttgggggacacattcaaaccattgcatccatcctctgcattcagaaagatagtccaacagaaagatctggaatcaagagacccagctgattaccaattccagttttgctctgatgtgctgaatgaccttagacaagccccttcccctctctgggcttctctttgctatccagttcaatgaaggaataggactagatcagggatgcgtacatgtggtgagcctgctgatcatccccacgccttcatccatacctcacagcaagccgtaccaatctctaaggaatcactgcacggctgagccccatttgccaggtgatctttaaggaaagtggttctcaaactttagtgaatcagaatcagctggagagtcttttaaaacaaagattacaggctgggtgcaatggttcacacctgtaatcccagctctttgggaggctgaggcgggaggactgcttgaggtcaggagttcaagaccagcctgggccacatagtgggacccgctgtctacacaaaattttaaaaattagccatgcatggtggtacatgcctgtggtcccagctaatcaggaagctgaggcacgaggatcacttgagccaggagtttgaggctgcagtgagctatgatagcaccacagcactccagtgacagagcaagatcctgtctctaaaaagacaaaacactgattgccagtcctcacccagagtttctgattcagcagttgtatgtggggctgggaatttgcatttctagcaagctctcaggtgatgctgctgctgatgctgatgctgctggtccttggactctacttggagaaccactgatctagtgacccctgctctgagagtcttggtgaaacctagtaggtatccccatgtgggggacagcttgccatacctaagactggaagcctgctggagccactgttgcctcctgtcattcaaaggcatccttgaacccaatgacaggggcactctccgcctacagccagctgcactccaggtcgtgcatcccacctcgccctgccctgctccctcctgctttccctctctcctggagcctgggagagcaccaggccttctgctgcctgtgtgctgcctgcccctgctgccctcagaacagctgtgggcttaattatcaaaataacattttaatagtctcataactgaactcccttcaaaacatgccagcggaggaggtgggaaggattctttttagcacctcttcccacccgacttgctaatcggaggcatttaaactgctagaaggcccagatgcccggccctgcccatggagcccctcctgccaccaccaaggatgcagcttccacaggcggatcgaggggtcgggcccataccagactgccagccggaaccaggagtcattgcaggagccacactgcaccttcgtaatgagaagaaagtggctcattcacgcgaacccaggcatcactcaggaaagtggatatgctaagagaacttaggcaattcatttgcgatcaccaggggtttcacttgctttcaacacattttttttagatttaaaaaaaactgctatcaccagcattaactctggctccccgtctccctgccatttcatgtaataattccacggggagtcctggcgggtatttagctcctaatttaagctccactaaacaagcccaacgcaaaactagcttctcagatcagcagtttcccctcctacttgccgcagccccttcactctctaggttcttcaggcctctaacatcacatccggccagcattcacaacacccgggctgtgagctaagtgcagagcatgtgttaggagtggctgccccagtcctcgttcagcagcacagggagataggcccgactgtgcctaggaggaaatgaaaccaggacaggccacatccccaagctgtatggctagcagtgggtggggcttcgacagaggccaggctggagggcaccgtgctacctccggcagcatttgccctgggtgtcccgacttccaagccagcccttctcaaacttgactgagcatgcaaatcacctggagctcttttaaaaacacggattcttgtttggcaggaccaggtgaggcctggcctttggtacttctcgcacactctgagacactgcagatggtgtaggtcactggcccacacttggaggagcctgaaggaggcacgggctgccctccagggtggttagatcagagactgagtgcaggctgggagaagcaaaggccaaactctgtcttagggtggggtcctttttctcccctggctctctcctgatcaccccagatagtgctcctgactcctgggagagacagaggggcagggctatttcaaaggtcagtgttctcatcttaccctgttcatcccgtttctcaaactccatacccagacatggaaccagaagtttcctttgctctctggaggaaattgccagaaccagacaaatccctttggccctcatcatatttcctgctgcccgcattgaccacttactgtataccaagatagacactgggaacactgggaacagcaaccgtggctgtggtccctgtgctcaggcagctgactggggtgcctggccagctgctgtccaagggagctcatggtgccaggtgaactcgtggtgggggcaggggcagaggcaggggtgcaggcaagagcagtagctgggctgggcactgccaggtgccctgaaccttgacagagtcaagtctattgagtgttagccccaatgcaactacattcactaccaataaaaacggaggccaccatgccactcgtggacactacctggaggcaggcactctttcacagacttgtagactcaggccactgcagtccgtagctcaaggccaacccttagcaaattggcccctacccatcagaaaactggtcctgttggaaaacccccagagcccaactctctgctgcccacacagtctgccccagtagagttcagagccctgaattcaagtcctacctttgactttccagttgctgtgaccttgggcaaattagttttcttctctgagctgaattttttccattggcactgggtgtgattcccagggtctagcccagagcagatactgtatgataaggaatagatgcgcatatattctttattatatgtagtctttgaagtgaaaggcctttacctttttaaaaatgtagtttaatactattcaatgaagcaagtgattactaaacatttaccaaatccagaatttgggggccagaaacagagggcacagatgagaagacaggcaagtccctgttctcaaaagaatctggaaataactgagatgtgccaaatggatgtgacaacattaaagacaacccgggcagacaatgaggcagtaaggttgggtgtccaaccacccagggcagacaatggaagacctggggtcaggccagctggcgtgggggggtggggtccctgcaggagcggtgctgtgagccaagtctccaagaatgggaaagagttgtaggaaaagaaatcaaccaccacagccataataatgtcaaacatttatgtactcattgctactccatgtcaacactgatctatgcactctacatacttagcttatgtaattctcactagcacataaggagagggtaccgttatcatcaccgttttactgaggagaaagcaggcacagtgaggttacatgacttgcctagttgcccagagagcagagtgcagaactgaggctcacacccagacagacgccagggccccatgtccagcaaggcccagcgaccagccaggagccagcatctccacaaacagagaaaaggagggctgggacatccctccaagcagggtcaaaagagaagggaaatgtggtgcaagacttggaaggtaaggcaggcagtccagcagccgctcaacttgcagcaggtaagtgcaggaggagagcaaggccaggaggtgacttaaggcctgcaggaaaccttgttggcagccacaggcagtgccgaccctcctcactcatggagagaaggatttccccacgccccactgatggcacaagagggagacctccactgtagaagcagcttctgtcctccttccaccatgcaggtgcaagaggcctctccaggacataacagcctctgtagttcctatttgccagcgatagagacccggctcccagccaccctggaccaggctgcctctgaaactctgcactcacattgcagtaaaggccagtgcctgcttgacctagacacatggcaggcacacactgtgggcaggtggaagaaggcggcagggggtgaatgtccagcacctgcatttggaagaaaggcaggatcaacagagcctagagccacagtattccaagatcctcatttctctgggcagggagctgggcatgccattgtccaaggcttttgaagccacacaaatggcaccagtcccagtaaacatcccccaagacaggacgggaatctgaatccttgtctgcaaatggccacctgccagggacccccttcagcaacaagctccctctcccaatcccagaggtggcctctgtccagcctatccatagcagctggaacaaggcatcccagccccctggctccagcgggggaaggactgcttccatttgctaagggtcttcttcatttccttcaccttctcacaactgcactttctaaaacaggatattaagggaagagaaaccgagggctttggggttttttagcctctgctccagggaaaaacagacactcatccctgtctgaaattgcttcactccgagagcttgtgggccgcgggagcctcccgccacagatgagcagaaaacagagtttgtttctctatttcccagccccctcgcctctcgccctctccttctctctcccacctcttcctttctgcctggtgcatggctgggagctgggaccttgtggctccacacggctgcctggtgccacggagcagggcatgggctcccacagtaggcagcctggaagggagggggaccagcagaaaccctgcccacttcctcccacactcccgaaacccctccaaaccagtcatcaaataaccctggacggaggtagacccaaggaccttttgttccctgaaatattcaggttttcaggtcattctctggccttgccaggaatgcagtgtactcctggcttgaacaaaatgcgctagtgttaaaatattcatctggttttggttgggactgagagggtgtgtgtgtttcagggaaacaaaaacattattttccccgcttcctctgctcccaagcatacctgggaggttcatgctccaccttgattttggcaaattcttttttagattcctccatgttccccaggatgcagagggtgggagagacacagatggatggattcaactagttgttgcttctccaagggaaaggggagggatattagatattttcttggaagttaattcaactcgaagctgggcactgggaatattctgtccaagcaattactccctgcccccccacccccacccactgctgccccaccccagcccctggtggtagctgcctaccctccagaaggtcaggtgcacacatgcccactgaccagatctccatggggcaggacccctcttgggccaactggaccacactagggccctcaggatcctttaattatcagtcactccacttcccttccctccgctccttagtcccagcacagaaacctgtcaagcgtccaccctgaggactgggaaaatcagctacctactggccctggtctttaactaaaggcttaagctaaattatattacagaccgtggggagcttgggagtggtggctggaggaagggctgttgttgggcttgtggggagacagaagggagggtccaggcaagctgagcgtgctggcatccacttctcaggaaaagctggggaaactgaggcttgcgtaggagtaacataattcatgaggggctggggaggcagggaatccagccagcccctgctccatcctttctcaaggaccaccataaagggttccaaacagtctttggggaaagaagaagacaccccaggtagtcagtcctgcgagatgacctctcccatgggagggcacagggagggctggcagagggtcagctgaagaaattcagtggcccagagtcatccagaccaacacaccttcctgcctcacatgcagtttaccagtgagtttgtccacctacctttcaaattataccttgacgcagcctccccagccactgccaccaccatggactgtcatctccagccagtacagcagcagcagtggccacccacgggaccctgagcttccacccttgctcttggatgttcccatctccacccagaggccatagcaatctttatacaaacttaaaataggaaaatgtcactcacagcttatagtcctgcaataatttcctattgcagagaataaaatcccagttcttggccacatcctggaaggcccaatatctcctgggctctgctggcctctctcacgtcatgggagccactgtcccggtcactccccacactctagccccacacccagctggctccctctcatcctttaaacctcagcttgaccaacatcctcccaattttccctatccctgcaccaataacacgtctcttagtttgtaattatgtatttacttgtttgcctgtttattcctggctttcccatcaacacagtaaactacacagaggtgtggaaaatacatgtattcattccccagagcccagcaaagcgcctgaagcagagcagtctctcaaatgtttgttgaatgaattaaagaacacaggccttccagttagctcaaagcagaacttccccattgccaagggatgaagaaaggagagctttgaacactcaagacccgtagaaacaaatattcttccaacctgtgatgcatatcaatcttccttgttccttcttaattcctgatcacatttggattcagatatttaagaagccagagaagcaaatgttatacaatgccccgagaaggccccagagattccacattcgagggtagaaaagtttcactttcataaagcctaataaaatcttgcttccaacgagcaggcagcggagaacgcattcagagagcctacagggtgctctgtggatcgtgagagcatagaaacgtggactgtgaccagaataccagagttcacaggacccaccaggaggacagcccgaggcccagccaggcccaccacatgcacagaaaaagggccctgagagttcacgggctgagtagatgtacgctccagccgtgatatttataacaataaatgattcacgagattgccacagcccacctcagtcctccttaagaaccgtggacaaaaacaaacacatactcaccacccgctccccaaaaaataaacaaggggggaagagaggcggtatgttcctccagccccactgatgtgggcttactcattactctaatgtaatcagaagaacattaaacatttctaaagtctcctctcttttccatggctgattaagcaattgggagcggagagtttactgtgaaaaaaagcaaacaattatgtgctatccgaggtaaacattaccttagtaatggaagctgagatgcgcagccccatcgtcagtagggattatcattataatacttaaaataacatttataacacttactgaaattacacgaatgaagtctgcagagacaccgaaatgaaatcagctcaatgtgtttttataagaatactgaaatctctgtcccttggaggaaagttataggcattaacagtttttgctaggcctccattagctggtaaaatttgaatactgtttcttaggtgagctctaatcttctttgaatcctcccaacacattttatctgtaaaaaattgtagttaaaaatttagcttgatggaatgatatttaagtgcttttcctcatctaactccctgaaagtgccccagagagtctccctgtaatttgttcaaacgaaataatattttcgtttccccgtttctctttgttgtcttgggtgatgaaaagtaacatttcttttctttcaatcctattaagcaaggctcgaggaatgccagccactcaatccaaatgcgatctggcagacaggcactcagcttaaaaaacgggacctgccaacccgggtttctgtcaggagctgacatgtcaccaggcgtcagttctgtgcaacatttcccaagcaataaccagggttatcagcaagctgagtgagttttttccttctctctcgctctctttattttggttgccacgctgggaaacttggctcaaatatctggttagttgcacctactctgtctgcacacccatgcaactcaccacgctcacatagtctcctgagcccacctgacgcctacacgcaagctggggatgcaagaaactgtcccattctccaactgcagaacttcctcccaggggaagccccttccaggcaggaaggtgcatgagatcctactctgttcccttcctgaatccattgagtctcctattcctcttctcatcccccatggcttccttccatattgcagacattgatcaaacttacaaactccaagccactcttcaaaacctgttataaaatgtcacctcttctctgaagccctccccagcatccgagttgtatctgtgctcccattgcattctgcaaatgcttttacttcatccagaaaggtgtgattaaataagttacggtgcagccataaaataaaacactatgcatactctattttttaatgaagcagaaccaaatgggttgaaatagaaagaagtccacagtgcaaacctaaaagcgaaggaagcaaggtgcagaataaccaatgtaattgatcccatctgaataatacatggaaatgggcataggaaattcttggaggcacataaacatcaataagagtggtaggtggcttccaggcagtggaaactgagggaggagtcaagaggggttagagaaggaagaatttatattcttctatgtattaaaatgtttttccacaaatatgcattacttttggatgaaaaaacaataaaatcaacctatgttgatgaaaaaaacacttattagcaccattttgaatttctacatttaactcactggaatgaatgctatcacaggataaaccactatcaccaaagatcagttttatcacacaactttctaaatgacccatactccctatccatatgtgaatatcttgctgacatcacaactgttaatttattgtatgtatggaacccctctgaagatgaaattctcttagcgacctactcaaaattgggctctgccttcccctttctgttcctgcctggctggtaaacagaaggaaaggccagccaagaagaaccacgatgagacctcagaggccacctatggaccgcaattttggacactagcaaagggttaggacctaggaaccttcctggactgatgggaacaaatggtcatgtgtttgaggcattttggccaacttgcaatggtgggttttttcatttcctgtatgttcctatccttggatgaaagaatagcaagaacagtatgaccagggatgctggcaggacactgacatttgggttttccagataaagctgccatttgacattagaaaagcatcttgtgatgatgctaatcacaccataagtggggaaaaaaagtcatgatggcagcatcattcccattctataagaaatgtctatggattctaaatgatttgagaacaaatacatgtgcgcaaaaatattaagcctatcaattttattctaatgacataattttctttacagatgcattaaccatctacagaagtactaatgactatgcatatttcatatatattcacacacacatatatatatacacatacataaatacatatatacacacacttatatgtcgtcaagctcaatgaccattacccagggagaaagggtggatactgtaccaaatctatatccaataatggcaagtgcctagcaagtgtgacatagtgctaatgaacaatcaataaaatatattgatcaggtttaggctagtggtcctataaccaagtaccacaaccttgcaaatatcaactatctgtccaaagttgggaatccaaatgttttctgctactttgctaagttataagaaagctaaattcttttaaattatggactggagctaggggcaggaggaagttggagcctggggtgctcaggaatgtgtcagtcacagacccagcttgttcactgagcagataccagccaggcctagaagatgctagaataagctctgataaccacaaagcattgtcttccaagcttaaaaagtcccttttgtaaatattggtttgtaggcaccaacacccatgtgcttagagaaggaagatgcaggaatgcaaacctctcccacacttcccatgaaaatgagagttatagctggttggtgcaagggtgtaagaggcctctgtggagcccatttcaaatgacaaagaagatccctcccacagcccccatcgtgtcccttagtagctaactggatatacgaaagaacgtctatctaatcccttttaggagctgggcctctattgtggaatgaattggagtggctgctatctactgcctacgcttagggcatcctgtactttgtccaaaaactgtgtttttcaagctttaagggggctgctgaactttggttttctgggacttttccaacagcccataccacagcctccccgagcctcctagagctataggaattgtctgtactcatacgctggggctgccataatgaagaaccacatgaagactaggtgacctaagcaacagaaatttatcttctcacagttctggaggctggaagtccaagatcaaggtggcagtgtcaacagagctagcttcctctggggcctccctgcttggcttgtaggtggccaccccctcgctgtgtcctcccatgatctgtcctctgagcacatgcatccctgatgtctctctgtccaattttcctcttcttatgaggacaccagtgagattgtattagggcccaactgagggcctcattttgattaaattacctatgtaacaatatgtaatttattgttcaatattgctacatattgcttcaatatgtagaatgcaccgggaacataattcagcccagaacagtgtcttcttgggtctctgttattccggaaggaaggagcctcagctgtcttgtctgtgtcagatccagagcctcctccccggcactcacttcattagctaagtgcaccaggctcctctaagcactgccatggctttctcaaggcagaagggtcagaagtgctcatgaactttcaggggcaatgaccctgactgtttctccccagccaccctctttctaaattacctttaggctgtggcaacagggacttgaaggtaacttcatccaatctcttcccccaagaccccctcagggtagcaagacctgatggattggaagaccttgcagaaggaaaattatgataataaagagccgtggctgcccccagaacacagatcaggtgtgggtgagaaagcgctcaggaggcaggcactgactcggcctctcagccccctgaggagcagcccacaccttccctcccactcccaaggtcccctcaagtcccacagctaccaatggagggtcagaccccccacccccacacccatagccgctgtacagccagccattgttacacaggcctcgatggggggatgagagtttgggaggtattttttagttgcatgcattttgaaaaatttgttcatgtgtgagatgcatactgcctgtgctacagagagcaggctttgcaatctgaatcggcaaatttgttaactgactgttgagtctaatgttataccactattctgcctctcgttagcaacacaaattaccggcaattagccggctgactgttcaaaggcagttcaatttcatgtataaagagaactatataatgcttaatgtatctatcaaatgtaacagcccaaacaaaattaatgatatgaatacaatgagtgcttataagggataattacaaggtgtccgtcatgagaggcaagccatggagtcagacgcacaattcaggcaaacagtcaccaaagttctcaaggctggcctaggctgttaggagacggaaaaggaattgtgatccagaggaggctcagccctgtcactggacagggtgggaaagcaggccaccgtgacgtctgaaatatacaactgtgatttcaagccctgagtaaaatgagacagtgggctccatttcctcatctgtaaaatgggaacaatagcatctgcctcccagaacgctaacctggcacaacacaaccaaacagcaacgaaagagcactgctaactctcctggcctcacctggaagaaggtggtgatgctgttgatgttcttattattacataagaatttccgaggtgaggcccagcagacctcttcccgcctgcgtcgctgacagagtagcgtggcgtgatacaaacgacacttcgatttaattaccacctttttttttttcctcctgtaactaaacattttcctctgctcagtatccctggaatgactgggccattcccagtgtattacttgcatatctataattaaataattaagaattgttcaagcccttccaaacacaacaaaaggcgatgattatttcaaagccactttaggaagagtcaagcccctatcagctccattttttgctaatagttatgcaaggctgcaccggcagcattccctcttgcatgccagcacaccaataaattaagatattcctggccgcatctgcacgagggaaattagagcattacctggtccccgccagtgtgccagctccgagcggcaggcgcagcccacgctgggcgaccagctgtctgcgaatgtggcgtgtggatcacagctcagagccaggggatctcttaggaggtctgctctaatatcacaactgcctcgctgcaggactgttcccttcacagcacagtattcaaacacttcttccgcctctttctttccaactccgaaccagggagaaccgggagctgggacctccgagccagtccccggatgccaacatgagcctggctgatttttcttgttcacctcggaatccttaatggtgaggacagcaccaaggcactttgttttctgaaaccccagccccagctgccttggaggaggggcaacctcattcctggtgggtgtaacttcaccaggcacaatgtctcgttggttttgatgagggacaagtagcccctgtgaagacttaacagccaaaatgattccacaacggtttacacaagcacaaactcgctgtcacaaagagagggaaagaccgattttcccagaaatgggtggaggctttcagtttgggaggccaagtcccagggtgtgtaacgtcttgagggtcaatatccagtttcccatgcgttcctttaggtctgaatctctctccctctgcagagctcctgagcccctgacaatgacagacaggccttggaaacggtccctgtgctttagacaaacaaaagcaaaaagaatgaagtgccactgaccctgcatttggcgaatgttcgaggcatccagatgaagcctctttggcaaaataacctgaggtgccacagacctggatcagagctggggcttggcaggtgggaagagtgaggctatgaacatcgggggtccaacaaacatgtgggtaggggttgtggggacaggtggaaggagctgatctaggagctgctgctgagtcagaagcactgagacaaggggctttgacactggtgtgggagagggtgaagacagtttcaggcagctggctgttggggtggaacaggagagagaaggaagttagggctggacaccattgatgagggttttcagacatgcctgaggacaagagtgtctaaggagtagtcaacagggtctaatggcctggaaagactataaaagtcatcaacttctacaatcaggagtcaccggtgactctagcaaaaagaatttcaaagagcatcatgctctttgcaatgcctctaacttttgctgtacttatcacctaagaattatctttcactgtttcttctggtgaactcttattcatcactttagagacccaactcaaatgcctctcctctttcaaacttccactgaccaccccctatcttcacatatctattcccacgcacacataaccaggacaggcaatcacttcctaacccattcatactacttaggaatttgcacatctatgtgtctacctctcccatcagattggatattcctctaggataggagctgtgtttgccttagctcagggtccccagcaaacagcaaaaagcctggcatggagctggcagaaacagaccagatggcatgagaggaaaactattccaagcctagggtggagagtctgagaccctgtgaatcttccctgctgcagtaggctgcctcagtaagttgtactgggggtcaactcctgaaccaacagggccagaaaccagaagaccatgggcatccatgtgtttgtactcagtgcatgagatgaacatcttcctcccagggcacactgggggcgtctgtccagaggggtggcagctggctcccgaccttacatacgctgaggctaagccccatccccaaaggacagagctctcaccaggtcccatgaggcccacaagtgaaaactggattcttctccctttcactccatctgggtatgagctgttgcaaattatgctgcactttcttggcttcatgagcaggttaaattccacccaagctggtctcatcagtacccaaacaggctacatccttctaaaccttttctgactattccatcctctacattctctttcccatcaaaaactcagactctagcatttaatcctaaactgtttataacatgagatgttttacggtagctatgtctgcctcccaaatatgttgaaagcttctagagggcagcaacaaatcctatatcttttaaaatatctacctcaatccaaagccaagcaagaatatttgataggaaaatagtgggaaagtgctgcctgctaccactacgccaccagtggcagacatggccaaacaagcacctatctgctatctcatgatgaatgattcatgcatgcaacttgatcacttctgccagttttatcggacagctgctctccaacagaactggaaggagctgtgaagtgcatgacttcaaggaggccccaagaagctactgctcacagcagcaatgtgcttggatgcagcccctctctgaggtcctccccagcagccctcctctgtcaacaactgaaggggccacagaaaatcaggagaaacaaagacaacagccaccatccccattcttggcatttcccccaagagtcactgaaacccctcttcccactccacattccagtctcagtaggtcaaagtccatcacaaaggggaaaacccagctctctaggatgtgcccttgtccaagctttcccactgcctacccaaccaaaatcagacaaagagataagacaaaaggtaggaactcttgagccatccatctgctgtctttaatattagtttataaacatgatttcttcctcctctgctactcgctctactctgggcgaagaaacgtagctcaagacctgatctgggtatcacttttcaaatgcccaaatccctgtaaaggtttagtgtctagctgtgtgcattttgctcagtattaacatgttcaatggagtactttgatttttttttttatctagacgccagaagctggtgaatatatgcttcatagcttcagataaaccttttgttcttctggggctgatcagctggtggagcagcgagagggagaaggggaggggaattcacaggggctcagcggtttcaaaaagtcaaattacctctgagccatagcaaggctgataatttaaatgaaaaaatatatatacaggctgcagcacacaacatcgtctctgttaggacttttaatgaagccccagttgtgatgacactgaagccgggaacgctacagtgggataattacttggctcccacacagctgagttccatagatgcattattaacggcacattcctcgccataacgagagctgaacagaggtaggctccgcagaccttggcgtccgccattagcggcctggcgcaaacacaaatgagtgttttcacaaaagcatgcaaaggttgtgaaattccaacgagtcttgagtcttgtgctgggaggtggagatgggatggggtaaaggggaagtggcgaatatatatatatatatatatatttggtccatacagacgtgaccagagatgtcacctttccctgcgcaaggtacttggagtaaggcaacctgggaaattatggagtcagaacacattgattttcccgcagcagatccaggcagcagccctgatgaagaattacagaagaaatgcaataacctaattctcctccaacctggccctgctgcgcctgcagccctaagcgtacctggctggggctgcgggcagcacctcctgacccgggcatgctgcacagctggactcccgtttggcactgccgggcagtcccccattcccagccccggctcacacccaagccacagcactcacaccggccacgttttcaagacatgcaggcatcacggctgcttcggggggcaagggtcttctggaaaagagaaagccacagatacgggcattcttgctcccagctcaccccaattaaaagcagggataaagacacacactcattatcacccagggccagggagagcctctgcacatcccatacaggagctccagggcaccagggtgacttagccaaggctggtgggaagccgttcccccagccctgtgcttccccttggtcttctcctcgatttctcttcccctggaagcgtctgtttcaaggtgaccctgtttcatgagttagccccagcgtcccccgcctgctcacagaaccaggggcctcccagtaattaacacccgcacttgatgaggtccagctggcaaactgaagcgatgccagcatcctcacaccacaacctgggctccagccggcccggtgagggcctttcccccaccaccactctggccactctgtctccagagaaggaggggaaagtcacccatttggttaggatgatgttcaatagagagttgtttctaatagtgacactactaaaagctccaacgggaaatttaaactgtggcacttcttataatggaacaccaagcagccactaaaaatgatgatgtagagacatgtgtgctgacacagaaaactgtcactgcctactgttggggggaaatgattacaaaataatatgggcattgtaactccactggaaaccaaaccaagtgtgctaaaatagtacggacagtataagtccactgcaaactaaacacaagtgtgcaaaaataggatgagcattgtaactccactggaaaccaagccaagtgtacaaaaatagtatgggcattatgactccactgggaagcaaacaagtgtgcaaaaacagtatgggtattataagtccaccacaaactaaacataagtgtgcaaaatagtataggcattataaccccactggaaaccaagccaagtgtgcaaaaatagtatgggcattgtaagtctactgaaaactaaacataaatatgcaaaaacagtatggccatttataactccactggaaaccaaaccaagtatgctaaaatagtatgggcattataagtccactgcaactaaacacaagtgtgcaaaaatagggcattataactccactggaagccaagccaagtgtgcaaaaatagtatggacattgtaagtccactgcaaactaaacacaaatgtgtaaaaatagtatgggcattataactgcactggaaaccaaacacaagtgtgcaaaagtctgtgcattataactccactggaaactaaacagtatgggcattaaaactgcattggaaaccaaacacaagtgtgcaaaaacagtacagacattaaaactctgctggaaaccaaacatgagtatgcaaaagagtaggcagtgattccatttctacacaggaaaaaaaaacaggcaccactgtctttgctgttagaagtcagggttgtggtcctctgggggctgggacaggaaggtgcaggaggtgaacttctggggtgtgggtcacactgtgtcatgatgtagtgcttacctgggtttggtctgggaaaattcagcaagctatctgctgcttatgacaagtaagcttttctgtatgtaatgcatcaataaagggttattacattaggttggtgtaaaagtaattgaggtttttgcagttgcttttaatttctatttattgatatgtctacttttctgtataaatatcaaactacaacaaaatgctttttaaaactgtatctatgcatgtgtgaacacacagaattgggaaaggtaaacatcaaattgttaacagcagttttccctgggaggtgagattaagggtgatttctatctctttcttctgtttatcagcattttttttcttgtaaggaaagtgtattatttgagttttttaaaacacagcttttttaaaaacaggaggggcagttcagctgaaattataaggaacacagccaattaggaaaattgataacaaccaccacatcatcatctactcaacaaataaagcataaaatgcagtttgggacctattcgaccccagagtcttcttaatgcaggctcccctaaaacacagtgacagaattcttttgcagaagtcacttgcaggagtgaattctttttccctggcctgggccataagccatgaaccaaaacgtgaataagacagctctgtgtgccagggcatcgctgtaaagcctatcctcgtcacccacaccagccgggagtcagccacgtgcaaccagagaatagttacacaaaagacaaagcaggcaggaaactcaaacccactcagcaaaggtgtgtgatgcccccacctctgccagaaccggcggacctgagggctatcccctcgcctcccctccccacatgctccttgctcattttagatccatttctaacagatcagtcttcactctgcgatgcccagattcacaggctcaacttctcactgccatccataaacagggaagaagatatgttagcaaggtgtggagagacagctttcgtgcggttgtgggtctggagaagggtcagtcatccaggtgcagtcatcagctcaccctccccaaaccaaaatccttcaaatacctgatcaagatggatttggaggaaaggttgtatgggggagtgaagagaagggggacccctggtggtgactgctatccacagcaatccagctctgaccccaaactcatccccaccccaaagagccaaacctctgggctctgcgtggtggctcatgcctgtaatctcagtgctttgggaggatcacaagaagccaagagttcaagaccagcctgggcaacatagcaagatcctgtctctacaaaaaaaatttaaaaattagccaggggtggtggcacgtgcctgtggtcccagctactcaggaggctgaggtggaaggattgctggagcctgggaggtcaaggctgcagtgagctatgatcatgccactgcactccagtctgggtgacagagtaagaccttgtctcaaaaaaaaaaaaatttctctgccattcacagacctcactcttgtcccttagaggtctcacccctgcctctcccgccagaaccctctctgaagtctggcggacagggtttgcagagatctctttctggtgggattgtagcacctcccacaggtcaacttccaaactctaccctgactctctgcctgcaaccaagccatatgccctccgtgcctttgtttctccatctgtatacatgaaacacccaagccccaagcctgctcacagagaagggagaatggccttagatctccgagaagcccccaagaccagcaccgctggtgtgggacctggaagaaatccacttcctttgcaaagtgagtaaagcttatttaggaaagcacaaggttggggagagggggccgcggaggcaacacactactgaagagaagaccaagaactctgccaggggctcagaaggcagcagaaatctctatctgtaagaggctcctcctggccccccatggaacccgcaggttccccagaggcagcttcctgtcccctgcaggagaacaggaggaaatgttgtcctagattactggggatggaccaagtcaggatagaactcaaaaactagcagtgcaaagcgagtccttgagaaccatcccctcccctcagccccccagctgcctgcctttcagctggggggtaaacagaagtggggacatatctggattaagaacccagagcagtaaatgttcccttccagattgtgcagggtgttagaccctggttcagttgtctctctctttattaaaaattccacacttccctcccatgcgccatcccctctggcccctctggaatctcttccctgcctcctctctcctctccttccatcagaaagtttggtggaaagagatggccacacccttgcggtaacacagccagctgcctccaagctgggaagcccccaggcctctctcaacagagggaatgcttacctctctcacacagacacacacacacaagtgcatactgacacaaacagaaaaacacaggcatacagaagaggggttcactgtcacacccaacatacacacaacacacagacaggaatatagagacatacactccaagatagacacaaaaacacagataaacccacagatccaaatacaaagcattaaacacataagaccacaaacacactcaaagacaaacacaaagcacagaaagaagcatccaatgtgttagcccaaaaaaacacccacaggcacaaagacatctaaacccataaacagaagactcgaaacaaactcacggggatgcagatggacaggcgcaaatataacacaaattagagcacacacggccaacagcagcaagaacaacatgatacacagaggccaccactcaggctcacagacataccctcaggagctacgacaggcacacacagggctgtcaacgcagatgtcttgggagagcaagagggcggaaggaggctggttcttacaaaactggaccttggtcagttgctcccaaaacacagacaaggcccagccaggctctttcagaactccttggcatcctctttcttgttttggtccttaaattcctctccaccccaccaccttggccattttcaccctgaacacccgggtgaccccaacagcacgatctgcgtcacagctaaaggcgggagggcagggagtgctgctgaggtgggggtgggggggtctctcttgtgtcccctcctgttggttttcctccccaatgaggacagtacaaaagaggggctcaagaagttagggtttccctgccactcccagctccagatggagctcacatgtggtaaacccacactgggacattgtccctggacatacttcagtggctacagacagaggctgaaaatcaaggtcaaatctttccagaaaccccagggctaaactgccctccaaacagcccctgatcctgcctgaacttaaattcccaggcgcactcactagcatcttcctgccttcccagccacagaccagcttagcctgactgattaatagggagagatctgcaactcatatttagcactcaactggagggattcacaggtaagaattctattttaaaaaataaagtgcccaccagtacctgcatccaatgataggctaacaaaatttttctgtgcagttagttctgaaacagtaaactaagaaatgaactcaaaaaccaaacccagattcactaatcttgaaacatccaccaaaatagcaccaaacttttaaaccatgctcgcttcctggaaaataaaaatatcaattgtctttttaaacctctatagtattttgtcaatatttttttattacagcagagaatgtataaatattttattataaaccaaaggcctaaaataaacagtttagtaaatagttattacattacaaggaaaaacatctgtggaaactgctttccatgtaattattcttgctattttacattagcgctcaacgtgaatttctttggcactaatgtttcacttgttctaaatcttcctccttgttgctattattaaaatcttaaaaaggtgccaaatcttaaatgaagaaaaaaaaatgattcactagaaattattcatatcacagtgagccactactaaacctggcaggggtgcagtattttcggtgaaattaacataaaatatacaactgcaaattatccaggaaatagctatgttctttacggcatgcttttacattgggaaaaaaaaatgttcttcttcatctcgcacaaagccgcaaacagctccattccggcaagttttaaagggaaagtaatagatttgtcaaaggagcacgggctttgaaaacagactaacaaatagctcaggggtggatcagccttaggtaattaccagagacaacgtcagccctggacagccggagtagatagagaaggcaagaaaaacaacagcccgcagcttccttccccctcgattccagagaatgtatttcctctcgaaggcctcagcccttactcctaaacacaagaaaaactgtaacaccatgtaaaatgcaaatcttgctgtaaatattttataaaattgttgcatacatcccaaaagctataggtcttaattgagagcaggcgatttttctagtcaatatatggaaatggaaaatgctaatttgtgtttttctacttatgaaaaaccctggagaacagcaagccacaaatgcactcactttaatattataaatataatttggctccctctctaccatccccacagccctggcttttatctccccgtggctgcaggagagagacagagaatcgctttcacagcatcagcccgggaaggtggccttgcatgctgtgcagaggagggggatgtcaggcacagggctgtgtgcttccccactcccacctcttcaccccctagggattggcaggcagggatggaatatggcagggccacacgccaggaagcacagcccagccattctgttccagcaaggggcagaagcaagaaggatgcctggggtttcggccacgtggctcctctctgccctgttgggtcggcttgggcttcgggctccatccaaccacctaagagctctctctgggcatcgagagatctctctgaaggtcagccctggagcagctgtgatgaacaggagcagctggcaagatggctggagcactccaagttgggagtgtctgtttccaaaccacaaaaagagtaacgccactgccaatgttccccaagagcctgctcctctggccaggggaagatcagcccacagcccaggcctcacaatgcacctcccagtgggaacctgggggaggagggtctcctacctagagctatcctatctactccagttgccactagccacatgtgactactgagcaactgaaatggggtgggtctaccctgagacgtgctgtcagtccaaaatacacaccatattgttaaggtttagtacgataaaagaatgttaaaaaagtctcattcataatttttaagttgattatatggtaccatcataatattttggatatattgggttaaacaaaaagtatactctttaatttcaccggtttccttttaatttttttttaaatgtggctagtagaaaatttgaaattgcacttgtggctcgaatcctatttcctttggacagcctgctgtagaggatgctccagtctgccgtgtgcaagcctgcctggtgtccatgcatgtcggtgccgttctcttaggtaccgtgtaaatgggaggcccccaacattatgattctagagctctgcagttctcagagtttgggattctgtgattccaacaatctgcaagtctacagctctaagagggcacaatactcagagattatattactattggttctctgcatttaacacagactttacaaataccattatgaagagggcaggaccacagccctggccttgttcattcctcagtcaaaaagggctggaatatttggtaatcacagctaccttccccgcatcctctcctaaacccaaacatagctcaaccctccctacggcagcctcctgggtgactcccaccctcccttactctcccctgcccacaatgcagaacaggtcctcatggggagagcttgtcaatcacacacaacctccttccctgggtagtatctgcttcctggaaactgttcctcaacttctcctcacatgtgtgtatttgaagaaaacagccagaaagaagacaggagtggtgagaaggacacatttagagttaggtagcctgactatacctccaggctgtgcaactttctagctgtgagagcttaggtgtgttactgaacctctccttgcctccatttcctcatctgtcacatgggaacaataactcctactttataaaactttgagggaaaactgcaataatgcacgtaaggtgcctggccacagcacacactgcataaacagtggctcttattccttttaccatcattatcatttttgtcattccagagctggcacttggagcatcattcctgggggcagaagcagtgaagggaaacaggtgtcaggccagagtgaaaacctgtgtagaggagaaagggggctgcctggagatttgtgggccctcgctgctgacagaccccagctggctggtgagcacgcgcactggggacaaaactgggtagggcattccactgtacaggaaactgagcaagggaggccatcacgccaaaaggcccaggcctggccctgcaatcctggctgtgcagagacacctgaaagtccaaggtaagagctgtctgctgaagaaactcactgcttcacttccacatgcttttggaaatatccagggaaaaactgaagtggtcgggggtgatgttaggactggatgcagatggtttataactactgcagcactgtaaatggttgcttctaaagggtctgaaagtattaggctgaaccacatgaaaatgtcattttggtaggttcaaaactggatgctcaacttactatctttaacacctgaaagtggggtgactattggctggaatgaaaggctacatggtttcgaagaaagccccagtttctgaactgtgagttggaggccacacttcacaccaggcaccccgggctcagcagaaatccctccctaactgtacacatgtgtgtgcacacacatagacacacacagacatgcacacaacatgcttgtctgcctttgaaatcgcttacaggttggaagtaaattaaaaaccaagaaagaagggagggaaaagacacagacccatctaggcttgtgcaatggcaaatttccatgttccaaagaaaaaggctaggttacttggcagcccttaaaactcaagggaaacctaccctgcacactcaccccactgcaatcagtatacaacaatctgcgcccaagtgaagctcattgatgtaaaaggctccagtccctcagtgttccctgggactgtgctgagcacttgaccatagattccttaatcccctcatttcacaaatgtataaaccaagactcagagaggttaaggaacctgcagaaggtcacacagcaagtgagtggcagagccggatcccaagaccccagagccaggattcatagacaacatggaacacagatgggcttagcagcactgtgaataacagcccaaatccaggtacaacccaagcacccagcaacagtaaaatgcacattttcccatattcacacagtgcaacaaacacacagcaatacaaaggaacacactgctgatacacacacaacacggatggatctcaccaactaaatgtagagccaaagaagccagacacaaggaccacaggatgcatggggcgattcaacagaaatgacactcagaaacaggcaaaactcatccaccgtggaagacgtcagaacagtgattgcctttggtaggggtacaggggtatcagctagaaggaagcctgaagaaaattaccggtgaggaggaagtgctcaatttgttgatgtgggtgctggttacacaggtgtacacacttgtaaaactgtatcacgcaataccataagatctgagcccttcactgtatgtaagttaagcctcaattaaaaggggcaagaggccgggcgtggtggctcactcctgtaatcccagcactttgggaggctgaggcacttgaggtcaggagtttgagaccagcctggccaacatggtgaaaccctgtctctaccaaaaatacaaaaatcagccagacatggtggtgcatgcctgtaatcccagctactcaggaggctgaggcagaagagcggcttgaacccaggaggtggatctcagctcagtgcagtgagctgagatcgcgccacagcactccagcctgggcgacagagcaagactctgtccctaaaaaataataaataaaaattaaaaaaataaaataaaagggggcagatcctcccaagttatggaggcagcaaggaccctcactcgggcagctctccccacaggatgcgatgaattcgtgcagccctgcaggaagacaccccaaagccaagccagcagaaacaagagtcccctaaccagcctcacaattctaaactcagggtcagatagacacaattctgggcaacttctcggtctcagtcttccatggcaaaaagtgacaggaagggcccccacagcaggggagatgaggcccagcagggaaccatgcgccatggcctcccctctctcgtggggagcaggaaggagccggccgacgtttattacccgccagcggcaagattgactgcagccctcctctgcccacactgcgccattagctcgtaatggccccgaaggctccctcggccacagacccaggccggagtgagtgctccggctccgacaccaaagatactaatgactaccacattgccgaaataaatcaccgtcgctcaggaggggctccggcccggccggcggcctccaaacttcatttcacgaatttccccttaacactcagctgccttactgagggggttctcgggtggatgcatcatcggagaatttctctgatatgatgtttataaagaaggagaaaaaagaaaaaatggggactattaatctctgcaactccacaggagtccacattggtgggaatttggaggttggaacaaaatccttgtctgagactggacaaggcattcaaggattcggaagggcccatgtgctgacgacggactaaaagggtctcctagagaacccggctccctctaggtagatgctccaaattggggacaatgtggcatggtggtgaggcacacgggttccacagccataccacgcgggttcccatcctggctctgacatccgctggctgtgtcaccttgggcaggtcacttcacctctgtattcctcaatttccccatctacaaatggagagaataggggtatccctttggggctgatgggagaattaagtgtttagaacagggcctggcatataagtgctatacactcatttgggatcaatattactgttgttattatcgtgttaaaactctgaaacttcccacaggaacggaacctggttaacattgtgaaatgctccttactccaattcagccctggtattgttgaagtgtggatcccagaaggggagtgacttgttcaaggtcacaaggcacatggtggggacaggctggagtccaggctgtggctcgttcacataaaaggcagccctctctgtaaacatgcaacgtcaatgacacaggggtctgcgctgcacagcaagtgagccagggagagctgcaagcttctctctgggctcagtcagcctgtggtccccccttggctttgggacctgcaggcggtgctcaggaacacagccgcagctggagagcatcctccctgcctgtcttcctagaggaagcaggagccagggcggaggaaacagatgggcagcctcaggcaggggcttgttcctcaagaccctgagtcctcctcttctccctccttgacacacaaccttcatgtctctaggtgatctggagtctttcctataaacctcagctttggctgtggagacttgttccagctctgacttaactctggtcccagcactgggtcttgcatacagttggtgctcaattattgtttgggtgtcattacatctctgagccataaagctatgccagcctaggctccccggcttcctgtcctggaccagagatgctctgttctgaatctgactccctggaagccccgaaataacagagaggggctagagtccagttcatcactgcctccgccaggaaggcctcctgacttcttcagcactccctgatggctgttctgacaaccagtcctccccaagctgctcatggcctaattgcccacaccctcagttttgctgccagcccctggaaggcagggtgtgaggaggccctcctcatcttttctgcactcgaagagtttcaccgtagaagatgtccacagccttgacagcccaggctgagggtgggggtgaaggtcaggaggggctgcacagaaccaggtcagctggcaggtcatgaaggtgtccatagaccagggcacactcagcgagtttcgggtggggggcagtttcagcagattcctccaggtagcctaatgtgggagcagaagtgtaaaacccggcagccccatccaagtgccttctgcccaggaaaacaagtgcctgggctccagccgcaggcccagggcacaggctgggtgtggaccaaattccttctcagcagccatgcgtttccagcatgcaggaattgctcctgccgattcaaaaccaggtcagagaaaaccggctcttgtttccggcaggggtgagtgttcctcccagggaagggctccgcaaaagtctccaaaccgagcacaagagacaagtgggaaccaagcctcattccctcggtggccccgcggctgccaaaattactgacaaactgacctacaaagagagtttctattttgtgagcaaaccccaaaggttaacagcggagctgccggcgggcgatcagcaccgaggagcggaagcttccccagcagcgcccgcgtggagccctggcacctcggtttcgcagagaaacgtgtccctgaaatgccaaggagaaagggaggatgggaggaggaggttccgaaacactggtgcgagaaaagggtctggatgggaggataccagcccatcaccaagcagcctctctgtcccaaagttctggatcactgtcactatctggggcctgctgcagtgatctctggcagggccgccagggaccacaatgtaaatggtgtcccctagagttgtgcagtagacaacctgcacaaccatatcctgcaggcctgtgtcctgtggggttcctgtcactcaaagaatcttgcctccacacagcactggcttcaaggacgtgtaatacatgcagtcacacaggttcctgaatttagaaaagcccagcatatggttttataccctactgtcactgtctagattttttttttcttcagacgaagtctcactcttgtccccccggctggagtgcagtggtgtgatctcagcttgctgcgacctccgcctcccgggttcaagtgattctcctgcctcagcctccagagtagctgggattacaggcgcccgccaccacgcccagctaatttttgtgtttttagtagagacgcggtttcaccatgttggccaggctggtctcgaactcctgatctcaggtgatccgcccacctcggcctcccaaagtcctgggattatgggtgtaagccaccatgcccggcctagaaattcttaataattttctgacatacagcccacattttcatttggcatcaggtcccacaaattattcagctgatctttcctccatgtctgagagcaccagagccatgcctgaataatttataccaaaagtaagaaaatagcctccctccttcctcatcctccaagcagtccccttgtggcttgccaggagcaggggtagggcttggagagccctggggacaggcaagggcacaaggatgccagaaatctccaaagccaagccctgatacagggagaagcttttgatagcaggaacccatttgagacgaaaggcccttgggtgttctcgtacgataccggtgtctgagctgcaagaacagcccctggttgtggcagtggatgagcaacagaaagcaggccagataatatgcacaagcaggcggcaaacagggtcaccatcagcaccccgctggcgggcacccgggcccctcaccactgtctctcaacccaggcctctcaaagcacccacggccactgacatttcatcacatctgaccagccacctgtgagagagtgccctcaccattggggtcacagagggctgaagactggccacagccaccctccaggacaggcctgacccacacctcccctagccctggtagtggcacagtggtccaggacagagctttccagtgaaaacttcaaaggacagaacagagcaaggcgtcacccaaccccatctagttggcccacgggcacctgccttgaacacgctgccacactgcagtttgagaaccagtgatctagtggcctcgtttctagtctccatcaatattaaatagttgcatcacctcagcagggttcctaaacctcactctatttctgtatccataaaaggggcatcctgggtttgtgcaagagctcagcttttttgagggatgcacaatcacggtcagtgcaatccctgctccctctgcccctgtcccaacttccagtctggccatctggtcatgcaacctgagatccttctcccatcctcaaggctcagaattttgcattgctctgcccctgtgtctgaccaccaaacaccaagaagcctgctgcatccaccccattcctgggctgccacgaccactgtccctactggtgtgatgaaagccggacactgtcccctccagaacccagactgtccacatcaccagatcctgggagggcagaatcagaatgcaaaggaacagttgaaagaaaaataaatcacaccccagaggaaagggggaaatgtattaccactttcaacttttgcctcggatgctgcctggcttaatgtattggcttccatgcccataacagcccactcttctcctcttgccaagggtattgagggttctagaaatagtcccggccctgggtctgggccactgggtcccaaagtcccagctcccaggttcccaccgagctccaggtctcaccaccagcagatgtagtatcgaccagaatttcccagacttccctggagatacaaatcctgggggtggaggatgcttgttggctacccagatttccaggcctcctcacacccaagttccatctcttctctcgttcattaaatacttattgaatgagatggaacttgggcgggtttgcatccatcccagcctctggccagctgtgcaacctcgggaaagtgtctgtccctctcaaagcctcagcttcctgaaaagtaaaatggaccacttagtcgtgaagcttccagctttttcttggcttcaacagagcagcaagccccttctagacactgctccaaacaaagagagaactccaactcagccttctaaaagagaaccaagcccatcccacctccttccattccccagaacagaccctcaggcccccttctgagcgacagcagacactccctcgggagaattaaaatactatttttcaataaatgaagccccggccctgcaccagccctggaagactgtgagctgggcgaggtggcttcctgcatgtgcctcacttattaagacattgccactctgaagagtggagtcattcccaaggcccccgttgtcactggcaggcagcggttgactgacaagtgtcagttgcagcttgctgagcagcagaggccaatagactgtgaaacaaggagcagatgtgctaatgacaaaactttccaaactgaaaacacaaggagcagattcccgggaaaggtgtttccccaacctctacctggtgatgggacgaatgagaaaaacactagccaaacacagagctcaaagtcatcaagacttcgtaatgagaatgcaacaggggctgagcagaaagagggaagggccgctgtcacagccgcgtgcacctgcagccagcgccattgtcatagcagctctgaggatgtaacaagaagcaagcaactgtcatcaaactgtaaacagagtgaaagctgcagaaggacatgtaggagtcactttcctatgggaaagtcccatcctttggagttagagcaaaataaagtcctctcttagacgctctcctgtgcagtaagaagaaacatctgtaatgcccaccgacagcagaaggggcctggcatgagggtatgtgactgggaagacacacgctggacctagagaagccagcttaagagcgaggaaatggtgtcatgccaagcccatggttagaattcagtaacacttgctgaggagtggagggacagaaagagtagaaaatagggtaaccagcaaagttgatatgcagaatgtttcaacaactggtgcaccagggtccccaccaacctgaattatcccagggggtgatgtggtagccctgatggactgggggttatcccctcaagtgctggggatgcccagggggctcaggtcccagagggagaacctgtggataggggtctcagggcagaaactatttgctaggtggttaggaagcacatgaatgttttatcaaacagtacagtggtactggtgcataccagctaaggtgtcctgacacaggtgccttggtgaacagtgatcacaggggccctgggatgggtgagaacacagcgaggaacattctaactatcttttcacttatatgttcctttaactgactgagtaatgctcctgccatctctgaaacaaggcctcccaagtctccgagcagagaagtggggaccatgcaagccgtgtgaaggccattggaaccagagcagagcccaccgggtgggggtctgcagggagaggaggtcaccaggagaaagaaatgagctgccccaggagcaggagacagagccagatgtctgaacccagattctgatcctgatgctgcagaaagaagccccaaaatgttttatggtgaaacgttaaatgttttggatttttttttttttttttgtaaaacagatcttgacagttgagagagtcagagtccttcattcacacaggtgactactgagttgttgttttgtttttcctttaaggaagcaggccttatgataaacccttcatgaaaaccccactcaggatagcattttttgtggtccttgcatagtgaaaggtgccttttgtggctcactgcagccctgcataacaggccacagaattcagagttcataaacataagaagattaactaagcccagcatggactgaggacctcaacttcagcatcttttaaggattcatgttatcagtagaaatgactacctttttcccaaagctatgggttctttactgtgtatgttgatgtttgatgggaatctaatcctaagccagattctgggggcagatcaccaaaactgaagaagctgggtttgtgtcacagagcttcttgatttcaatcagcccctgcagctttaaaagagcagcccacggaatcctcttcccaaagtgaaagggctggataatggggttgttttagtcatatgaaagtaaggatcattctgtatcttaataggcccataattaattcacacattcaactgttaagtccagaaatatgttcatgttgacaatttgcatttgatgcttcaaaaacaatctggcatgtttttatttgcctcgaaatctcaggaacatccacccctttccattatccatccaaatgctacaattccacaacagcttcctaaggccccacctgtgggaatgcggggagggggctcaagatgcccagtcaggagaagtggtgttagtgcgagagctgtcctcctttgaaggacaagaccaccatatggccagtggaatttccgtctgcccctcccaactcccatgacaacttttagccctaggcatcaatgactggagatcattctaccaccccatatcttcaacactggatcagtgattttcccctcaacccccaagcaccagttatgccccacctttgcccagctcctggtctacactatgagtgcacccatctgatatgtcaggtgggaccccaccccagcctgtctacctcatcagctcctaggaggataaaaccagagtgagaaggaccatcggagggaagaatataaaaagcaatgctggcacaggaacaagggatcgttagtatcaacgtttactgctaggcttgatttacaactgccaccaacaggcgagtcagaagaggaggggagggggaaggaggaggggcctgagctcaagccctcaaactcttagctccaatttccacaccctgagtcctacaagctagcacagaagttgctgtggaataaaacaatgtttatggaggttctcagttgcctgtgctgcttccagatcactcccacagatgtactattccctattcctctgtcgaagtacaactaaaaccctgaacattatatatgaaagaaacagaagaagattcagaaaggcagagagaagaagccagaccagccagggacccaaggagtgacaaagcggtgaggatcctgggttttctttttgcttcatatatcccagactaggacctgacaaaactggcaacccagaaacaccaacaaggattttgctttaagccttaaccaaaccccactctttctagccaaaggaccaggaaagatttttgcctggcaaaacagaaaacgtttagacaataacagctctgctccaggcaaaccccacagaagaaaactatgaccccaccaccatccactccagcaaaggctgaatggagatctgagactgccgtgctggcaaggcttatataatgaggcactcaccgcccgctcttcccatccctgttaatgtggcatcagagaaaccctagcagggagccaagacagtcatacttgctgggcagtaacaaggcctttccccatggtgtcagtagagaccacatggggagcctggactcccctcctacctaacagtaacaagtgccctaacccatcctcctggtatagtggagaccatgtggagagcagaaatgatgcattcctaccacgactgctcagagaggtatgagtggagacctagggaggaaacgagcctggaattctacccacacctggcagtagcaagatggcatctgcaccccttctgcactggagtggggtcaaaggaagccagctaaaacagagggtttaaataagatccacagtgtcattatgtaatacataaagatttcaatcaaaaatcatctatcctaccaagaaacaagatctcaaattcaatggcaaaaaagtcaatcaatatatgccaaaatcaaaatgacagagatgttggaattatctaatggggagtttaaaggaggcatcatagaattacgtcaataaacaattatgatcatccttgaaacaagtggaaaaaaaaagaagtccagcaaagacctagatagttttgacaaagaaataggagatacaaggaggcactaaatggaaattttagaaatggataaaggagaaaatcttaaaacccaatgaataggcctaacagcagaagagagaagagaaaaaaagaatcagtgaaataggagatagaataataaaaatcacccagagtttcaggggccagtgggactataacatttttgtgattcaagtcccagaaggagataaaaaaaaaagagggcaggattgaaaatgtactcaaaagagtgatggctgaaaaattcccaaatttggcaagagatgtagatgtattcgagaagctgagtgaaactcaaaaggaataaacacaaggaaatccacaccaagacaaatcatattccaactcctgaaaactccaggacaggaaaaaatcttgaaagcagctggagaaaaaatgacaccttatacacagtgaaaaaataattcaaatgacagcagatttctcattagaaaccatggaggcaagaaggaagtggcagagcatttttcaactgctgaataaaaaagaactgtcaatccagagttcttctacatccagtgaaaatgaccttcaagaatcaagggaaaattgagatactctcagataaaagaaaactaagagaatgcgtcaccagcagaatcaccctaaaaagaatggttaaaggaagttttctaaacagagaggaaatgattggaacattaggtagtaagaaagaacatggtaaggaaattttactgtagataccactaattccccttctcttcttgagttttctaaattatgtttgatgtctaatgtaaaatgttaacactgtctgatgtagtactaaatatatgcagaagaaatagttaagacagtcataagtagggaagagtaaagggacctacgggaggtaacttttctacatttcacttgaactggtaagattatgacaccagtagtctttgataagttatgtgtatataatataatacctacagtaatcatgataaaaagctgtatcaagaaatgaaaacactacagataaaccaaaataaaattcttaaaaatgttcaagtaagtcacagaaaggaaaaaagtaaaccacaaatgaaaaacagaaaataaaatataaaatggcagactgaagctctcacatatcattaacaacattaaatataaataacctaactatactaattaaaagatgaagattggcagactggaaggaaaatgactcacctatgtgctgtctacaaaaaactcacttaaaatataacaatactggcaggttgaaagtaaaagaatgtaaaaggatatatcttgcaaacattcattgaaagaaagcaaaaaggctatattaatattatataatgaaggcttcagaacaaaaaattagcaagaaagaaaagaacattaaacaatgataaaggggtcaatctaccaagaaaatcttaaatatgtatgcaccaaacaacagagctgcaaaatatgctaagcaaaagctaatagagctgacagaagaaatagacatatccacaattatagtaggaaacttcagaacctttctctcaatgactgataggacaactacgcagaaaatcagaaaagatacagaagaactcaaaatcattgaccaacaggatctaatagacatttatacaacactccacccaacaataacagaatgcacattttttcaaatgcgtagagaacaaataccaagacagaccatatcatgggtcataaaacaaatgtcaacatatttaaaataactgaaatcatacatagtgttttttcctatcacaatggaaccaaactagaaattaatagcagaaaggcaggaaagcctccaaacaatagaaactatacgacgtacctctaaataatcatggatcaaagaggaagctcatgggaattttttaatacactgaactgaacaaaaaaataaactacaacatgtcaaaattcgtgggacacagctaagtaaaggctaagagggaaatgtatagcaataaatgcttaataaagagaaaaagtctcaaatcattaattaagcttccacctcaaagacctagaaaaagatgaagataaacatagaacaagcagaatgcagaaaataataaggaaaagatcagaaaccctgaaacagaaaacagtaaaacaaaattgaaaatcaattaaacaaacaggtggtgttttaaaagattgataaaattgacaattcttttaagaaaactaacaaaaaaagagagaagacacagattaccaatatcaagaatgaaactgaggatatcactacagacactacagacatcaaaagaataataagggaataatactatgaaaaactctacatacataaatttgataaattagatgaaatgatctgatttctcaaaaaatacaaactaccagaatacacataataagaaatagatattttgaatagtcctattctattaaggaaatggaattcataatttaaaactccctgtaaagaaatccccagacccaggtgttttactggataaatctaacaaatgtttaaagaagaatcaacaccaattctacataacttcttttggaaaacagaagaggaaagggcacttcccagtttatttcagtaaattaatattgccctatattaaaacccggtcaaagacaggacaagaataaaacttcagaccaatatccctcataaacacagatacaaaaatccctgacgaagtattagcaaatagcagttagcaatatataaaaagaagtatacaccatgaccaaatgagatatatatatatcaaggatgcaaggcttactcaatatttgaaaactggtcaatataatccaccatattaacatacttaagaaaaagtgcatggtctcacaataggtacagtaaaaaaaaaaaaaaaagacaaaaacttcaggcatttgacaaaatccaacacccattcatggtaaaaaacaaacaaacaaacaaacaaaaaatgcttagatagaaggagaattcctcaacttgataaggagtatctacaaagaaaacctatagctgttattttacttaatcgtagaagactgaatgttgtctcccttaagatcagaaataaggcaaacatacccactctcacactactgttactcagcatagtgccagtaggtctagccagggcaataaggcaagaaaaggaaataaaaggcatacagatagttaagaaataaataaaactgtcccaatttacagatggcatgattgtctatgctgaaaatcccatagaatctacagaaaaattcctacaactaagttgagcaaagtcaagcaatacaaaaatgaacattcaaaaaccaactgtatttctatatactagcaataaacacatgaacactgaaattaaaaatgcaataccatttataattgctcaaaaaattaaaataattagatacatctaacaaaacctgtaccaaattaggatgttgaaaactttaaaaaaaaaaaaaaagatgaaagaaatcacaggtctaaataaatggagaaacataccatgttaatggattagaagactcaagacagtaaagatgtcatttctccccaaatcaatatacacatttaacatgattccagtcaaaattacagcaagaattttggtagatacagacaagattattctaagatatatatggaaaggcaaaaagagctagatagcaacaattttgaaaaagacaatcaataaagaaggaatcagtttattcaattccaaaacttattctatagctatagtaatcaagactatattgtatttggcagagggataggcacatacatcagtggaacccagaaacagacccacagaaatatgctcaactgatatttaacaaaggtgcaaaaacaattcaatggagaggctggacaatgtggctcatgcctgtaatcccagtgctttggaaagctgaagcaagaagattgcttgaagccaggagttcaacaccagatgggcaacatagtgagatccttctccacaaaaatttaaaaattagccagatgtggtggcctatgcctgtagtcctagctattttgttaggggggaagttggtgctgaggcaggaggattgcttgagcccaagagttcaaggcttcagtgagctatgatcatgctacaaacactccagcctggtcgacagagctagatcttgtctctaaaaacaaacaaagcaattcaatagaagaatgatagccttttcatcaaatgatacaggatcaactggacattcataggcaaaaataaaaacaaaaacaaaaaacttcaacctaagtcttatattgtatataaaaactaactcaaaatggaccatggcctaaaataaaactataaaactttcaggaaaaaaaaaataggagaaaatctttgcaccaaaggtataatccataaaggaaaaattgacaaatctaattaaacaaaattaaaaacttttattctgcaaaagctcctcttaagataaaatgacaagctccagactgggaaaaatatttgctgaccacatacctaacaaaggactagtacttagaatacataaagaactctcaaaactaaatggtaaaaaagcaaatgatccaattagacaatgggcaaaatttatgaaggaacatttcatcaaagaggaatggctggcaaataagcccatgaaaagatgttcaacatcattagccattaaggaaatgcaaattaaaagcacaatgagatatcacaatgcaactatcagattggctaaactaaacaaatagtgacagaacaaatgctggtgagaacgtagagaaatgtgatctttcctacattgctggtaggaatgtaaaatggcacagccactgtggaaaacagtctggcaatttcttaaaaagtcaaacatgcaagtactacagacctagcaattgcactcttgggaatttacccccaaaataacgaaaacttaaatataattccatttatataacagtcttgaaatgataaaattatagaaacagagaagagagtagtggtttccaaggattatgggtaggagggaagtgtctatggctataaaagggcaacgggagggattcttgtggcaatggaaatgttttgtagcttgactgtatcaatgtcaatatcctggatgtgatattgtactctagttttgcaagatgttactgttgggagaaactgggtaaagtgtacagaggacctctatgtgaatctgcatgtgaatatacaattatctcaaaataagaactttattgtctttaagctaaaaatgtttaaaggacaaataaaagcccaggaggggctttaaaagaagggggaatggatagggagcagtggctcacaacagtaatcccagcactttgggaggctctggcgggtgtatcacctgaggtcaggagttcaaggccagcctggccaacatggtgaaaccccatctctactaataaaacaaaaactggccaggtgtggtgacgcttgcctgtaatctcagttactcaggaggctgaggcaggagaatcacttgaacctgggaggcagaggttgcagtgaggcgagatcgtgccattgcactccagcctgggcaacaagaaagaaactccatctcacacacacacacacacacacacacacacacacacggggcaggggggtaatgagcaccagcattcttcccaggctaactggcttgaggcgtggagagggtgcagggttgccaggtaaaatacaggacggcaggcaaatgcaaatttcggacaagaaataatgttttagtagagtatgtcccatgcaaatgaatggagacatacttcgactaaaaatgtattggctgtttatttgtaattcaaacttacttagcctgtatttttagtgggtaaatctggacacctagaggggaaggatgggacaggagggttctggagcccccagggacagtgggctgaaaaaggcagggtggaaacagggagaagtaaaagagaatgagcaaagggatgccagaggaccagaaaggcacgcaggctaggcagtcccatggtgggggcagagggcagtcacaagctgggaggcctgaagtcccccagctgctggtgaaacaaccctgtgtggggcaatcaggcagaaaccagaggtctaaagagcagatgctggagtctcggtaacagggggcctggcagcctgaccaaggggctcctctaggcaccaggagcatcacccagttaagcccaggccaacccctgggcctctgtcgccatgacctggctccacccaaatggtctcgcctccctacagggaaaggacgtgctgagcagtgggttcaagtgttcaggtcggtgggcagccacgtgcttgaccaaaacaaaaaatgctttgatgagactttgctatcagcctgcaagtcagttccagggaggccgctgcatacgtttcattttcaccttgctcccacacacacccaggacccgcccttctcttctgtgtggtacccatcactattggacacaatcaggagctcttacttgttctcttagtgaacacctgtctgctcccaccagacactatgctctgggacaaaatggcaaagactgttctgcttgctgcaatattcatgcttactgcctggcacacagtaggtattcaagaaagaaaaataacttggaactgggggacattatgttaagtggaataagtcaggcacagaaagacaaatgtcccatgttctcactcatttgtaggagctaaaatttaaaacaactgaactcatggagatagagtgcagagtgatggtcagcagatgctaggaagggtagcagggagggaggggaagtggggatggttagtgggtacaaaaatatagttcgacagaatcagtaagatctagtatttgatagcacaacagggtgactacagtcaacaatcatttattgtacattttaaaataactaaaagagtataattggattgtttgtagcacaaagaaagaataaatgcttcaggtgatagataccccattttccctgatgtgattattatatattgcatgcctgtatcgaaagatctcatgtactccataaatatatacacctattatgtacccataaaaattaaaaattaaaaaaagaaaactgaatgaatgaaggaataaatgaaaaatcggcttgattggagctactccttctgggtctgtcctccaggcccagccccttggagtcttgacaaggcagagagagggggccattcttcttgcagaaagccctcaggagcatcctctgagctgataagcactgacatctggtatataggcttagcatggccggtttttcctctctaaactgggactctatcatcatcatcatctaataacactaatacaatattgatagatagaatttattcagaacttaacatgtgccaggcagtgtgctgggaccttttcatacattttaatttatttaatcctccaaacagtgccaaccagtaggtgtggtgagttgcactgtttgtgctgccccttcttgtggaaataaaagccctctttcttttcaataatacccttcctacttccactgctggggggcagacacccaggaagggcaggggtcaccagcctgaccagataaccagctccacctccctggccataacgattggctcatgggcagcttcaggacgctcctgaggccagtggaagaggccttccactttctccccgctgggccccaaggatccaaggccaggtctgaggctctgaagcccactgggtgctcaggacagaggggaccaagctctggggccactggccacaggacccttgttgtctgctgttattccagtaaggctcagccagaagcaggtatgagggaaattgcccatgcatcagctgctgccaagcagccaaatgacatcaaaggatgctcaacaaagtcagttcaacaatccaggccaccaagcccatgtgacatgacagcaagaagagaagaacatgcttatgagccggctcaagcaagatgatgccagggctccagtgccagcccctccaggaccagctccatcagcatctccctcacttccatccttcctcttcccctccctgctggatctctctcccgaacctagaaacacactttggtctctctctcttaaaaatgcaaatacttcctgttacctttggagccttccagctcccacttctctccctcctctcccagcctggaacccggaaagtccactgacactgctgcccacccccatctcctcctgaccccttccatctgatgccactgaccctgctcacacccaggacacaatggccacttgttgctgagccacacagaccctcttcagcctccctcccagtgcacttttcacactgcacccaattgatattcctggaaacactgctccttcagcaccaaccaccctacactcctcactctccaggctcctcccagatgttctcaccatctatgctgatgccgctggatcctcttccccagacagggccctgctggccctcagatctccatgggtatcttgtgcaaggccacattatcacaaacactcaagcccaccaaacgtgatgagccttcaggtgcaggggttaagggcgcaggccccgagtcacactggctgagttcaggtccctaccctgaaactagcaacattggacatgacacctcaactccccatggataaaaggaagtaatgacagcacgtctcacagggtgttgtgagggtgaagtgtgataacacctgcagatatggaaagaagggcctggtgctgagtaagcttcattagatggtactgactgatacggtttagctctgtgtccccacccaaatttcatctcgaattgtaatccccatgtgtggagggagagacctgtaatccccacgtgtcgagagaggaaggtgattggatcatggaggtggtttccccaatgctgttctcatgaatgagttctcacaagatctgatggtttcataaggtgctcttccccctttgctttcttctctctctctcctgccgccatgtaagacgtgcttgcttccccttccactatgattgtaagtttcctgaggcctccccagccctgcagaactgtgagtcaattaaacctttttcttttataaatcacccagtcttgggtagatccttacaacagtgtgagaatggactgctacatgaaccactgctagcatcattgtcttctctgccagtccctaagagctcttcctctggcatggtatcatctgccacctgtcacccaaaacctggtcacctgagacctttgagtcttcctaacttctccccctcccatgtccactcaataagcaaatcctgctggttatgtctcttaaatgtttctccagcccatatcctcctatccaacatcctcaccttctctcacctactctacctcatcccctttgctgtgatccacccacctcctgcctcaaagtttgttctgttgcagtactgaattgtgtacagtgtccctacatactacatggacctcttttctctataattggcttgtactagtttctttgcctggaattcccctcccaccttacttcttatactctgagaccctgattaggtgtaacctcttccaggaagttttcctggaatacccagattgggcaacatgcctgtcctctgagctcccttatcttagacttgtgacgttacattgaccttgcaggttatcatctcctgagctgggttagcggcccctcacagagcccaccgaggattttaatagtgtttactgaacatgaaggtatgaggttactactagaagaaacctcaatgacagaggccttcccccaaaacaaacaaacaaacacatacgcatacaaaaggaactcaagaaaatgagaaattttccactattttaaaattcagaactgatggattctccatagacctaaacagcttcctcgaatgaaccaacgggattcaaagtcagggaaaccaagtcctttgggctggttctctcagccaggaagactgttgagggggaagtgactatgccctagtttgggggtttggcaacgaaaaaaaaaagaataaaaaagaattggattatagtcttgctgtacaggcttgttattctgacagaacagttccagaacctgaaacatgatctctggagggagagggagacatttttatcacatattaaggttagacagatgttttgggtctggtgttacctgaatcaaaagcaccattgaagagcctgacacagcccggttcagcaacacgtgatcctggcagaaaggagacaggaacccctttttcttttcatgttcatgagattttcctctgtggttctatttgggttttttgtatctccctggagctggggcgagacactgacttccactccagactgtcctccttggaccagagactccttcccctccaaaatgctgcaggctgggccttcagcacggggccagggtccaaatggcagcttgaacagtgggccctggctctgcaaggtggtttgaaagtatctccagggatgtgcttcataaagacttgtaaggtagaaaaaccctctctctgtctgtctccctctttccctctctctcttctacacacacacacacacacacacacacacaccacacacacacaacacacacatacacacacatacacatacacacacagacacacacatacacatacacacacagacacatacacacacagacacaaaacacatgcctccctccaggttggccagggccagtcctgccacagtgacaggggagggctggggacaagaggacacacaaggacagaagctggcactggggacactttaagagcctgggcaggaggcaggaggggttgattttccaaacacccacttcctcccccatgtatttgcccctgacagcagagcccagcccttgaaggcacccagggaaagggccggcgtgagcatgaaaagcaggcctccggaatgactaatgccccaccgggacaggcctggctctggcctggctgcccgccagagagtccacagccactttccaaggacagcaagggcaagcgttcctgacaagattccctgaggaccatcccttcccagccctgaccctccccggggctcccccaaggggcccgtgaggccctgcgtgaggacgtccaggggcccagaggctgagtcactcccttggggccaacctgggtcatggcaagtttgttatctcaaggacaagttctcagaccccttatccagccatccccacccaaaacaaactaaaagtaaggcctctccagcaaatcggcttcctgggggtctccagactcaggccctgccccccagggtgaggtgccatgtgccccaggagggcagtgtacatacattatacatatatgttcaacacatgtgggcagacccactgctcctcccttcccagccgtgggggaccagcttcctctgggccaagccccccataagcctccctctctctccttcagcagcccccccggggagcccaaggcaggggcctcctgcagagcaatttcctggggcggcagaggtgggagtcatcctcccagagtcctcggagggggtgaaggggaggtggggaaagggcgactgggcagagctgggtcaacccggcaggaggccacagcacagagctctgggctgctccaagtttttcatgtgccttctgggggaggaagtgtcaaagccatttcaaaagctgggggagtcccagggaaggggcctcattctccatgcggaggggggatttcaaaggagaccctgctattgaaaggtttccaaagaccctcgcctttctatcagatccaaatcactcccctccaagcagcagccaggagaggggtgctgggaaaatgtttccaaggagacatgtccctgagtcatcataactcccagggtctccgggctgcagagccatgcagaggcccccgctataaaaaggccggtttaccgccccgcaggggagctctccagcagtccgggtcccaggggaggcctgcctcagacccccaagtgccctgagtttatgagaaggctgcagagctgaacagggccacttctacccaccaagtccccctggtgccactaagggggacttttacccccgtcagcggcagggcagccactctgggctcagaccatttagcaggagaagccatccactgggacactgggccccaaaagatttactgggattgcagagccagccccaaaccaggcctgcagtgtctgcctctcaccatttccccagcagccttcccaagccaccagggccagccagaatcacagcacaagccacatctaagttccatcaactcctcttctccccctgccctgttcactcaccccaggaccacaccaggtgggtcttcgttctcttcccaactggttccttctcaacaccgcagccagattcttcttcctaaggctcaggccaggatataccctgctctgaaaccttcaatggctccctagcgcttaagtccaaggtttaaactcaggtacccacagggaccaggctggagacttaactgagcaagaccatgatgcctgggaatgcatgccttgcctacatacaggaaactgctgctgctgctaagtcacgccaggtgggaatgatgattgcgggaatgtgaagcccttgctgccacctcttgtggtttttcaagagaagcctagtaaaccatagccaaggggcccccaaagttggaccctggcctacggggtgaaggacaaaccctaacccctccacttggtatcggaggtgctccatggctcaccccaaccccctccccattctcactccccacaatgcctcagtcttggccaagccaagcacctacagccccccagactcacctgctctgctcaccccccatcctgctataggcagtggctcatcaccctcgcagcctggcagaaacccattgttccagagcctcctcctgatgttcagccatctctccgaaggcaacgtcccccctcttcatccttcaatgcccagggggccctgttctgggagcacccacatcactgcactgcagttacctgcatgcccatcagccttcccctggagagggaaccctgaggtctctcccaccacaggccctggcaggggctccaaacacaatggagggaccctagctgtggttcagactctgcctccattactcaggctggaaggacttgggtaactcacgtaacctctctaagccccgggttcctcatctgtcagatggggaactagtgcccatgtaaagtgcctggcacatagaaaggctgagtcagtagcagctgttagcatccttattcaatgtgacctctttgctgcatgctatgtgcagtgtcttctatgggatgatctctgaagcagagaccatgtcccctgtactcccgtcacccacagagaccgctgcaactctcaacatgccataggtgctcagtcaaggtcctctggtagactgggttgatgaggctcggggagggcaggcaggtagggagtgcaggttagagcgagagggactgcccagccaccggaggtctggctcacccggggttccatgccgcagtgaactggaatctgcactcggggaccaaccaaccactccctgctgcctgctctccaggcctccaactcccacgttcctgggctccaggtcagctgacagcgctgcagggcaggaatgggcaaggggacctgtccagccccccagccaaggcgccttccctcagaagcccggcccacagctcatacacaggcccaaatgcccctcacaccctccttttgtgtttcccacaactctagttaagagcaacccccttgccttgcacttgaggacacatagcttccaggctctgcactaaaggcaaggtagaagagaggagggagggggcagaaacacctcagaaatcactgcagtccaattagccaggcttgcgcccttcatgcttacaaacaggaacgcgcattaacatctgctacaaaagcaaacatttttagatatcttcatcttcacctccctgacactccgtgaaaggactctcagcagccagtgactgacaggggagtgccccttcttatccttcagcagggggctttcagacggagaaattaagaagccaccaatctccctgtcaggccaagctcccacagcccccacctgctcttcctgggcccctcctccccactctccgccaggtgagccccaccacacacacgattgggagtcagtggctgcaggagactggctccaaggcactgggggtagaggctgtcagataggttgggggtcagggggactggccaatgctgtggctaggtagggaccaggggacccatacctgccctgagagcaccttcactaaagaagggcctttgcaatgcaaaccttaaacaaaaccttgatggctgtacaaatttggagcaaactccaactctcatacaccactggtgggggcgttaagtccatacaaccacttcagaaatgtatttgtcagcatttactaaaggtgaacatcatttaacctgtgactcagcaagtccatccaaatcctatattcccattttatatacatatttacacatataaagaatatagtatataacagtatataatgtattatatataaacgcaaaatataatatctatatattcctataatcacaataaaatcacatacatatgttcatcagtagatatgtacatggggccaggtatggtgactcatgcctgtaatcccagaaattcgggaggctgagatgggcagatcacttgaggtcaggagtttgagaccagcctggccaacatagtgaaaccctgtctctactaaaagtacaaaaaaattagccaggggagatgctgcatgcctgtagtaccagctgcctgggaggctgaggcaggagaatcacttgaacctgcgaggcggaggttgcagtgggcagagatcgtgccactgcactccagcctgggtgacagagtgagactctgtctcaaaaaaaaccaaaccaaaccaaaacaaaagaagacatgtccatgaatatgccagcactatttcagaatgggcccatcaagaatcaaacagataaagagtggttggcatgctcctgtgacagattattatacaccaatgagaggcatgatctctaactagaggcaataatgtgaaaagtgaaagatgtcaggtgcaaacgagtagaaactgtgattccatttccataaactagaaatcaggcaaaaccaacctatattattagacatcagcatcgtgatgacctgttggtggtaagggagggcctgaaggagcccaagagggaagcttctgaaatgctggaaatagtctgtttcttgatctgtgtgtgggttacacaagtgtgtttagttcatgaaaattcattaagcttctcacttatgagaagttttctaaatgtacgcagtaaagggttttgtaaaccagtactccgatggcatagctgttaagacaacaatgaaaagatgctagaagaagaaaaacagagatgaagtaaagaagtagttcaggccaggcgtggtggctcacgcctataatcccagcactttgggaggccaaggcgggtggatcacgaggtcaggagttcaagaccagcctgaccaagatggtgaaaaattagccaggcgcagtggcaggtgcctgtaatcccagctacttgggaggctgaggcaggaaaatcgcttgaacccgggtggcagaggttgcagtgagcaaagattgcaccactgcactccagcctgggtgacagagtgaggctctgtctaaaataaaaaattaacaaaaagatgaagttcaacccatggctgcaacttcactgctcagactagagtcttggagaaagtgatcacatgtccaacaaagacccagggtaccaggcttcttgaagctctcccaggccccagcccatcccaggccagccccttcccttagaacctccatgcctatcagaacatcagaacatccagctgtgccctctcctacaatgagggcacccctagctgccaaggagaccacatccacccatccaaggtagaggggacttcacagcttcccaggtctcttgtgccaagtgtgtgaactccatagaactttgcaagctgcccttctagagaggctgaattttccaaagtccaaaaccacttgaagaggaatgggaaaagtactgaaataactttgtaagcgttctgttttgacaatgtgcctgaggaattcaccatgttgagtagggaaatgtgagcagttaaatctattcaatgtcatgacacacaaaattgaagcataattgctcctgagtgcttgacaattggaaagcactttgtttcagaaacggagggaaatttatgctggaaaatggaagagattgtcaaaagtttgattataatgtgagtggagctgcgacaagaaggctcagatggagaaagggcccccattctgacattttcactcccatgtgcaatgtctcagaaacagcagcagtgactctgtcctttggcctaaaagccagtaaaatgatgattggaaccgcaaatttaaaaccccaaagagtagctccagcatggctgggaggaaatgctctcttaccaatcatgtggttggcaacgtggatttggatctctctctcgttctcgaaggtcatctggcacttgatgcactggtatgtctttttctgtttggaaaccaaaaataaaagatttagagaggcaggaggtaggaaaaaggagaaagcaaaagttcctagggggcctgggtcaagactttccagaatggttccagtcccctcctaggtctccccaggccattctcttcccaccttcctctaaatccagctctaccagactgaggaaggggcatgaagctacattccaagggagctgcttctctgctagatctgggaaaactgccatctcaaggtgaagctttaagggagctgaggggaggcctccttgcttagaagggcaaatccatctacccatgcccccatccatccaaacatccacccatccatcctccatctacccatccacccatctacatacacaatcacccatctacccattcatccatttacatacacacccatccatccactcattcatctatccatctaccatccatcctccatctacccatccatccatatacccatccatccacctacatacacacccaccaatagacccatccatccatcctccatctacccatccatccatatacccatccatccatctacatatacacccaccaatagacccatccatccatcctccatctacccatccatccatctacataatacccacccatcctccatctacccatccattcatctacatacacacccaccaatagacccatccatccatcctccatctacccatccatccatatacccatccatcctccatctacccatccatccatatacccatccatccatctacatatacacccaccaatagacccatccatccatcctccatctacccatccatccatctacataatacccacccatcctccatctacccatccattcatctacatacacacccacctatccacccatccatccatcctccatctacccatcaatccattttccatctacccatccatccatctactccacccatccatccatcctccatctacccatccatccatctacatacatacccacccatccatcctccatctacccatccatccatctacatacatacccacccatccatcctccatctacccatccatccatctacatacatacccacccatccatccatcctccatctacctatccatccatatactccacccatccatccatcctccatctacccatccatccatctacatatatacccacccatccatcctccatctacccattcatctgtctatatacatacccacccatccacccatcaatccatcctccatctacccatccatccatctattccacccatccatccatcctccatctacccatccatttatctatactcactcacccatccacccatactccatctacccgtccgtctccccacccatacatctacacacacacatacccatatacccattcatccatcctccatctacccatccatccatccatccatccatcttctatctacccgcccatccatctacataaacacccacccacccatccacccatctacatacattcccacccatctacccagtcatccatttacatacacacccatccatccacccattcatccatccatccaaccatccatcctccatctacccatccatccatatatccatccacccatctacatacacacccaccaatagacccatccatccatcctccatctacccatccatccatctactccacccatccatccatcctccatctacctatccatccatctacatacatacccacccatccatcttccatctacccatccattcatctatatacatacccacccatccacctatccatccaccctccatctacccatccatccatctactccaaccatccatccatcgtccatctacccatccatccatctacatacatacccacccatccacccatccatccatccttcatctacccacccatttatctacatactcacacacccatccacccatactccatctacccatccatctccctatccacacatctacacacacacatacccatctacccattcatccatcttccatctacccacgcatccatcctctatctacccacccatccatctacatacacatccacccatctacccattcatccacacacacatccacccatccacgcatacacccacccatccatccatctattcacccatcagtctatccatccatccacctacctattgtctgtctacccattcgtccatctacacacatatccatccatccatctatccatccatccatccatccatccatccatctatctatctatttttctacctatccaataaccttctcatccatttacttaccctaataaccatgtggctgagcaggggacactgttcctgccaactctggtgttcaagggtggctaaggaactcctcatctgccctaagcacaaatgaccccaagagttcctacagctggtttccacacacaggggctagtaccagctgcctgtgggagctgagggcagaaaaactgagatgagaagcttcaaagcttcttgaagagttgttccaaagagtgaacctcactcacacaactaatcccagatggttctgaaacaccccagggacagaggtggtgttgcccatctgagggaaggactgtggctgtggggttttttgaagaaagaggggtggtattggaatcacaatatccaagttttttgaagaccactttggttcctgggatgagagggcttctcttacttctggaaaagggagcaggacttcacacttcttggccaaggtcccaggcccaaccctcaactatgcagccagatgaaccaccaggtagcttaaccatctcagctcctacttccctctttatcattctgaaatgttatgatgagctcttgcatggtgcacacttttctttccttttacttttaacctacctgtgtctttatatttatagtccaggccctgtagatagctttcaattgagtcttgcttttttctttgcatctaatctgacaatctctaccttttgattgaaatttcaactccatttatacttagtgtaattgtcaatatggttgattttaaatcctaccatcttttgaattaatttctattttatcctacctgttctctgttcctatttccctctttccacccacacccacagttccctaagtaactacaggcctttgcctgtgctggttcctctatgtgcaacaccccctccatccttgactcaattcaaatgtcatctcttctgagaagacttctcttttcaccccagaatgggtccaggaccccctccacatccctgaacttatgctaaaggaccctgggtaattaatacattgttgtgtcagggtggattggttcatctgctcccctcttgcaccatgagcacccagagagccaggaatgtgttttgtctacctttgaggcagcacatgaagtgcttaacaagcatttgctgaacacataaagttgcagaataacatatgcagaggagtctattcaggcagaggtgacaaagagaaccaaagatgacttcagtgtcctggacccacaccaccctagcgcaggccttacctagagtcagtgcataataattatttaacttttattacgattattattggcgctaagaaaatgctgcttgaacaaatgaatgaatgaagaaacaactggagaagctgaagctggatgcgtcaggctccaggacctgctctgacaaaaccaggggcctttcccacagtgtttcagaagacctgggggattcgctgtgtcctgagtacaggccacagcctggggcccagacacaggcactctgcatggaaaggccctgggaagagctaggtaagtcgggggcagggtggagagaaagacagggctggggagtccagccttgccacagacaaaggaagacgtctaggccacaaggagactacagggcctgaggtcttctcaggagatgcagcccagagtacacatctcaggtcaactccagggccatggtcgtggagatgaaccacctcgggtgtctccagcatcaaaaccatcccttctgtctcacatgtgcccccacctactctgcttggcaaagtgcaagagcctttggtggttgaatgaatgaacgaatgaatggaatgagtgaattaatgaatgaagcacatcccaggaagggaagcttcatcacaaggaagcccatgggaggcctgctggatgaggaccgcccaggcctataggtgggtgggtgggaggatggggttggtaccaaccagcagcaatggctgcgggcagatgaccacgtcccccctccaaggatggcgatttgcttgggtgcaagtctctagaggctgcagccatggctggtccagaggcatgcagggaacagtccatgatcacagtgacttggttgatcttctcaggggcaggtgaataaagggagctcactgtgcttggaaaatacatccccaggggcttgggcaggaaaacaggctgccctcaaatgcctctctgccaccccttggtaataggaagaacactgcccaataactgagcccctcctggtggggcactgggcttcatagggttcagagggttcccaagggaagggccgggagaagggctgacccctcacatacacacaagacacacacacagatgtgcaagcacacgtatgcattcacatgctcactttcaccccaactcaccagcaacacacaagaccttcacagacacacccgcaacccctacacacagcaacctgtaacacagatacatatgtgcaacccccagagaagcagggccatccacatgggtgaacaaggccacacagatgggcatgttcacactcatccagagaccctgccttcagctcactcaccacaaccccagtacacacaccggtactcccaaatacgcccacagacatgcatgcagcttctgacacaagtatacacacagacccatccccacacgtaccacacaccctcatgtacacacatgtagactcataagtgctcacatgtgcactcacacataggcacatacacacacaggctcaccagcccccaaaccctccaagcatggctggactccagtcctcaccccaacatctattcctagtctatccccactctcaacccccctggagaccccctcctcctgcagcttcagcccccactaggagatataattacagaaagacagaacttggcactcaaagcacctcccctgccataagccccttccctggggcccagcccaggagaactagagctgagttccagggcctgtggccagggctgcctcccccaacacagccctgagcaactgcagaggggggccccgggcaggaagaaaacacacttgagaatggcaaagacaggagagggagggcagggaagaaatggccaggcccttcaagacaggaaggagagaaggaaaagccagccagagctgttatatttccatgatcgtgagcactgccaatgttcactgagcacttgccatgtgtgggcagcatttatgctaaatactcacaaaccctctgcaagctccaccctagggatggggtaagtggagtttcaagaggctgcatcacttggtcagagcctcttgctggtgagtaggagaactggaattcgatgcccactgtctgagctgccattctcagctccatgtcccagatctcctgccaggcctggtctaggtgacagaaagctagtgggatctggataggccctctaaccttgatatctgtttacttggctgtaaaatgggtatgagaacacctggcctgtcccacctagcagagaaaggcaccgtggggatctgcaggatcaatggatggccagggtctgcccgtgctggtctcgagttggggtgatgttgtcattacccataaacagagggggaggtggaacttcaatgcttcatgctccagccgacagcagcctcagccccacaggaacccagtcctctgagagctggttgctatggatacactcccgagggtcccagcctgccagcccccaagcccctgtgaaacccccagagtctgttcttacatgagtgggtcctcagggagggaaggggtgggctaactgacatctgggcccctgtccccaggtgtgcccacacagggggcaaggccccagagaatgccgccttgcctggggaggtacctgggctttgtttctgcaatggcccatctccccaggcctccaggcaggcagagccatgattttcagctcatccctgctcacacaaggcccaaaggcagggagaggaaggcctgggggcccccaggaaacacggtccccttgagtttcagtccctgcacagccgcgcacagctgtgcatccttgggtatatggcatcacctttctgagctggagcccctctttaccaaaacacaggccacagcaaggttcctggattgttgctacagagatgacctaaaagttggtgcccagcagagcaccactcacatagtaggggctttcacaaagtggtgcttgatgccggatgcagagcactccagggaggctcacacagcccaaggctttggaggctctagaaacagctccctggccatcagaaaacccagcaccatggtgggcagtgccagaaagggaggggtgatctgggttgaggggcacccaggagaagcgggcacagtgacccagcccagctgcactgccccacagcctgagcacagctgtgaccacccgggaccccaccccagctggcctttcccttcctgcagccaggatgtggtccagagctgctgggtggactgttggtcaagatcaggggctgtggtgcagatgctgcctgcctgggttcaagtctcctctcagctctcgaaagctgggggcttgaggcaagcaacctcattgtggtatgcctcagtttcctcatttacaacatgaaatattgtaaggattaaatagaaagtgcttggcaagtccttactcctcaatgagtgtggattgccattgtaaaagggaaaaatatcagcgacatttactatgtgcttggcacttaatttacacatttaatcctcagagcaaaacgctaaggtcagcatgagaaatagtcacaatggttcacaaatgatggggaacaggcagtgaccaatcagagcagataatggttaaaaaaccagagaggccccccagtttctccctagatgcagagatgtcagcccaggagagactctattactattccattactatcactattcattaccactgccactacctctggcttcgtagtggaacacagaggcccagagaggtcaaattaccgctgggtcctgggagaaggagattttaacccaggccacctgactccaaggccaaaacattccctgagagcacctatgcccccctagaaaggctgagggggacagagcggggcagcagaaaccagtgcccatgctcagcccctggagggggtcctcctggggccctgtttagaaccctggctcagacaaagggtcctgagagggtggggtactgctatagcccctaaaaggagctctccactccagacaggactttgaggagagactccaggccccagccagacatgcagctctgtttctttttcttcctttctttctttctttttttttttgagatggagtcttcctctgtcacccaggctagaatgcagtggtgtgatcttggctcactgcaacctctgcctcgtgggttcaagcaattctcctgcctcagcctcgtgagtatctgggactacaggtgtatgccactatgcccacctaaatttttgtatttttagtagagacggggtttcaccgtgttggccaggatggtctcaatctcctgacctcgtcatccacctgcctcagcctcccaaagtgctgggattacaggcgtgagccaccacacctggcttttttttttttttttttttaaggaacagggtcccactctgccacccaggctggaatgcaatggtgtgatcatagctaactgcagccttgatcttccaaactcaaaaagtgctgggactataggtgtcagccacagcacccggcctcgctattttcattcaagttgtcctctcttcaggaagatatccacggacgggtcccctggccctcttggctcccgtgggcctgtgtgtaacaccagaagtcaaggtcagcaggcactgaggccccttccgctgtggggtcctccctttactctctctggccctcttctctccccctctgccctcctcaccccctcaaaatcacagggtcccaggaaaaacaccctcagcaaacacccctgtgtcccagccggtgcctatggcagatggcccttccccaaatcctgcctccctgccaatggtgccagcagcggtccttgagggaaatatactcctgagatccgcctggcacctccttggtctggaaacagacaacacagactcaatgggaaccccacacctgtgctgtctgacacccaagggccacacagactccaggcccaccattggttgcccctcagcccctgtacccaaggcctgtgtgggcccatccatagcctagacttctccccagctcattgaaagccacttatcatgggcctgtggctccctctggtccacaagtcccaagtcagggtccatttctggttctccttggctcccaggcacctccaaacataatgggtgctttgatgaacagggaaaatttgatgaacgaatcaatcagtcattaacaataacagcaattgaaaccacatcaaagggccttccacataccagcaactgcactaactgaaatgatgccactggtgataagagtaccagctggtgatgacagccagcaccactgagccatgagtgctgggctctcggccccttgtgtgtgtgtgatctctatgaactgtcaaaagaatcctggatctaaggcccagagaagtcagtgacttgcctaaggagacccaataagcaaatgagtatgtcataccccagctcaacaacaaagacacaagccaccacccatggtgccctcactgtgcatcagccactgtgccaggcacattacctgtatgatgtcctcggcctcttacaacaattctctgaggttgggacaattattattcccattttatacattagcatttgacaaatgagacccagagagataaataacatgagcccatcacatggctggaaaggcaatggcagtgctgaggttcaaactcaaggagtctacagcacagcagttctgttttgccactgcgcgatagcgccgcttcttggaaacacggcactcagggtacgtggctcctgtggggaccagaggagccccaaggagaggagcagggagcaggatgaggtggactgcacttacccggggcactggcgatgtctgggtgcctttccggggcccactggtctccggcgtgaggtcacggtggtccacctgcatgtggctctccaggtcttcggcactctcaaacttgacactgcactcggggcaacggaggccggcacagggccggtcggcgggctcgggcggggccaggccacccacctgtccgttggcgctgcgggccatgcagccggcgcagaggccgtagggcagcccattgacgtcaagcttcaccaggtcctgcttgctgcggaactccttgaggcacagggcgcacttgtagagcttctgcagcccctggccattgggggaggacgccgctgagctgcccgccagcttctgcatgtggaaggtgccatggatcttgagctcaagcgtggaagtgactgtctgcatgcagaccacacagcggaagcccgtgagtgagttgcgcaggtcagggtgcatctggcagtgctcaataaactcctcctcgctctgcaggggcatcttgcagatgcgacaggtgcccgtgtccaggctcttgctgtgggtcaccttgtgttcggtgagcgtcagcagcgaagggaagcgctcaccacagatgggacacatgtagtgcttggcagggccccggtgcgtctgcaggtgctcccgtagcccgttctccgagaagaaagtccgtgaacaaacgttgcacttgtgactgcccttgataaactcagccttcttgcgtgagccatcatcctcgcccggccggatattgtggtcccgcagccggtgattctgcagcagcacctccatggtgtaggccgccccacagatgtcacagccgtacatgggctccgacgcgtccacgtcatcctcgctggcctcatggctgttaggtgcctcagggttcttaagcagcatgccctgcaggtcagcaggctcagctttcttggtggccattgggggtaccccattggccgtgccgttctcggtcgcagcatcaaacacacagtgcttctcccgcaggtgcttctccagcaggatgatggcgtggaaggccttgctgcagaacttacagttatacttcttgctgtgtgtggtgatgtggcactgcagctccacctcggtgctgaaggtctccccacagaagatgcacttgtgagccttggccgggttgcccaggtggctgtgtttgacgtgcacctgcaggtcagcctccttgcggaagtcccagttgcaggccgtgcagcggtacatcttcttctcattgctgtgcttcaccgccaggtgcacctggatggacaccttggagtcgaagacctcctgacacagggtgcagtggtacaacacaaaggtgtgcatgtccagcaggtgcttctgcaggtcatccaccgaggaaaattgcttgtcgcagctctcgcacacatagtgggtcgacgtggtcatgtaatgcactgtcaggtgctgcaggagggactcctgggagtcaaagtcctctttgcactgggggcacgcttgcttccgcagcagcagctccaggtgcagcttcaggtgggtctggaagctctcaaagttggagaacttgaggtcgcattgattgcaaggatactccccattggagatggagttggcgcttgctgagagccgctgccgcttcggggaagacacctccacatcggacgagactgggctctgctcggccttggacttcttgctgtgggccagtggaatgttcttgtggttctccttgatgtgcttggtgagtttcaggatggagccaaagatgggggagttggtgcagtaggggcaggaatagacctccatgaaggactgcgtgggctgcaccaccggagactctagtttggcactgcccacactgcagtgggcctgctggatgtgctcggtgagggaggactcagtaaggaaacccatggagcactggttgcagaagaaagcattattaccgtcagaggggttggcgttggggccgcagtgggagacgcggatgtgctcctgcaggctattgatgtcggcgaacatctcggggcagtagttgcagtggaaggcagagatgttgccaaactgcatcacagggtaggcatggttcttgtgcagcttgcgaacgtgctcgttgaggttgtagagggtgggcatggagtccaggcagatctgacatgtgtggctctgctggggcttgtccgcgtggatggtcttcaggtggatctccagcacggccaggctgttaaagtcccgcttggaacaataggggcagctatagaccaccttggtccagccctgcccgtcatcccgcatcttcttctgcccccgcagcggcttcaaggtggagtccggggtggagccacgctccacagaggcgctggagtcgggtgtggcgctgctcatggaggccacgctgcccagtacagggtcgggactgacactgtggttgctggagtcgggctgccggtggctgtccaggtggcagtagacaccttccactgaggagaactgctcagggcacatggggcacttgtgtttctggttggcgtgggcttggtggatatgggcgagcagtgtgttctcgtcgacgaagacctcagggcagtgaatgcactgcaggtccgccttctcggacagctgcgggtggcgggtgagcacgtgcttctccagctcctccgtctggctgaaggtgtcctcgcagtagtcgcacatgaagtcgtccttcttggcttccttctccgacttggccagatgctccttgttctttttgtgggcctgcatgtggctctgcagcgagctggtggaggagaagccgcgcttgcacacagtgcacttgaagggcttgctggagctgtgggtcttcaggtggatcttgaggtggtcgctgcgggagaaggctgcctcgcactcgtggcagtgatacttcttgtcgcccgtatgcagcttgatgtgccggtcacggctcctcttgtgcttgaagaggcggctgcagtaggtgcacttgaacggcagcttgtcgctgtggatctgctcgtgcctcttcaagtagctcaagcggatgaaggacttgtcgcagaactggcaagggtatggcaggcccgtgcccccttcctcctcgccgaggccgaggtcacaaccatctccgatcatctgcgtgggtgacgcaacatccttgctggagggagacgaggccacccaggagagttgtgggtcgtcatcaccatctgcaagagaaggcagagaggatattagaggcaattcccagggctgccgagaaacaaggacagagccagcttctcgacagcacgcgggctgaggctgtgcagctggccaacggctgcagggggctgtggggaggggcaggggccggaagcaagtggacaccagggccttcctgtctgcagagggcacgccagaggggcggcagataatgaagggggagcgccttttcccttcacaacacttgcctggacctggcaggacatgataccccccatcagaggggaggctctcggccactttcctgatagggaaaggaggggcagcctggacaaagtcactggaaacgaactcacagaccaccagtcccataggccaaaaggaagacaagtcctgtcacttgatccacacctgggagtcaactcccctcaaatccctaatcctggagggaaggaaatcccactggtccttatgaacacaggcaaaattttgcaacaacaaaaatgcccttatcagattggccatagaatgcaccattctctgggtatgggtggactgatggagctggaagctgctgcttcaggtggtagacaagacataggaggtgtgaaatcacagggcaagagacagcagacttcagtgctcaggtgggaagggaacctagggcactgaagaggcatctgtgggtttcctggcccaggccatcctgagacccttgttttctttgttcccactgcacccctggatttgccccaaccccacccaggatcaagacagatggagagatggtgacagtgattggaggatgaatgaggacatggaaggccacagagctcagacccaggcggacccttaaccccactgcaaaggcaaggaagagacaatccttgtacagactccagccagtcccaccctccctggggacagcccccacaacccccctcgtttgctggcccggctagcctcagaggaaaactaaacaaacctaagggtaggccgtttctgggaaaacaaaggcacacaggacacagtgaataaagctagagacattccccggcgggggccgagcagagccagcccgggcagggagtgagttccaaggctcaagtttctcttcggctggatttaaaacttaataatgaatgaaacagaccgcaggctgctgcgggcaggggagagacaaacaaaagctcagattcggctccgctgaccttgctcttgtaaccccgaggaaataaaccactgcccccgcctctccagccgccagccagcctggctgagtcttcagaagagcctcacagacgtaacccagacgtaaccttggcccagaggcagcccagaccttcaggaagggatggggcaggcgcaccatgctcccagcacgggtgaacactggcacacagatgcgcatacacacgcctacctacatacacacacaacacccaccatcacacacattcattcacaccatcactcccacacactcacactatcactcacaaacttaaatatacatgcacacgctcatgtacacacattcacctgcagacacacacacacacacatcacagacctgtggtttccctacaaggctctccacacaagctgcctctgctgtcccaggccgatcctaagacttaaagagagaacaaaggctgattggggggtcttgaggggtccctcacagctggggctgagcctggtcctaggccccgcccccaccccctggcccccgcagcgctgattgtgtgaagatccacctgacccccctggcaccattggcacagctcaaccgggatgcatgcggctctccgaagctcgcagttctccaaagctcccgactgcaaggcttccggcagccaacccacctctgaagcccagctccccagcccagctcaaggggcctcctggaacaccctcccagagcaccagcaccttctcccccgggggcctcacatgacgggctcggcagacgggaaggatgcagcagtcgtggccagctccccagatgagatgcagtgggaggcgccccagcccctgcctgccaattcccagctcttgccagctgggctctctggggcacagacaaaagggaccccagggaggagatggctggggccaggggacctactcggcccccgctccaggccaggctggactggcttcttattattttgatgtcttcactcagactcactcaaactgccactgagcccttcctgtgtgcccagcactcagtgctaagtgctttctcacaactgcaaatgagtggccaggtccactcccactggacagacgaggaaactgaggcacggcctcagagacttgctctgggaaatgacagtgccagagactgatgccaggactgtccacattcaggccccttgatcgtgatgtgggcctggaccagcttctgggggccaaacagtcaaataagaccactcctgcgtgggtaagaaggggagaggcccacgtgtaaagcctccagggtcctcaggacttgatctccttggagcctgccttgtgaagagggctggggctggcccatgatttgcatttctgggaggggctcatcagggttcagagagacacaggaactggctggaacccacccagcaactgatgtgtggagaagtctcaacaactgggcaggtgaaaccactatcactcttgtccctaggacaagcctgaacagatatttctgccagggttcatttgctcctaaacctttcacaccacctgaagaccagaagacactcactcagagccagagccctcccagctcctctatgaattcatccatgccctgaacattcctcttaaccactcactttacgcatctgaaaaaagggaatcactgggaggagtggatgagaaaaactaatgggagaaagcactattatgccactgacatgagatgtccagaataaggcgcatctgagacagaaggcaggttagcagctgtccgaggctggagatgggagcagggactggctgcacaggtgacagggatccttctgacatgagggaaatggtctaaaactagactgtgggtgaagactgcacagctctgtaaacttaccaaagactggctgagttgctcacttcaaacaagtgaattttatggtatgcaaattatacttcaataaagttgttaaacaaaagcactattttgccaataataagaattagtactaattagtgccacaagtgctaacaatattaacagctccatttattgagaatgtcccacgtgccagcactgtgctaagtatgtctattatcgcaattaatttctattcatcctcacaacaaccatatctggctgtctgcagtaacattcccatttctgagatgaggaagtggggttcagggaggtgaggaactggcccccagtaccaagccagatgccccatttagtgtctggccaaacttcatcctgtaggagtacagaacctggtcccgaggccccacatcagtcattcacccagtaggctttgaaaaggagaatcttaacctgcccggcaccagagtacccaaggttcattgcaggctggctgcttggctttatttttctgcaaacaagttttgaaactaaagcaaagcgtattattctgggagcaacaagctgagccactgctgagattataatcatctgaattgaaatgaaaataaggctccttaaactgaaaaggcccaatcagggaaaatgggcatgttgacatataaagtcccaaactcagattgccctgtttaaagtcttttattcaaagaacattcaacctcgcctgctgccatcccaccccctccaaatgcattttgctttggggggacttagctcagtgctctagaaacaggctagagagataagctagggccaaagctcgggatgtatctacaggggcgtcagcagagaaagcggttctcttttctttttttttttttttttttttttggcaggggcaggaggggaaggagtctcgccctgtggcccaggccagagtgcagtggtgtgatctcggctcactgcaacctctgcctcccaggttcaagcaattctccttcctcatcctctcatgtagctgggattacaggcacatgtcaccatgcccggctaatttttgtatttttagtagagacagggtttcaccatgttggccaggctggtctcgaactcctgacctcaagtgatccacccgcctcagcctcccaaagtgctgggattacaggtgtgagtcactgcgcctggcccaaggttctcctctcttatagcaatgacactttcctcatgctggatgctggacaccacacacacacctgcaactgtggccaaggcaatcccaaagtcccctccaacatgaacattccagaattcaggaagaaggtgggttcaaggaaagtcctgttcagtcgctacatttttattttcaagtaaatacttgcatcgattttgctgtgtgccaggcattcttctaagagttaatgtgtactcactcattcaatcctctcaataggctaatgagttagggactgttataatttccatttacagatgagaaaaccagggcacagagcgactgagtgacttgcccagtgccacacagccagcaggcagcagagtcaggatgtgaacccccccttagtcctgttcagtcagtgttttcacccacaaggcttcactaccccccaccccccactttgggaggagaagcatgagaaaatcaagtgggaagtacaatgactaatgacagacccatgcttcccctgccccccagagtaaatgcaatcaaagaactataacaaaaatgagttaaaaaaacacacacacacttgcaaaatggagattaaagtcatttaaaaatgactaatcctgcaaaaaggccaaataggaaatgggttatatgaggcttttgctgtctgctgcaggaagagaaagaaaacaagcataaaagaggagagaatttttgataaaaattcaattaagttgaaaaaagaacattaactgggcttcagaacacgtcagcagcagaaagagccaggtgattcccaagctcatgtggtcacacttggtgaccagcatggagcaggacatgaattcagcaggctgatgctacagtgtgtaaaactgcctcggacacacctcatctaggctgagcagtgcaagtggccgcccagaatggctgggagccacagctcacggctcctctgtcacagagaatcaaggtcagagatgctggagaaggtgctcgggccaaggcaggagagtgactggcccacagactcacaggagtgggccgaaagggaaccttcctgcagtggggggcacacatggaagaggaagtgaactcctgccatcgaagctatgcaagaggccctaaaaagaacactagggggactctctgcattgagtttggggggaagatagctgagcccaggaagttccaggttactaggacattcctgagctgggcagttccatctgtgtgaataaaaatgaccatccagccgggcatggtggctcatgcctgtaatccctgaacattgggtggctgaggtgggaggatcgtttgaggtcaggagtttgagaccagtctgagcaatatagcaagaccctgtctcttaaaaaaaaaaaaaagaacaaaatttacacaggcatggtgatgtgtatttgcaaccccagccacttgggaggccgaggcaggaggatcacctgagcccatgagtttgaggccgcagtgagctatgatcatgccactctagcctgggtaacaagagtaaaactctgactcaaaaaaaaaaaaaaaaaaaaaaaaaaaaaaaaaaaaaaaccgtgagcctacagagggaacaagagctcatccagccattggaataaggtttccatcccagtcctcagggcctcttgtgcccaggactgtgctgaatactgcagggtcgcctgggtgcatcccaccttggtcctgccccaaggacattccagaccatgcaaaggagaggccaagtagagcaagaaaggcaccagtgggagtcatgctggggcaacgggcagagagtccatcaggaggctgggcctccactgcctctgctggctcatgggaagctggaattcatgctctctatagcccctgccatatgaatataaagatcaccttgtacaatactccaaccatcaagaccatcttcatgatagacacaaaatggccttacagtgcttcacaaagtccccaaaaagactccttgccactcaactgtttcttcagaaaaatgaaaattgccaaggagaccagttcccgacaggacaaagctttgtaatacaccaagcagagcttctctgctgcccccatacagagctccaagaataggaatcactgtggcccttccctaagctcagaggaatgggaccctagactcaggaaccaactacccaatcccacatgatacagatggaaaagctgaggcccagaaaagagaagaaaacttacaagcccagctaattggtagtggttgcctagaatcctgtgttcagaaggattccaaggccttatctcaggtccaaagaaatgagtgctgcaatcaactgatgatgtctgccatgagcagagacatgtaggaatggaatagtcaaagggcactgagcaaactggaaagaggagtctcctgactcccaatgctagatgcttttcaggtttcctcttccaaaaaaggagctgtccattctctttgagagatgaggctttggtgttcccaaaatcctgttggtcacagagagacaagaggccctgacagataccgtatgatatggtttggctgtgtcctcacccaaatctcatcttgaattgtagttcccataatccccacttgtggtgggagggacctggtgggaggtaactgaatcatgggggtggtttcccccatgctattctagcgatagtgagtaagttctcatgagatctgatggttgtattaaggggcttccctctttgctcagctctcattcttctccttcctgccaccatgtgaagaaggacatgtttgtttccccttccaacatgattgttagtttcctgaggccttcccagccatgcacaactgtgagtcaattaaacctctttccttcataaattacccagtcttgggtatttattcacagcagcatgagaatgaactaatatactgtagaactgtgttggagtctggagaggaatctccagccagataggtcagctgtgacatcagctgatggtgaggattgcccaaagtggacacaaagcagcccggacaaccgaggagagccagtcagtgtttcctagagcctggggtaataagagctgcaagacctgaatatgcttcagggcacactgtagattgtggttcccacagaggtagccagagcctaagcaggtggctttccagacacgaaatgatccaaattgagctcaaggggcatctgggcatattcctgatcacttcttgggaaaccaggggtacttgcacacacctgatgccagaactagccatccatcccagaatactcctcaactcaattacatccctgcctgtaaaactagcatcagtgtattgagggcaagagagggtgcatagctcctccctcatcttatttcactgatggagaaactgaggcaacatgacaagtcacaggcagatccagtggttactgtttatggcacattttcttttctttttcttttttttttttttgagaaggagtctcgctctgtcacccaggctggagtgcagtggcacgatcttggcttcctgccacctctgcctcctgggttcaagcaattctctgcctcggtaggaatcctgagtagctgggattacaggcacccaccaccacacccggctaatatttgtatttttagtagagacaaggtttcaccatcttagtcaggctggtcttgaactcctgaccttgcgatccacctgccttggcctcccaaagtgctgggatcacaggcgtgagccaccacgcccagctgtatgacacattttctatgtgccaggtcctttgccagctttttctcaattgattctcacacattccctatgaggtaggtactattaacaacccctttttataactgtgcaaagtgacactccaagaaggaaagtaacttctgagcgcacagacattgcaagtggcagatgcccccacccacttactaaccaccaggctacactgcttcaccaggccctggagccagtccaaggcccatatccctgctggacctgctccctctttcttgaggtccaccatgcacaagcacagtaccaggccccgtgacttgaaccaggtacaggtcttaagctttacaaccccacctgccattgaggcaaagtcagtggtggatgaccaggctaggctgggtctgatgccaagcactaatgaatgttgctggcctctttcctcactggatggcaggtaaagtagcctgctgcttaaatagcctatgcagaagcaaacctggagattgtggtaggcagaataataattaccccaaagatgtccaagtcttaacttccaaaacatatgaatatgttacgttacatggtaaaatggaattaaggttgacaattggctgaccttaaaataaagagattatcctggattatccacatgggtctgttgtaatcacaagggtccttaaatgtgcaggagggaggcagaagaggaggttgaggtgatgcaatatgagaaggacccaaccagcaattactagtattgaagatggaaggaggccatatgccaagaaatgtgagcagcctctaagaactggaaaggcaaggaaatggatttttccctaagagcatccagaaaggaatgcggccctgccaacaccttaattttaacccagtgacatctgggtcagacttctgacctacagaactctaagatactattttttgtttgttgttttaagccactgtgcttatggtaatttgttacagcagtaatagcaaactaatacagattttggtaccaggagtggggtgctatgagaacaaatacctaaaatcatggaagtggctctggaattgggcagcgatcagagggtagaagaattttgaggagtatgatttatttaaaagcctaggtaaccttgaacagattaatggaaacatagatattaatgactctgttaataaagactcagaagaaagtaaggaacacatcagagaaaacctaaatcactttaggaaatatctaaatcatcatgaacagactattaagagaaatatggatattaataaaggcactgacagtgaaactgaaggaagggggatccttgatacttggtggcagaaagctaagtgaaattatgactcacagttatgtgggaagcagaactttcatggataaacttggatacttagctaagtagatttccaagcaaactgtggaaggtatgggctggtttcttcttgctgctaaaaagaaaaaagattaagaaaagaactgttaagcaggccaggcgcagtgctcacgcctgtaatcccagcactttgggaggctgaggcaggcggatcacctgaggtcgggagttcgagaccagcctgaccaacatggagaaaccccgtctctactaaaaatacaaaaattagctgggcatggtggcacatgcctgtaattccaggtactcccagctattcaggaggctgaggcaggagaatcgcttgaacccagaaggtggaggttgtggtgagccaagatcatgccactgcactccagcctgggtgacagagcaagactccatctcaaaaaaaaaagaaaaaagaaaaaaaaaactctaagagatttacttacaagaaagcatgctccggagaaaaagctgaaggtaggactgcacatattgctaatatctcaggaaaatcaaaatgccagagtattgagtattcagtcacaacaaaggctctttggtgagattaagggtgtgactcacagatctcctagatcaaattagagagcatctaggaaatttgggggtattgctctggagcaatctcagcaaaagacaaaagtagagaagggattatccaggaaatatctgtagaggaccatcttgaataatggagaaaatacccatgacatacacaggagactcacaaggttcttgaaaagtttatactgacagaaacactgccagcttaaaccaaaaaggacagagagagtacaggatgaaagaagtctgttggacacccaaaacttcacaagcaggaaacaggttaataaaactactcagatgaaagtacatgctacctttcatggggaaaaaagggatgactaagcgggcagaacctcaagcccagagggtggagccatgagccatagtggatgagatcactactggaccaggttcagattccagaactgtgtaaccatgggcaagcatatcccctctttgtgctttcatttccccatctcttgatagagagaatccgacgaacaggtctctaagaggctttgtagctcttacagtctgttatcacttaatgatgtctgtgcctgccctgggtacagagtaagtctcaggtggtaggtatcccagctctctactatctcctagttcgggtggttttttaattcagcacatatttaggatgcctgctctaaatatccagttttccaaagggtgtagaggtacccagcattcttaggtttctatgctcttatctgtccaatctccgtgtcaattaattactgtttaaacattaaacactaaagaaaccctttactgctttgaagtacacacacacacacacacacacacacacacagggagagagagagagagagagagaatcccttcaattgtaacatcagtactgcacctagatatctgacaggagaagtgtaaaggattaagtttgacccctgggacatcaaaagtccaccctgggaaaggaaagggatgaggctattggaggttctttcctcagaggtaagccaaggagctccacaaaggtgaccagaagctgacatggctcttcctgaaatctcgagttagaattatgctattagcaaaaataatagcagcacctattcactcattcctcctccagggagctgagagtttcttacgaatgggatctcatcatccccaaagtataagcaaggaaaagtagggatcattccttcggtttgggagaaaaaagactcagaggtcactggacatctcaaagacagagactgaccaggcctgcccttctccagccagctctgggggctgctgaaatgccatgtgacagtgaacagctgccaccaaggcccttaacaaaacttccagggactcaaaacttagcttaggctgctaagcttgaagaaactcagtcaattgcagggagacgtcagccctgagggacagcagagccatgagtaagagtgtgcactggcttgctcagccatcattagctgtgagaccatgggaaaattactgcccctctctgagtgcccatgtcctggggaaactaaaagtaactaccttacaaagtggttaatgtttacatactgctaaacattggatgaacattggctaaataagataaaggggttcctaatgtaactgacactattatcattcatcgtaaatcccataatctacagggcatttaacattttgcgcagcacctcacacccattatccatttgacatctggagcaactctgtgcagtggtggtggtcatggtggttttgttattgttattatccccatattacgagtaagtggggggccacacacccaggcatcctgggatggaacccagcatcccattcagttagtgaatccctctcaccctcataaacagctgagcttacacagtaagttgtgtggtcaccccagtaatgaggaaaaagaacagagaggttaggtcacatcctgacatcacaaagtgactggaagagctaggcctgaacttccaacccagggctcttagccagctggactgggagaaatgatgccctgagcaatgggtcataggtcatcatggctgtcctcccactggacagtctgggggccacccagttatcagtattagtgattttgtgaaaatgccaacatttacaaatcaagaattcccaactttttgttgttgttgttccttaattcacagtcacttttggctttttttttttcttttttcttagagacagggtctccctctgtcacctaggctgtagtgcagtgatgcaatcatggctcactgcagactcaacctcctgggctcaagcgatcctcctgcctcagcttcccaagtagctgggaccacaggtgcgtgccaccatgcctggctaattttaatttttttttttttgtagagacagggtctctctatgttgcacaggctggtctcaaactcctggcctcaagggatcctcctgcctcagcctcccaaagcactgggattacagtcataagccaccacgcctggcccacttacggtttttcttgaaggagaagaaggcctgggagcacagactctgcatctggcatgtggaagatggagctcagctggggcttcttggaggagggacccccacccccctgcatgcccagcaccccaggacttccctcaccattagggggtgtcccgggccttggagacatctgtgtttgcctggtggctgagagccggcagcagggcttagactcccagctcccccacttactatgtgtgtgaccttagccaagtgaatgacccttgctcaattttacagatggagaaacctgtctcagttttcacatctgtaaaatggggatgactatttatagacccaactatagagttgttttaaagatgaaatcagtgaatatctgtaaggcgttatatatgacaaatgttctataatgcctaaaatagtcactggctactggctcccaaatcaccataaggtggtcacaggacaaggagaggctggcaatggctggaatggtttgaggggacacaagacacagtgtcacctccctgagccctgattgataaccaacagggtctaagctaaacctacagttacccgtgcacaagatggttttcaaacaaagcaaactcaacctgccaaaattctcagagggcccctgccatttacaatcccaggacatcagccctgaaaggagcttcaagacccctcattatacagatggagcccaacgctctcattacacaaacagagaatctaaggtactgggagccatccatggcttggatgtgggtccctcagctcatggtggagggggtgggggatgaggctcagactcccagaacactccctcccccgcccccacatggctgctggacatgcagggcaaggacgcgtccacctttccccttgaagcctctgacctcgcagaacacacagcctgccaggcagctccatcccttagacaaatttacttagcactgatattgaaaatgcaattgagctcgagttttattgcagaaattaaacagactaggaaaggggaaaaaaaaaaagccagtgctcatcagctcacccgagagctggctgtgatcaaacttgctaaagaggagcctagtgatcaactcctgccagcaaggaagagccccccaagtctgcccctacaagggactccccaggggcacgaggagctcaggagctccggaaggttctcctgccagcctcctggcgtggacctcctgcgcaccctgacatcgcctgcccgcctcttcacaaggagttggcgccttgtgaagtcatctccgtgagcttcatgaagcaacaccgccaagggcctgagcaaagggcgctctgctccactcgagtgaaagcaaaatgctttcggggttgaatcactgtttttcttgactccctttggagatcggcagagcccacattcggccgtgttcgtggacctgggactggaaacagctgcgctctaattacatgtaaagtgtaccaaaacatcccttttatcacagactggaaatctgttagcatctgcctctcctttgtttcttccacaagatacaagcttgtttctacatttttctcacctgtagcagtgattaaaattcattataaatgaaaggagtgaacagagaaacaagttcctctgtgtaccgttctaaactcaaattagaaacagctgtttgctaattcatgcagtgatgttttgtcgtgctctgtgaatcaataataactcaccctattgctgcagaaatttttggataatccacatatttaacgcggcattggattctccaggcagggctgcagcggcaaaacctcaggcgggtgggaggggacttggggtccccactctggaggcgtcccctgctgcccagacagagaacccctaactcagagctgcccagcacctctacccactacacaagtcttgggaggacctgaaggaaaccctgaacaggcgcctcatctccttccctccccaagaaccaccaaaaaaaaaaaaaaaaaaaagaattcaactctgattaaacgcaaaccacacacatcctccagccgccggagggaacagcaaaattaaaagtctaattggtacccggaacaatttaaaactattaagtataggtgaagcttttctgtaagaaaataatcctctgattgggattaggcatgtttggatagcatttttcccatccacacattttagctgcagaagttacagctaaggtctggacatgctcaggagcctctgagaagtgttcagtcatcccctttgccacctccagggaaaggggtgggtggggtgcagagctgcatccccatctgatggcttagagggaagcagatgctctctctcctttgcagggagggagatggacaacacttttggaggcttgtactgccactgtggcatgccaaacctactctatcctggctaacacatgcccatccttcaagacactgcctcccggaagccttccctgactgcctctgtcatcctccctgacttcagggcactacctgtttatatttgagtggttggggtgtccctgtgtctcctgcatctttctaggtctggggcattgtcatagtgaaccactttttgaacttcagactggtagcctctgcagagccctttctgtggccagacacagtgccaagctcttcgtaagctccattttgttaaactctcacctgcatcctatgtggtgaccactaccaccattaacccccatcttacagatcagacatctgagacatagagagggcgagggccctgacttccacagcaattaagtagaaggagcttggaatgactccatagatctccagaaagccatcaagaccacccactgtcatcaaagatgtataccgagcatgcctcacctgctccagctcctgagccttcattcaggccatggtggtcactgcccccgaaagcccaacccatgacttgggggccagctctgcccacctccccaagcatctcacaggtggtggtgggaagggtggtctcctgcatggctaagagtaggtcctcatttcctcctttcctggtgttcatctgggcctacagaagatggcagtccaatacgtcctggggggcgtagagcacaggccccaggcaggggcatggacaaggagctcatgctgtccctgcagggttgtagggagctttcccttagccaaggccactgggtgccagaagctccaagcccgggagggctgggaatggaaatgcacagatgaggtgccatcatgggaggcaggagcactcaaattgggctttgaagaaggagtaggagctccactgatctgtgttcttccaaacatgggctacctcccattggtaggacccgtgatcattttagggcgcagccaagatggtcttaaataaccctgatgcacaaatgagaaagttagcgccctttccattctgttgtcagccttcagattaggccagggagaaaggctgtctctaactcctctccagcatttcagcaaaagagagggcagagtccacgcttagcatttccagaacacagcagctcatgtctggaatagtgtgagcatggaattttcttcggttttgttttttatttacttttaaggttactgtcatcttacagtaaatgatactggttttccatttgcagaattaagtaaattaattaatttaaccacaaaagagccagcaaagacaaatactaggtgaatcatagcatcagtgatactcaaatgttgcaagaatcacagtagagatatgcaaatgactaaagcctgggacctccagatacagagagatgggaggagaaggcctcctgggagaagcaatggcgggagccatggctgaagcttgggtatcagtgggagaagcagcttagaaggtgcaatgagagcccatcgtcaagaccttaaataccaagccaaggagccaagaactccattccacaggccctggcaaccaccaacactatctgaaacactagctcatgagtaagtgggatctggactccccagcccagggctctttctagacctcccataactccaggtctgcgaatgactgagagttaaacaatcactagcctataagcagaacccatttcaaggaaaacagtgatcagtgaccccaacgacccagggctctcaacagccaagatcaggtgcccctgcaggagaaaacccctgcacaatcagcatggggtccccttccacgtgggggctgaacactcaagtcactgtggacagcagaagtatcaactcccctcacaaggatccctgctggggcactgagggggatgggcgcaccacctttcagtgagtccaacccagccagcttttcctccacttttggaataaattgccatgtcctctgtgtgaaagagccaaggtgttcccaaatacacaccatggacctcaacatgctgaacaggtgtctgctcccacaggaggggagtgtggaagccgaaagcccagaacagcatccatctcacggtcacttcgcccctgaacccacaccactgaattatttttcttccacaaacccacgcagtcattcccttgcagagcacatacaattgaagcactgaatgctaagtgggtgcacgaggtaactccagtggggttttgttcatcgggtccagggcaagtctccaactctccaagtgtctgtcccacctccctctctcctcccacccccaccctggctacctagggacccgagtcaaaggtcttctgacttccagtcctccatcccatctacactgcaaatccttctgacagtggtgccccacgttggggcagtgtaggtgagacggaggactgaatgcagctggtttatgtgactttcttaccagagatgcagacagaggaagctctcaatgcgaataaagaatgggcaagcggaggccaggtgcagtggctcgtgcctgtaatcccacacactttgggaggctgaggcgggtggatcacctgaggtcaggagttcaagaccagcctggccaacatggtgaaaccccgtctctactaaaattataaaaattagccaggtgtggtggtgcacgcctgtaaccccaattactcgggaggctaaggcaagaggattgcttgaacccagggggcagaggttgcagtgagccaagactgtaccactgcatccagcctggatgacagagcaagactctgtcttaaaaaaaaaagaaaaaaaaaggcaagtgggtaaatggatgaccaagttcatcttataattttcccaaaagccagtatcagagaaaaccccataatgcctccaagctagaactctgagcttagaccaactggcgacactgaagaataattaatagattatactttgtattctatatcatacattgcatatgtacgtataggtctaatcaatgatgtttattaagtgccacatatttcttgggtgtttgatccatgtcacgtgttgtctcattttattttttgtctccaagaaaaaaaatgagttgtctcattttaatattcacagcaatctgatgtgttcctattaccagccccattttatagatgagaaaactgaggcttataaaggttaattgacaggctcagggccttacaggtggagatggcctagcagggctttgaacatggattccctgacctcagaggctgtgttcctaaccaccgcgggatatgagtttatgaaccaccatgtcccagggaaagagagggagtgacacccgttcaggggcacaagcattctgccaaggaggtggcctcccgtggagcccagcctgacaggatgtctggattgggtccgtattctcagcctggacacctctcagggtgacacgctcctttggctggagacttccacagacaagcggcacacactgtgtgacctcaaatcacagatcccctgcttctcagtcaaatcccatccaggacctagccccagggtcccaccccaagtatctggaggatggagaaactccccaaaaacactccctgtctccagccatgtgccaggtgccctccagcagctccaggagacagtcatgagcttggtccaattttatggaagggaacgctgagggacagaggaactcagggacctgatgtgtgcatcatggccagtggccccctgggaattcagcagctgcagggacagtctgagtaaaagagcctgaggccccacctccaggtgtctgcctgtctcaagtctgaccccaaagggaggggaggtgatgcccccaggggcaaccttcacctaaaagggcctggagccagtgggctcctctgaagaccattcctggggcaccctgcagacacgaaggttttggcagtttcaagcccagtggtctacagcagcaggctcaacactgcaccccaaaatcggcctttccctggccctgtctcctccgtcctacttcctgggagtgcctcctcgccacatatgtgcactaagtccttgcttcaggctctgtgttcaggggtcctccctgcaacactgactaaggtacaactgccacagatggtggtgtcagacttggaagccatgtctttcagcctgcatagcctcctccacagcccctaatctgcacctgccaggatttgccatgctcaagtcactgagaggccaccgtcagggtctgtgtcctatactattactcaaccttgtcctttcaacgacctcaggactaacaatgtcaggtacccaagtgtaatcctaaatcatgatattgatgaaatcatgagtatgatgtttttgtaatgcccattaaaataaagatgtaattgggttaaacatgcatgaaccaccagaaactgggctgggcagccctagatgtggcgcaagtcctgctgccctggcccatactgcagtgactgcagctcttggtctgtccctctccccctccagacagggcagtgcagggacgagggcgcaccttcatagctgctgtgtccccagcaccgtgcctggccagaggcaggcaggagagaagaggtgggctgggcgctgcaaggagcccggggcctgaggagggccaggaagagaagagccagagcattttcaaggatgtgctgggctagccaggcggcccctctgagggccccactcacccctaaactcatccaaatctacaacacgacagaggaaattccaattttcccgattttcatgtttccacccctagagtaattgtcgtcgtggactttgtagctgggctgttgagcctcatggctgaaggctgccccagccctgcccgtgatgggcaggagatgaaaacgactcatcaggcctggggaaggctctgggatatggcagcagcagcagagaggcagccacctggccctggaccaccacgaggaggaggagttccagtttgtttggccagcacgtcaggtccctgaaggcagctgtggcagggcattcccctgactggattccggagtgtggggcagggcccctgaagtcctaggcatcaaggctggggcatgtgggtcccccaccctttcccagcatcgctgactctttccttggaacccccgccccagcaccctgcctgtccctgctttctcagcccgagtggccaccacctcctcccactggaaccaggccctcatctgtgtgcctcattatgtgctcctgctcacaaacagacctgaatatcagccacactcaccagacacttcctacgtgccgggctttcttaaaatctatattatttatttactcactcatattagtctttgatgttttacttgttttagcggggggtggtttgggtttttaaatttgaaatagagtcccactctgtcgcccaggctgcagtgcagtggcgcaatcatagctcactgtggcctcaacctcctaggctcatgtgatcctcccacctcagcctcccaagtagctgggactacaggtgtgccaccactcctggctaattttttatatttttttgtagaaatgaggactcgctatgtatgttgccaggctgatctcaaactcctgggctaaaccaatcctcctgcctcagcctgccaaagtgtcagaattgcaggcgtgagccactgtgctcggccgttttactatttaatgcatttaagccacacataatcctttcactagaccccccattttacgatgtattgtgcattgtacacatcgggatactgaggcccttgaggtctgagggagggacttgccccagggcagagtccggcagagccaggagaatctggccacctgactcatcagccatatgaaatgttgagatgtggggtttatgggaaacacacccctgacacacatactctcaagaggaggccgggtggacagtgtaatgcaggggagagagaaactgatggagagcgatcagtcaccccagatcctgcacatggcacacgaggggcttcaggtgcccaccgctgcaggcactggtaccctcctcatagaggggtctgggaaggggagatgccacccccagcccagctcaggctgacggcacccctgtgggtggtgctgggcctacagtctgccacaggcagctccacggtccccaaatggtccccagctcctcccagcacccagcacacagtaggccctcaatatttgccaaatgagtcaatggatgcacactttagtcaggccactcgtcagggtggggtgcagggccagaagggagctgcaccttccttcctcctcctccacccgcaatatacctctcaaccacttcccttatgcttttttatcttcttccaagaatgtgattaaggtttcctcacaggtactcctggcttcgaactgcctggagacaattctgataagccctggattcctggatccctggatccctgggagcccccacaaggtgcctggcaataactatctgctcaatgactgaatgaatgaatggatgaaagggtacctggcctacgggaagctcttggtaactgtggcatgaataaatgaataaatggatggatggatggatgaaatactgaagtccagggcttcgtctaaaggaggcacttgaaaactatggtatgaatgaattcagaatgagaaaatgagaaaacgaatgaatgaatgaatgaatgaatgaatgaatagtctaatcacaaagaagcagcaaggagccactcaagaggcccctgtaaggtggggcctaggagttggggacagagcctccagctggaagccagggagtatataagcctgacctgaccaccctcctgaccacctgggtccagtggggctgcccccagcagagcctgtccagcatcaccaaggtccctcgggccccctctcattatggcagaatgcaattactccagtcttcagtggggtctgaatttgttatgattttatttgaaagagcctcttggagccagggaagcagcaagggtgtgggggtcaggaagcacggacggaggcagaaggaacagctcagctacacagcctcagcctgaatcccagagaaatgacattaaaacaaaggagacacagagctggggcagggtgtggggggatggggggggagcttacttattcagaccagagccaaacaaatggatagatttaataagataataagctcagattccatgctcttaaagatacagactggggctgggcatggtgactcacacctataatcccagcactttgggaggccaaggagggtggatcacctgaggttaggcgttcaagaccagcctggccaacatggtgaaaccttgtctctactaaaaatacaaaaattagctaggtgtgatggtgggcgcctgtaatcccagctactcaggaggctgaagcagaattacttgaacctgggacgcagaggttgcagtaagccgagatcgcaccattgcactccagcccaggcgacacagtgagacttcatctcaaaaaaaaaaaaaaaaagacacagactcaacagtgggatttggggtgggagtctccatatttttccgggaaaacacccctcaagtggatgcctttcttcacacaccacactggagaataagggtatgtgaatatgcatgtatatgcttgcaggcatgtgtgtcttccccaccaggggggacccccaaaactcaccagaaacctccttacttcctaaccaggacctgtgaacaaatgcacccctccacaaggaacacacagccaagcagtgcccttgtaattttttcaggaggaattcgggccagccaagcacaagtcggtgtcacctccttcccagcctgggcttccctgtctctgtccaatggaccaacagtaaaaagtgagcacttcccgctcatcttgggaaacacctcgcatccactcactcaatcagccagcgactgcactgttgaaatatttatggagtgcctcttctgtgccaggctctgctgcaattcctggggcagtgagcacacccagcaaagccctgcaccatggaggctgcattccgggggcatcaggatcatgtccaggaaggctctggagccagagagcctccgttcaaatctcagctctaccactgaccagtggtgtaaaccaggatacgttaatggacctctctaatcttcaccaagagggaaaacaggcagaatcccttctgcctcctcgggttgtgcacaggatgagatcagataccgcaggttaagcacactggcccagcgcctggtacatggcacatgctcaatgaacagatcattgtgtgtggtttccagtccagtggcagcaaacacagagaccgctgggcagagccgtggttcactgtgagacccccgcccttggggaactccacccccactcccaggttacccttctcgcgggcatccccaatttaccacctccttatgtcattcctgccaatgtcatgtcataaagaaagccagtccccctgaagggctctggtccaccccaaaaagtccttaaatcccttctacaaagaggtttggtcccttccaatgaaggggaatccactcccttctgaactcccttagtctgcaggaagaaatgatctcctgatgagccccaaaggagggcctgctgacctcctctcagggacaggaataacaggaccctctgactccaaccatcctccaagaggaaggacaaacagcgagtcacctgcgatatggcagccattttttaaaatgacattgcaatttacattcatttattccttctataaatacgaataagtgcctactctgccagccctgttcgaggctctggggatagggtatgaagaaacaaagtccttgccctcagtgagcttacaatgcaaagagaggagactaaatcttcctgctgaagaaggaataaatcagtccgtagtaaatcacgtgttgctatgaagaagtgcagggcaggaaaagggtgaagggtggggtgccactctggacaggtgacaaggcgacacttgagcagacaccagaagcaaacaaggcagcaggccaaggcagaatctagagagagaggatcccaggcagggatctagcaggtgcaagcaccccaaagccagagcatgcaaacttttcagggcacattttctgagatgcccacgtggggctcagtgtgaaggcatgtgccctgccttctaagatcacaggccaagctgtcatccaaaaccccacagggacccaaaatccaaccccagcatcaactcactgtatgatctgactctggtctctcaacctctctggtcttggtttcggcaacagctaatcagaactgagcattatccaagcaggcgctggcagaggaggcccccagagtcctcccgagtctgcagctctatgcaaagcgcacccaccattcctctccaccccatcgcgccattctcacaccccgcgccagcaacaccacgcaggattggtactcctgccaaaatagctattaacccagtagccaataataacacgttatcctatcaatttgcttctgaaacgctgtgtaattgcagaacctaagtttgccatctcggtagcctggttaccacataaacagaaagaaactcaccagcctcttcctgaggagaacaagtggctggccacgagaaacacccgattaccactgaggccccccagcccacccccctcgaggccctacagaatccatcaggaatcatagtctggcattcagtacttcagaggctagtctcaatgtccccttggcatgccgcccctgtgactggagaggggaccagtgcccgggatgggatggctttttaggtggcaaagtcaggcccggcagctgcactctggtggcctccctcccggccagtggtgcaggaagtgggacagacatgaggcttcaggagggcacgggagagggcaggagccagaggcaggcaagcacttgagtgcaaaaaccatcacagatgcaagccagccctccccacgggagacagaggggacaggaggtcaatgggtggggcacagagggaaggacaggagagaggcaagggagggactccagacctaggagtcagggtgcaccccagggccctccccatccccatgccgcagggccccacccaggtctgacaccctggccaccaccacctgcttggcagctggccgcccacttttcctctctcattccagaaaaaaacgtttccttccttctggatttcattccactctgagcaaacattccactccccaacgcgccgggagcctctaaggggactcggcgttccggtgcagacaccagcctgttttattcattcttcccccttccaacccagccaccccctcatcactgtcccatgcctccgcttacctttccccctgctcaccagggcgtcccagggcaaactggccgatgccaagagggccagaacctgagcccgggttcccagcacccggcggcagggcaggcgagggctggagaggcgcttcccaccggcccactggtgatctcagccacgggacgcatccccacccggccgcctgggccggcggagaaggatgggccgagggtgtgctgctcccgcggcggcgcttggcggaggacccagctagcgggagaggaagggccttggggaagaaaaggggctgggaaaaggcacagatggggagggagaggacagaggaggcccagggctcaggccacgcggccagatgttgacccagttgagggatccaggccccgggggcgaccgaggagttctggctcccctgccagctctgagattctacagagatggaggagggcctggggccggcgccatgccagggcctggtgctgaggctggggttaaagggaggaccacagaaagggagcaaggggtctctctcggacactgcccctgtctgccaggacagggtggggggacggcccctgggaggcccctgggtggggtgggtggggagctgtctgcgggaagcagctctcagcaaatgaaaaccaggccttggaaactggccgggccacagccagggcacagctccagggaaaaccccgctgctcaccgaaaggtgccccaaccagagcgaaaggtgatgttaaaatgaacgagctaggaggggccaggcagcttgagcgagatcgggggtggcccctggctacagccccacgatccctgctcttttgtgctctgaacgcccctcattgtgggcacattgtactcccaaggcctgcttgcctgtaagtgctgtaaaaagccaactaactgcgcaattttcttcccttggcttccctccgctcagccttggtcaggttatcagctgagctgggcctggggctggggactggcctggctaggcaggcctgaagtccccacacccgccatatttggaaattcaactctcaacggtgcattgaggcccaaggggtggcacttccaaattggtgggacaccagggttctgccatcaagagcttggtgggtagcggcattcagtaaatatagatgtcacccacacatcctttcattcattaattcacccatttagttattcacaggatgtctctgatgtgcctacaacccagcaggcacttaggtggtgagggtaggagggtgagccacactggcagctcttggcctgtggagctcgcagcctaggtggagggacaacatttgatcccctgtgtttgctaggagaagtgtgtggggcctggggggagaacaggggcgcagtaagggtgccagagccctcctggaaaaagcaggctctccgtggagaccagcaggatgaagaattcaccaagtgaaggaagcaaggggcagaaatgagctccaagcggcaggaccagcaagagcaaaggcctggaagtgagactgaggtctctgacaggtttcacggagcctcctccgctcctcactctcagccacagtgggtggcccagccctggtagcaccgccccccaccccagctcacagactcggggagccccccatcagcacctctggaggccaatcccacaaagccatcatccagccgtctctttcccagctgaagttctagttaaaaatgttttcatatgtttatttttaaggggggatgggaagacagaagggagacctgaaggtctttttcttttcagaaaaaaagaaaattaataaataaatagagcctcaagaaaagggcatggaaaggtctctgcatctgtaaccactgaacaaattaaaattagctcatttaatcagctcctaatggcctggctgtcccgagtgggccccggaacacagcaaacttcacagcagaactgcgcaggccaatgtcagtttatcctacaacaaagggattttctaaatagtgcgatcaaaacgcagcgaaggccggggagagctggggagacggaatgcggccccccagatcctggctggcccccgcctcccagcttcgtccctttgaaaggaattgttcttttggcttttgttctaattatctaaacatgtgtgtaactctgttctacaaagagtgttttaacccgcagaggaggtaactgtagcccctaccatacgttactggggccctgctcccaatcctcacgcctttaatacttctccattccccacctgccttcgacagaggcgtaaacacacctacgacatacagccacctacacacgccagttacattcacaaacacagagttacaaacacacagttctatacacatgatcacgtattaaaccagctacatacacgtagttataagtgaacagttacatacatgcacggttgcctattccacacacataaagttacacagacacacagttctatatacacagtcacatataacacattacatatgcatggttatactcaattacatgcatgcatgcacagttacattcccagagttatatacaccacacacaagtacatgtgcacacaatacacacagctcctcaagctcctgcctaacagctggagatgggggaggcccagctcaccagacccccagggagggccgctgggtgcacacctgaggcccaggctggtagtaaggactcttatttccctggagtagtttctctacgcaacttgccacctgggctaaatcattagggcaatggaggaggggaaacaaaaggccaggggagtggggctgggaccccagaaaaaagggcagggtgggaaagcatgatgccaggggtaagcacaagcccatggcccagtggggaggaaggaggccagccccatcaccgactccatcaccaacaccgacctcaaattcccttcccatggcctgtaaactggccagtctgcagctctgcctttaggcccagagcctccttgggtgctcagcccacagggaaataagcctggagtcagccagatcttgttgaaatccaactccaccacttactaactctgagcctccccttcctcatccaaaaaataagaaacaacagtagtccctatcccaaggggcagttgtgctgatttcattagagatgccagtaaaatgcctagtccagaacaaactgggtcagtgtttgccactctggcaaatgaaaggtgtgggcatggaggcccgagaagagaccatcagacagtgggtcggggcacagccagacaagagctagccatttggtgactttcaatttcttattcaaccctcatcccccgagtgaggaaggggagaattttaaaactggataaaagaaattaaacagggtaaaaagaggaaccaactgggatggagggaagccttcagaaaacttctggcccagagtcagaccattatcttctgaagacctgctctataggtatttacagcaacaccctggggtaaaagcaattgttatctccatgtcacagaaaaggaaaccgagggctgggcacagtggcccatgcctataatcccagcactttgggaagctgaggcaggaggatcccttgagcccaggagttcaagaccagcttgggcagcatagcaagaccctatgtttacaaaaaattaaaaaataatttagccaggtgtggtggtgcacacctgtagtcccagttacttgggaagctaaggcagggggatcacttgagcccaggaacttgaggctgcagtgagctatgactgcaccactgcactccagcctgggcaacagagtgagaccctgtctcaaaaataataatgataataaagaagaggagcatgaggctcagggaggtgagaagcctgggctggcagaggcagtgtgcaaagaggtctgtgtggctgcaagctgcatgctaatgcccagccccgctccaccttccttcccgaggcaacctgttctcccaactacaaactttctttagcaggactccagcaggtaggagagcctgaagttggcttctggctctgggaactacaagagcctcagaccacccaacccaaactcaggagtgtggcccttttccttgcaggagttcaccaagtcctcaagcccctaccccccacccacctcccatgctgagtaggaggtgggaaagaacctgtacacagaggccttactgtaaaatgggaaaacattttacagacttagaaactgaggccccgaaatggcaggggtgggaggctcaaactcccacaactcagaggctgactctgcaaaccttgagtcctcccaggatgggactcctaccttccttgcccttctcttgcccaggcaggtcctcctgggatctattaggtgagcagcattgttgagaccccagggagtgctcagaaaaagaacctggacacaggctccatccagaaggtcccactgggctagtggtagctgtcctggtcctgtttagggatcctgttttccacttgattggcagggcccaagctgacccctggtatgcctggaggtcagccaagatacagggaaggtggcaggagggtcagagccacctgatgcagcctcagtacagggagtaggacctggggaaacagttcccgctaacccactaacgctgcagacccacagcctgcaggctctcccagccccacccccagtaagcaccaggcccccaggaggaaggaggggtgggcagggaggtaagcacatgggctcgtgtttgaatcttggctctgtcatctacatgctgtgtgacctgggacaagtgacctcccctctctgagtcacaaacctcaactataaaatgaagatggtgacagtgcatgtctccttccttacttgaggactgaagggacgtttctagctcagtgtctggtcccccttccccagtggtaacccttagtaagcacagagagtggggagtggggagtgcagcatggtcttaaatccatctcaaccatgcgcggcagctcatgtctgtaatcctagcactttgggaggccgaggcaggcagatcacctgaggtcaggagttcgagaccagcctgaccaacatgaagaaaccctgtctctactaaaaatacaaaattagccaggtgtggtggcgcacacctgtaatcccagctactcgggaggctgaggtgggagaatcacttgaactcgggaggcggaggttgcagtgagctgagttcgcgccattgcactccagcctggataacaagagcgaaactccgtctcaaaaaaaaaaagaaaaagaaaaagaaaaaagaaaagaaaaaaaaatccatctcatctcccacatggcgaccctagaggcccaggccaccatccccaatgagtgggatatggggcacccttctttcagatgcagcaggactgtcccctgcccagcacagattcatctcagccattcttaagctaagcccagcaggcagccgacagggcagcccagaggacacggccaggccaggtggggtgcaaacctcttccttacgggatctgggcccaccaggcaggagttggacctagagaccccttggaaagcccaaaacttccctctcttaccatcaggattcagaagagaaccacatgaaaaaagagttggtgatatctccccctgcaccccctcaccatccaggtcaccccccacacagagcccagctgggctgggaaatcgggccctagccagggctcctgcttccctactccagagccagatggccctacacaagcctcccttctactctactccaagcctcagtttcccctccttggctctgcttacttcacagggctgcagtgagggtcagaggggaatgatggctgtggagatgctttgtaaactgtcgagagccattgccacacacgggattattgagggtaaccaggataggaaggggaggagacgccaagggcaagccccatctgtccgttcccctgcatcagggcagtggccccaccacgagaacagaggaaaaaaggccaagaagacaaagtcagggaggctcacgccagggctggatgctccctccagggccccagagtgcaggcaggagctgctgcagcccagcagttctgtttggtgacattggaaggggaaagcagacaacatgggtctctgggatgcggccacctggctcggcacccagcacacagtaggcatcacccactggttgagttctcccagccgccaaccctcagacaacctgcctctgcgagagttcagtgcagatgcccacagatggaagccagaaaaaaatatgactccttgcaaaagaagcagactgcaccatgtgtcccagctcagcaggctggtcccaaggcctcagaccccctcatggctgtggccctgtaaggatgggaaggcatggttttcccacttcatgggtcaccagcagctgtccctacctgcccaactctgccagcaggcaggctcaactagatgcaggcagccaacctagtgccaaggaataggcagaggaggagttggggctgcattctagtcctgcccacttttgccccctgtgccatctgcatctcggggacgcctctgttggggactcagtttccccacatgctccggctccccctgccccataagctgtgaaacccaagcaaaacagcacgctgcctcattctcagccaacgtaggctacaattaatctgaagcagggattttcttaattgctgggttttacaacccaatcgcaaagataaattacagctagctgacaacgccggcttgaggcgagacgtttaaagcatcctttttaagtgtgtgggctctttaaaaagctggtatgatgggaatggaattgtgcttgcagcctagatcggaggctacttcccttagggagtcaggccagcaacgccaggggacaaacctctcgaaggagatgtcttattggggagtaaaagtaaatacataaaagaagggaggtccacctgcaaccctcctaattgccttccttcacatgcagctgcagttccacactccacagccccttcaggtgtttcagcgccaacaggattcccgggactaggaaggcccagcttccctcattagctgtgcctggtcacccagggggcacagaagaaatggtgtcagcatgcacttggcagtgccctccaacacaaggatgactgccccctgggagaggcagtgagggtaagggacgaggtgtgaagggggtcccctctgatcttgttcttgcagggagctcaaggcctggcagcagccacgtccaaaacagacaaaccataggccctgggtcctgtagcccaccctaggaccaagcccggccttgatagttccatgaggtcccaagcacgcgtccacccgctacagggtgtcccacctccagccaagaggaatagcatgggtgtgcatgtgtgcatgcacatgacttccaagcaaacgagccctcccaccaccacccaccccgccctgcatggccaagagtgggaggaagaaaggaataggaagaaatccggcagtgctgctctgtgtgatgggtcaggtgatggctccacctaatgtctgctgagcaattattccgggagaggtgccccacacgttttattttattttttatttattatttttttttgaggcggagtctcactctgtcgcccaggctggagagtgctggtgcgatctcggctcattagcaacctccacctcctgggctcaagagattctcatgccttagcctcctgagtagctgggattacaggcagacaccaccaggctaggctaatctgtgtatttttagtagagatggggtttcaccatgttgcccaggctggtctcaaactcctgagatcaggcaatctgcctgcctcagcctcccaaagtgctaggactacaggcgtgagccaccgcgctcagcccacatcttttatttgcctgtccacaactccctaccccaaacccaaaccgtcagatgtggtccaaaattcagactttttcagattctagaaaggtgagacagtgcacttgctgcaaatttgggaacactccagcagcagtcaggcacactgatacttctgcagcaaaacatatcggtattcactaatgtgaacgaaataaagaccataaatagcttcacatcagctcaggtcaaacttggctgccaaatacattacagaaaaaaaaaattcaggtttctggctttctggaattcagaattgtgaataggggattctggacctccactgcctctttaatcttcctggtgaccctgtggggtaggtactattgctactcttgcttcccagagaggaaagtgaggcacaaagaagttaagaaataatttccccatagtctgtggggcagcagggcggaaaccatggccatctggcctggagggtctgcactctccatccccagggtgtcccatagttgaccaaagtacggagctgcagtttaaaagcctcctgaggctgggcatggtggttcacgcctgtaatcccagcactttgggaggccgaggcagatggatcacctgaggtcaggagttcaagaccagcctggccaacatggcgaaacctgtctctactaaaaatacaaaaattagccaggcatggtggcacatgcctgtaatcccagctactcgcgaggctgaggcaggagaaacacttgaaaccccaggcaacggaggttgcactgagccgagatcgcgtcattacactccagtctgggcgacagagtgaaactccatctcaaaaaaatttaaaaataagtacaataaaataaaataaaataaaagcctccgaaaaaagagtggagcatctgtaaatgtaccgagtgtccacagcctgccccaccacgcggtgtgatctatgggccagcctccaccaggaggcactcacctaggagttacacaaaccctgagtggcattcccacacctgcccagagccttgctggagcccaggagcccaaggcggtctcccaccagcaggtgaggctcaccaccccgccgtggtacacaggtaattactccctacctgacacagtctgcacagatcattttacccacaacaaatatgctaaacacagccccaggccaggagaaacatgctgcaggtaaatcccatttgacaggggctgaggcttccagcaggactcccagatgcctttgggaggagtggtgaccccatcccatcaaaatgacattggagccccacgactcccctggtcatctccaacttctcttgattggcaattttttcacccactgggaaagattgttgcataggcaaaatcctggcattctattaccaaataattacatgatcatttcataggcattaagacactcccaccagcgtgagcggtggtgtccagcgctaaccgaggctggcctggactgcgggtgcttgttaaggagaactccagcattgaggaaaacctccagctgcagctcccacactgccctggtttctaattaaaaattaaagcaggcatctttcctcagaaacccaattagcatcaagctgatggtacaaacacacatgtgcacaaacacatgggcacacgtgtgtcacatgcacatgcttatgcaaggtgtgcaaacacgtatgtatgcatgtgcacacacttgcacatgcacacaaacccttctgcccatggggggctacaaaccgccatctggtcatccattcagtctaccctgatgaggattcaccaagcatcacgcactccacgtgccccacaggaagaaacccagggccctgccttcaggagcatgagctctaaaggaggctgaggaaagtgcacaaggtaagacagtccatggtgggaccttaaaagggtccttaggaagcccagagagctcagttctggcagggtgatcagggacaccctgagacatgaaggcctgctgctgggtcttaatttatagaaaaaaatataaaaggccatggagcaggtagagaaaatagccagagcaaaggcaagcaaaggtagctggcactctgagaacaaaaattattctgagtgaaaaataggcaggtggaaaacgggtaaatgtagataacacaagagttctagcatgggtacttttttaaacctatatgaatttagctgtgtgctgagcaaaaagaaaatttgtgcacaggatctgagataggaatgagtgtgaaacgcaaacaaaattttgctgtgcagtccaacagctgatgttccagtaacctctcctaaagcaagtgtcaccgagtgcctaagggatttgtggtgtgtgtgtgtgcagagcacgcagtgtgttctcggctggggagcagtccagtcggtaatcctggccatgtgcatacgtgtgctgcagccgatgtgtacacggtgcgtcatcccactttacaagggaggacagggtggctctgagacgtgatgtcactctactggaaacacaaaaccagtcagggccagagcccacatctgaccccaggcagtgtggcccagagtccaccccctgcaccaccaggcggaacagagatgtgaacaaagctgtacttcagggaaaataatcaggcaggggtcctcaaggtggggtgggacaaagtgaaggcacagaccaaagcccgagaggcagccacgcagtgctgtgcagaggggcggaacggggctgcagccacagggatgctctgaggccttggaacagatgggaaggcagggaagagggcaccaggggactctgcggtctgagtgagattttcttcggtgactacagtttgtgagctcccagtggccggtttgtcttagaaagggactgagtcccagcccttcccctccaatcatgaccacccctgcttcctccatcttgcccttggtgagagaaaactccagcacaccaagatgtcctgggaagtccatccttcccaccacccaggtagacaggatggcaagcaggcaactgaacagccgcccagggcagagcgggaggcctgtggtgtgtggaattcatctgctgtgagatgatgctatttcttcatgcaacatgaccagggttggaaagataacactggaaacaaagtcaacatttatagctggtctactaacatgctgtgtgaccctggatacatcactaaacctctctgagcctcagcttcctctagctgttgactcactcatgtacagaggacccactatatgccaggtataagctctgtagttggtgacctttgcagttggtcagtgctgcatggctcatgggtctgaagcccaccctggatcatgcaggagaggcacgtacccacccaggtgctggaaccattaacctggccatctttgactaggaggcttgggaattacagcattcagccactcccagaatcccctccctgctggggtgataaccagcactgggggtgaactgccccacccctccctcagcggtgccctcagctggaattgggcacgttaaaactcagactccgggctgccacggcccccacaaccacgctgcaccaccccacccccctccagctgcctgtgcgccggctgctgctgctgctcatttccaggcaaatgttctagttaattaaaacacacccaagtgctcacacgcacatggagccaagctacaaaatcagttctaccaaacagcagctcctctgctccagcctgggatcgatgcaggccaggacaggggttccaaagttgatgttactggcaccgagactttgctcataagaccctacctgtatacacacctgtacacaaatgtaaaagcatatgtgtgcacctacacacgagcctgtgtgcacatgcaagccatatgtgcatgcacatgtgtgtgttctgaacacgtccatgagtgctccacacacaacactgtgcagaggtgtgcaacatccacgcacacacgcacctgcatacatatgcatggacacactcacacaggcatgcacacaccccacagtgcccccttctccaggaagtcttctccagctttttgggccttccagctcagaacatcagccatggttagtaaataaacacttgctgcatgagggagagaatgaataaataaatgaatccactgatcaatgatacagtgggcaaacgggaacagcccacaagtacaattatgcatcaccgcagattggattttccagagactggaggcgcagctctgcccttgcagctgtgctgcagagctccacgaggcactaactgagatacacacacacgcacacgggcatgtggctggaaaatgcacattcccagatctggacatccataacaaccaggaactggcaagggagggctgcagtcatccaggctaggagacagaaatcagtcacctttaatgggactttagtcccagaagggaaggtgcctggaggtccacaaggctgcctgacattctgggactaaatcagacacatggccttcacacaggcaggtgactctagggaacaaaaacagcctggagtaggtcaatcctgccctagcaagcatgtccagtatgctccaggtccaccgagaccaccttgcaggtggccacttctgcagccacaaacaactgttctttatgaggacctgacactcatacacaaatgtcaaccacttgacaccctagatgggcatggaaaggatttctgttcatggagatggggacagctgtgctgggcacctcaaaccacatcagttgaacaactgaccttctaactcatgccacggggctggcaaagctgtctacagagagcaaaggacgtgagaaggagggtttagaaaggagtggggatggtggacttagcggccatgggagtcagccactcaaaatgtggccctggaccagcaactcagcatcacatgagagctttttagaaatgtagaatttaggccaggcctggtggctcatgccagtaatcctagcactttgggaggccgaggtgggcggatcacctgaggtcaggagctcaagatcaccctggccaacatggtgaaaccccatctctactaaaaatacagaaattaccctggcgtggtggtgcgtgtctgtagtcccagctacccagaaggctgaggcaggagaatcgctggaacccgggaggcgaaggctgcagtgagtcatcatcacgccactgaactccagtgtgggcaacagagcgagactccaacatagaaacaagaaaagagaagagaagagaagataagagaagagaagagaagagaagagaagagaagagaagagaagagaagagaagagaagagaaaggaggggaagggaggggaggggaggggaggggaggaggggaggggagggaaggggagggtaggaggggaggggaggggagaggagaggagagagagaatggaagggaaggaaggaaggaaaagaaagaaaaagaaaagagaaagaagagaagagaaaagaaaaggaaaggaaaggaaagaaaagaaaagaattttgttgccaggtgcagtagcacatgcctataatctcagcactttgggaggcaggaggattgcttgagcccagaacttcaagaccagcatgggcaatgcagtgagaccctgtctctataaaatttttttaaaagtagctactagggaggctgacgtgggaggattgcttcagcccaggaagtaaaggctgcagtgagccatgatcacaccactgccctccggcctggataaaagagcaagaccctgtctcaaaaaaaaaaaaaaaagagagagagagagagagaatgattagaaatgcagaatttcaggtccacctggagctgctaaataagaatctgaatttcatacattccattagtaattatgttaagaatgaaatgaaaatatgacattttttggccaggcgcagtggctcacacttgtaatcccaacactttgggaggccgaggcgggtagatcatttgaggtcaggagttcaaagccagcccagccaacatggtgaaaccctgtctctactaaaaagacaaaaattagctgggcgtggtgatgggcgcctgtaatcccagctactcgggactctgaggcaggataattgcttgagcttgggaggtgaaggttgcagtgagccaagatcgcgccactgcactccagcccgggtgacagagcaagactccatctcaaaaataaaataaaatattacattttatttgaatgtatgtgttttattttttttttaaagctactatgctgttaggacataaatatttaagttgtttagacaactgtgaggtttttgttttgttttgttttgttttgttttgttttgcttaaggggcaccataaaaaagttaccgacactaaggtgccatgaactaggaaagtggggcgttcgagctctgtatcaggcatggttttgggtgatggcaaaacagcagagaatatcacaaagtccctgtcctcgtggagttgacagtccagtgggggaagcaacaataaaccagtaaacaagtgactgggcaagatgtcagggaactggaatcgaataaaaaaattaagcagggcaaagtattgattgccacctaccatgtgtgaggcactggcctcccatgctgtcctccctgtgccaggtgcctgatgggtgtctttcctccctctcctcacccctgcactgggaacaacctccagctcataatttgcactgacagatgttgggtatggctgtctttcacttgaaattttcaaagatctcacagaggtcctgtaggttagctgttgtgccctggggtgccacagcacacagtttggggaaaccaatctcaactatttattaagtgaatgaatacaaatcatgaagaggatctgacatgagatacaggaatcaattctcaatccatacaaatgctcagagataccttggagcactggctcacaacaccagccctcactgccctgagcctatcaggctctctgggcctcagtcaacccagtggtacacaggtcaggagcccacagtgactcgcaagcacactcccgggctcaagggatcctcccatctcagcttctcgaatagctcggactacaggtgtgtgccaccatgcctgaaaaattgtttttgttcagtatacacagggtctcactatgttgcccaggttggtcttgaacccctgggatcaagaaatcctcccactaatggcagcagcacccagtctggagcgaccgctgcaaagatgccagctgcagttggggaggcatggccagggctgcgccctccgtggagctggcgggagccggaaacaggtgggatctctgcccccttccaagttggcagggtgggatccccaccctccccagcacagctgcagccacctagctcttgggagcctgggaggcccccctctcctgtcctcacaggctcggaagtgcctgctcctgctgcctggcttctccctgctcccagcaccctctctgattttggagcaaagttgaggccaagcccagacactgtcatgacccggccagatgtgcatgcactcagggcagtgctgacatgccagccccctgccacctcagccccctccagacttttggtgcagatgagcatgggagggacaccaagagggagctaagggtggctcagcgtgggcctgcaggtgcccctcggcacaaacagtctgggtgctgtggatgatatgattgatggtggcaggaagcagacaggctcctgagcagaaaggggcgggtccccagtgaagccccacgttctagccagaaatggcctgaaacctggggtctgggctgtcagttccaggtggagtcccagcccagagtgagaacttatggtgctgtttctgggaccacccaaggatcaatcagtacgcacttcctcccttctgaagcccattacaccagactcagccagactcacagagatgttggaactaccagctgcaggaaggagctacccacttcgggtctcctgactcttcaggacaacctacctgtggaaaagagctacccactgtgggtctcctctgagctgagagctggacacaagttagtacaacctgtctgtggaaaggatctacccactgcggtctcctctcagctgagaactagacactcatggggacaacctgcctgaggcaaggagctacccactgcagtctcctctccactgagagctggacctgcctgcagaaaggagctacccactgcaggtgtcctctcagctgagagctgggcacttgttgggcgacctgcccatgggaaggagtggcccacttgaggtctgagaggtgttctgtcactcattgaagctcctctctgccttgctcactctccagttgtctgcatacctcattcttcctggacatgggacaagaacttggtacgtgctgaatggcaggacggaaagagctatgacacaaacagcacggaaaaacactccctgcttaccatgttgcaggcaatgagaaggacagaagagctgcagcccttcggtgagcccagacctagaggctccccaagccagggctgtgacaccttccttggggttctgtggttcctggcatctccaagcttccggacaccactgcattccccagtactcccagtggaagccacttacagtacacctggtccagccacagcctcacatggaaccagcacatggagctgcccgccccaccacagcagccagcatgcctggctgtgtgaagtggccggacttcatgctcacttgcctcacggctctgcacctggatcacccttggcaggtatgggatccaggctggtagcatgagccgagcacagcctgccaggtcaagggtgcagaacgagcccagcaggcatgagcaatatagtcaggcagaaggcactgctggccacagaggtttctggctggtgaagcaacaccccaaggatcctgtgacaccaacttaggctcccaaagtgctagaatcacaggtatgagccaccatgcccagccaagggcaaattttctaagaaatgtcggtgtccaaacagggcccctcagctctgcacaccttagagttggagcagcagacctttccaagtaggagaccaacaggctcgcccaaactcgacagtcagggattcccacttctggtgaacaaagcagaaagcactatgtggcggactcagtacaaactccaataggaaaggaagcgagaagtgaagggtggatttggggaaaaccaactgaacaccaaggtatcttttatcctaagccatgactgcagctgctctagtttggggaaaataaaatccaacagcatccagactacacagctcccatgtctaaataacaaaatgaaacatgggctctcttttggcagctttcttccccgtcagcaggagaactttggtaactgagtgctttttggggatacagagaggggagaaaaactctcatgtactcacgctgccaagttcacatcagcgacaggctttataaagcaaatggggcagatgtataaaccttggtgctggaaggatggactgggagattaaatgacagggtgtgtgcagcaaagtagagactaaatgagacctcaggccggatcgtttcaccacgatatcagggacttcaaagggatggctcccaggcctggcctgccagcaagggcagcccacaggcgtgcccacccccacagcctcggccactcccccaggtgcccatgggttcctggaggctgcagggatctgaatgctggcttcctggcctttcatattatgattttctttttctttttctttttaagacagggacttgctctgttacccaagctggagtgcagcgatgcaatcatggttcactgcagcctccacctcccaggcccaagagatcctcccctatcagcctcccaagtagctgggactacaggcacgcaccaccatgcccaacattatgattttcaaatatcagaattctttctgtacctaacaagctcccacccctcacagcccccatgtctatctccccttttgctctctgcctcccctcatccttcctccattccctccatttctgtcctctaattaccccccagtctcctgttcctcctccccttccccttcggaagccagctctcaccctacccatgtctttgctagcactcggccagtttcctctctgctctcccagagggtctgtcctgcctttctgcctgctcctgtcttcagccttcctcctgcccctttttctctcaaccccattttcccccaaccccattttccccccattctccaaccgtctccctggacctcaagaaagaaagtgcaagagagtgaatgaccatgctagagcttgctgtgagtgccagggctggccgagcacatcccacccctcctgctcaggaaaggagggtgggtgcagaaggcccggccccaagggagagccaagggatgccagatcctcccggtccacacttgcaatgccagggtctggagcagggacacagcctgagaattcccttcacctccctctgcagcaactgtcctggtctaggatcccaggagaggccttgcatctggcctgaacagaacctctgacagatgggatgccgccccgagtatgacaggaggacatgaaagatgggaagagaggagaggttggtggggatgctgagccgaaggaagaagcagaggtcagtcatgaggactgcccaggttcaaacaccatccctgctactccctgactgtgtggccttgggcaaattccctagcctctctgagcctcagtttcctcatctgtaaaatgggaacgatgtccaaagaactcaataaacagcaattattttgtcatgatggcaattcttacatctgcactgtgtattggcggctctgagtgggtgtcaggacttcgacggagtgggtatctaggagacgcccctaccacaaccagcgcagagccgcaaccccaccgggcacccgtgtcatgcaagggagcctcagggctgagggagccgcttttccgcctgtgccaataaagaaggggcccttctctaggctgcagagctgcagtgcccagaggagtggggacccgccctggccatctccctgtatttctccccagtaataatcttatgaacaggtggcagaggggtgcctggcgtctgcctccaactttgctatctgactattcactcaacaaatactcagctctcccgtgtggatcagtggggcattcaacagtgaccaaggacaaggcagcccctcaaggagcccattgtctcctgcaggagacagacactgaccagcaaattgcaccctggaagtgtaaaatcactactggagaaagagctacaaataactaaatacaaatatattctcatcttaatattgaaaatacattcttatacttaatataagtgtattccttctttggaatcgcaaatttcaggatgtgggcggtggaggagaccaaccctcatctctagacagagaacttgacacccagaggacaaaggaccaagttcactcagagccgcttagtggtaacccagggctagaattcagttctcctgactccaaattaaagaagtgctttcctctatgccacaaggtacattgagaatagttcccttaggggctactgtccaaaaagaaaccgggaggaagaggggccccctgggtgattccaatatgcctggtccgatgctcaacacttgacccacacctagcaccagctcctcgagagggcattaaaagcagctacaagacagcctggccaacactgtgagactctgtctctacaaaaaatttaaaacttagccaggcatgatggtgtgcgcctgtaatcccagcactttgggaggctgaggcaggcagatcgcttgagcccaggaaccagcctgggcaacatggcaaaaccacatctctactaaaaatttaaaaattagccaggcttagtggcgtgcacctgtagtcccagctacttgggagggtgaggcaggaggattgcttgagcctgggaggttaaaacagcagtgagctgtgattgtgccactgcactccagcctgggcagcagagcaagatctggtctcaaaaaattaaaataaaataaataagagcagctacaaggaccacagaccacagatgcaggtcagaccgtgaactccctgggcaaaaaaagcagaatatattagacaccctctggttggaatcctgtaaattctcatgtgtgcagacaaagaccaacacaaaagaaatatcatcaggaaaatagggtgtttgggtaatgaggaatttttttctcaaaatacaactaactgtgttgtctgagattcatccattgaattctcaggttgtaagactatagccacatggccagattatatcagggatatttagattctcaaattgccctggggaaaattaaagagacatttgtaaccatcttgaggatgtccatgccattaattaaatgttgaatggtgagggaaatgggtctatggtgggtgcctgatgttcccattttacagatgaagaaacctccccatggtctgcccagacctggtcatgcctctgttaaaagtctgctttgggctgaagatgaagaaaagagaagctgagcccctcaaggttctggtcaggatgtgagtggccccaggacgtaactctccttcagcccagagagcaaatctaggacccaagagcagcagtccagttcatgtagggggtggaacccgcatcttcctataagccctcccctcagcttgagccctgggcccctccaccaggttaagcagcaccccacttccaccccagcccagctgcaagaaggagctgccaaagttggtggacataaatgagggggccctgacacgcggccagctggagtgtgtgagggctggagccaggctctgcacacaccaggcaaagcagatttccacgcaatctagacagcgggcggaatctacagcccagaaaggcaggggcacgcgaaccaccaacaccggctgatggctgtcctcaggctcagaggcccagccaggccagccaagagggtttacaagggagtcaggaacactggacaggctgcccccatctggggccataacaagcgggcatccggcagcccagccaggcacaacagctcaagctcaagctcagggcctccctctggaaggtagcagcccccaaaactcaacatctgaagttggaggaggaggcagcccagggcagaatcttcccccatcaagcagcatccccatcccagcaagttttaactgatctgcagccttctagagcaggtctccacaacagatattaacaaggcacctactgtgtgccaggcatggactaggtgggctcagctagggatagagcaatggaggttcctgctcacatgcagcatggggtcttgaggggactgagcagcagccagggtctagttccttggactgacaccccactgtccctaccagctttgtcccccaggcccctgccctggtgcagttcagtcagaaaaggggaaagacttctctgcctccaatcctattcctccttcagcgctgtgtatttcaggagagacccctctgttcacctcgatgcccaagccaggaaaccagggatcctcctgggtttctccaaaatttaatccatttccacaccttgtcaacgtggtccctaggacggctctcgcacacaccctctgttctcggtccccactgcctgcagcaccatcctctccatgtccccacctgcccacgcccgtccttgacagggcattggcaggaactctgccaaggatgagtctgaggatgccaagacccccaccacccacactgctcctagaacataatacaaatgccccacctggtcccacccgtacacacgctctgctggctcaccacgctcccccatgctgcctaccaccaatccccccaacatgccagcgccctcctgacttgcagtcttcaaaccttccgtctggatggctatccccataatttctattcattgtttcgccctcgtttccagtgtccattcttcaaagaagcctttgcttctctctcatgccccatgctcttccttccagatgcttccacgcctagaagataaacgtagctatttatggggtggtttgtctagctgtccttctcccccacagactggaagctccacagggggagagtccaggcctgtccagctcactgttgtatgcccagcactcagcacacagcctggcacaaagtaggtgctcaattaatatgcattaattcatattaattatgaaagtcctgctgcttgagtctcgggtaggcaggcaggaaggccagcctcgcaaccttccttagcatcatccaaagtgcaaggcgggtctcacagaggctctgtcttccatgctggggcaggaggggaccacaccgtcatgaataccaggcacgtagtggaggtgacatgaagcctcaggtatcatgtacaaaaaccttctggccctgtggagctcactgccaggaagcagccctgcagccactcggagtacacaggcctgcgtacgccccacacggaggatgcaggtcccctgtcagtgccctcccagcctttcctgccagacccaccacacttgagtggcctggacgctccaatcaccccctctcccaccacacccaggcttcctacctgccaggcttcctacctaccttactatcactgtcccctgaccaaggcagacctcttcttctcatctctaagagatttcccataaagacccaagtgactggcttctcttggaaatctagaagccatggacaggaacagatggaggagcaagcatgatctcgactcaccagccccgccagcctgtacccatgcttcctcacctcccaggcagaacccccatcatcatcagaacctgcgatccctgcaccagcctcgcatccccatcccaccttggatcgcatgttcctaaccatggagaaggcctcaccttctcatctctgtctgccccagggtctcctgcctggagggaagccccaggaagggtgtacagaagaaccagatggcgacaccccctccatgtctgccacctccccacatctggcagagcacccctatttcatcttgggtacctgagttactgttcatacaccacccccgtggtttgtcccctatagtttattaacatccactaataaacagtgggcaggcctcccagggcgccaccaagagacccctggctgggtgggcagggccttccttgtcctgccctctctcaacacatttttcaccataagggaacaattaggaaaaactccctccaggttatatttaggaaggggtggaagtgggggaagcttcctctagtaattttcattcagttgcacaggactgcctgtccccacctacccctgggctagcactgcagggcaggcaaccgcctctccccacacacgggtgcaaaccaagcccagcctctgcccagccctgattatgcccgcgtttaaaaataagatgtgaaagatgcattatgtaagacctgtaacactctcctgcccacctccgactctagaatcaaagatcttcatttctgccatcaaaaaagaatgaaagaaaggcaggaacaatgaaaatagctgcccaacatgagccagatcaaagacatgggcacagaaaatgaggaaccaggggggcctttaattactgcctgcatcctccgagtcatgtggagagaggggagaagaaaagttttgaaggccaccaggttccgtcctgctgcggctcctgtttccacagccagcaccagttcccgacaaactcgtgcctttcatttccctcccttttttccctcctttttctctgccccccacatgtgagacaggactcccagactccccagtgcttgacgtcctccagcagagagagctcagaggggctccttggagaccccaagggagggacacggctgcatcttggaaggtcctggtgggtcccaacccatctgccctcccaaaaaacagccagagggcctccaggagggacccagggacccacagtgggagcgggtgctgcagaccacggtgcggttttttttttttttttcgcaagtctccctggttgagagggaaaaaaaaaaaaaaaactcttcaaattcacattgggcagggctccgtggggcagcagatcaaacctgaggcccggctgtttgagctcagcggcagaaaaaaggattgcccagggaccgagcttaagtagaagctggattaaacttcaaacacaaactcctcctttttctacacagcagacagtcatggctaatattgcaatatggactctaaaaatgcattacaaataacttactctggacccagacttgggtcttttgtatcaaggggaggagcaagagaaatcatttcaacagaaaagacataggagcccgccctcttgctccatagagggaagccgctggaggtttgggccagggaggccagcgagatccccgagtgacgggaaccttcaggaagatgtcttgctggcagcccgggcggctcccccggaggctgaatgaggcttaggtcttcctaagttgggagactctatgtatattttatcaaggaagaaatgccaggccaaggtgaccaaaacagcggtacatttcaaatgtctagtgacttaaataattaaagcatttacagcactcatgctcttaaaacacatccacaaacaatggaagatgattgtgttattcacgtgataaatgagagactcaataaaaaaggaaaacttacaaactcccgatgccagcaggcagtgtggtgggtggggagcagaagacagatttcaagctgtaggattggcttctttcagcacctccagttaccctgtggttggtgtcccatttctttgagaatggccacgctagtatccactccacggaagctcctgggccagtggctgtcctccagatactagcaagagcctagagctggaccaggagccacctgcactaccctggctcccgagacagcataccaggcacctcaggagatcttggccaggagcacagccacacaggtgaggatttggaggtttgggtgtagggatgagaaggatttgttcctactgatgtgttgattcatgtgtttacccggggcatgggtctaagattgtgttgtataataaagaatttggggctggacacagtggctcatgcctgtaatcccagcactttgggaggtcaatgcaggaggatggcttgagcccaggagttccagaccagcctgggcaacatggcaagaccccatctctacaaaaaaaaaaaaaaagatgggtgaggagaattagccaggcgtggtggtgcgtgcctgtggtcccagctgcccaggaggctgagtcaggaggatcgcttgaggggtcaaggttgcagtgggctatgatggcaccactgcactccagcctcggcgacagagagagagaccctgcctcaaaaagaaaaaaaaagaatttaggccaatatttgcaaagatatgctgctttcctgaagtattttcagaaacattaaaagcgtgccccacacctccgtgacctccaggaggtcgaggggtgtcacagtgtctgtgacggaacaaggatattgccctctccctacactccacaacacccagccagaggccaagaggccttgagagttactgcaagcaatcccgtgtggcaccccgggggccccaaaggcatggtacaccattgctggtatctccacacaactttaccaaggtcaggaacaggcaggtggtacctgaggaggcatccaggctggagatgcatctgggaggggtggctgtccttcccccgaccaaaaaaccaaggcagtcctccctcagaatggccacatctctggatctcacaagtcctgaaaggctcccaggcagtgacccagctctgccaccagatagctcaatagccaaggacactctcccaggtccactgaggatggtagcctggactgtttcactctgccccacctgccatccccaggaaaggcttcctctccacaccctactccacctccctgcacccccaggggtgtcctgttctacacaaaagggcacagaaccaccatctactaagtgcagcccagtgtacaaggcagtgtgccagcccttcatgcccattactgccctgaaccctcatcgccatgcaagagaggcttcagtggccccatttcacagaggggtaaactgtggctcacaaatacgttaactgctaaagactgtgggcagagaaaaaatgtgaacacagaactgtcaagatccaaatcactgggaggccgaggcaggaggatcacttggggccaggagtttgagaccagcctgagcaacatggtgagatcccacctctagaaaataaaaagccaaacatagtagtgcacacctggagtctgactacttgggaggctgaggcaagagaatcgctcatgctcaggatttgaggctgcaatgagctaagatcgtgccactgcacttcagcctggacaacagaccaaaactctatctctaaacaaaaaacaataataattcaatttatctgcttttcttttcatgatgtgacatcatctcccaggaattcttcagagcttccacccctattaataaatccccttgcagagaaagtactgaccagaggggttctggaggaggcagcgagggggtaccactgggttaccattggataaacaaatggattatccatgcccgacaggcggtgcctcctggaagccttattacaccctataggggcacacagagaggtacccccgagcgctcccaacaggagtcactggaggatgggagggggatggagacctggaaacaaggagatggcaggcccgggtggagtgtggcaggtagaaagaggctgcagctccagagacagccaggaggtcggtgagcaaactaaagcaacctgtttcaccagccgcaggcctggggagcgtgtggagacaggagaggtgagctccccggcagcccatggctccagcctgaggcccaggcatctgaccagagacactgatgacatccttctcagaagcagccgtcggagggggctgagcggcccttagtggggaagaatcagccgaccagggcagagggcccgacagagggagtcagacaggtagacatagagagtgggttcatctatcaaagccctcgccctcttggcaagttctgatcttcgaagtttccaacttgtagctagaaaagtggccaccttctatgccccctcccagttgggaggatgctggggtctgtgcaaatattcactctgtgggatggtacaacttggtgaccaagaacttgggctgtttgatcagaccggcatgggtttgcctccaagctccaacacatcctggctgggtgatcgtgagcaagttactgaacatctctgagcctcggtttcctcataggttaaaacagaggatcctcggccgggcgcagtggctcacgcctgtaatcccagcactctgggaggcctaggcgggcggatcacgagatcaggagatcgagaacatcctgggtaacatggtgaaaccccgtctctactaaacatacaaaaaattagctgggcatggtgatgggtgcctgtggtcccagctactcaggaggctgaggcaggagaatggcgtgaacctgggaggcaaagcttgcagtgagccgagatcgcaccactgcactccagcctgggcaacagagcgagactccatctcaagaaaaaaaaaaatagaggatcctcaacgttcacaagtaacagagatgttgagggtatagaagatggggtgggtggctgcacaagggaagcgccattatgcagtgactataagcctggggctgagcacttggcctcctcctgctgctgagggacagggcggctgtggccccctatccctacactgccccatttcttttcttattttgtttgtttgcttgtttgtttgtttattgagacagggtctctcgctctgtggcgcaggctggagtgcagtggtgcaatcgcggctcactgcaacctccacctcccaggctcaagagatcctctagcctcagccgccagagtagctgggtctacagatgaatgctaccatgcccagcttatttttgaattttttttgtcgagacaggcatctcactttgtgttgctcaggctcttctcaaactcctgggttcaagcgatcctcctgtctcagcctcccaaagtgctgggatgacaggggtgagccaccacacctgacctgccccatttcttatgcagagcacttgacatatgaggacttcttcccatgggctataagggggaaaacgatgaggctttctccttccccactcctctctggcagacccccagcacacagcccgatgcagagccaagaggtctgccccaggaaacaacccaaaaaaaccagagtgaagccaggcccaagaccccacccaaactgacgtgggacgagggactgaagtccgatcggtgttggacccaagaaccagcaccttaacccatgcctgacccccactgcctcctttcaccacgcagggtggagactgagaagcctgcagccgcctcgtccatcttgctaggaggcacagaagccaagggaacagccacacaggggaaagcttggagaaaggatgaggaggaggcaggggaagctacaatcctgggtggacacccctgaaggacaggcaaatgcccacccactcacaacatgctagacaaaaggccactttcgagtttttaacatatgcccacatctattctctctatgcagtctctctgcagaagacaatattgtctctagtgtttagatgagaggtgaagaataagcaaagatacctcttacatctccatgaaggcaagggctatttccttcacccctgtgtcctaagcttagcctagcactgtgccaggcacatagtaggtgcttaataaatgtttcttgaatgaacgagtgaaaagcaatcgtagaatgcctctgtgagttccacaagggcaaacattatgatgtattcacttgcttggatgagccatagagttcatgaataaatgtgtgaataaataaaaagagtgatagctaacattaagtgcttattacatgccaagcattgttctgagcactttaaattgattaacacatttacttctccctccggcttccccttcctacttccctcctttccattcatcaaatatctattaagcatctttattccctatgctaataataggggtccacagaaatgagcagggtgtgggaagaacccgtgagtatgaggtatatgctatcgttagttccattttacagatgaggaaactgaggctaagagaattaagttacctgcccaatgtcacacagtaagaaggatgcatacgtgggattagaacccacagtcaggctcctggtcctgtcttatgcgtgaataaggttcaaaggatgcttatcaatgaccgtggtgaaatgctccatgcttttcagcctggccagcatctatccctgcattctgtagaccagccctgtcttccttgagcaaacactccctacccgctatgtgattcaggtacttcaagcctggccaaatagcactgcaccctccagccacagtgattggcttaaggatgaatacatgaccaatccaggccaatcagcgtgaatcctgagacctcattacactacaggaaagagatgctctacctcagcaaggaggctatgagcttggggccaccggaggaagggggattaacttgccctcttttaggaagagcctggcagagaatgaagccaacaaaaacgaaagcagagacaagaacactagagagatgaactcctaaggatccggccaggcctgaaggtttatccttaagccagtttgagatgcgactctattccttgcaaatgaaagatgcctgcccaatactattattgttcagttcaacatccttctcttataaatgaaagctcagagcaggtcagtaacttagtcaagctcatagtcagtgtcaatgccaaggctagagccaagtctcacgaaaactcctctgccagtgcaacattcctcctcagtctgtctaacgaggttctccccatgccgtgatcatttctatggacccctattattaacataggaaataaggatgcttaatagatacttagtgaatggaaaggagggaagtaggaagggggagcaggagggagagggagggagactgaattcccagagatcaaaacctgttcttactcagcttggtatcaccaagtgcccagcacagtgcctgccatacagagacccctctaaaaataatcagatgtgtggcgggctgaatgcacagaacaaagcatgagtctttgctgtgccaagagaaacagagagggttccattaaatcccccaattgctaggggcactagcagtagaattggatttgtaaagctacacacatgattttgtgcctccagccctgaacacctttttggccacatggtaaaaacatcctgcctctgctcatctgcaagcagggattggaaatcatgccccccgcccctgtgctcagctgccttcaggggataccttttctttcccattcttaatacccccagacttctaagagtcaaatcccctatgccttcctctcctgcaacagacacaccacacatagaactccactggcctccaagggaaaggaagggaggccctgccctcctccatccaggaagggctctgatgccctctggccagggcaggcaccgccagccacactgagggtggaggattactcctaacagcatcttgaggtagggtagggagagccttgggaaatacttgtgagcatttccaacacacaaaatagggtctggtttcatgtgaagaaatgtctctctgcaactaagggaaaccaggcaaaatatgaccaagccttacaaatacttgtccacctagtgaagacgtgagagtgtggtcctcagaggcagcctctggctcccacatccatattccacttaccctgagacccacagccagtcccttcccctccctgggcttccattccccagttctgcaccgagcagctcaggcgaaggatccctcagcaaccttacaggttttggtttttgtttttgtttctgagacatagtctcactcttgcccaagctggagtgcggtggcgcgatctgggctcactgaagcctctgcctcacgggttcaagtgattcttgtgcctcaacctcccaagtagctggcattataggtatgcaccaccatacctggcttaatttttgtatttttattttattttattttgagacagagttttgctcttgttgcccaggctggagtgcaatggcacaatctcggctcaccgcaacctccacctcccaggttcaagtgattctcctgcctcagccttcccaagtagctgggattataggcatgcgccaccaagcccggctaattttgtatttttagtagagatggggtttctccatgtgggtcaggctggtctcgaactcccaacctcaggtgatccgcccacctcggcctcccaaagtgctgggattacaggcgttagccactgtacccagcaatttttgtatttttagtagaagcggagtttcgccatgttggccaagctggtatccaactcccgacctcaggtgatccacccacctcggcctcccaaagtgccaggattacaggcgtgagccaccgcgccaggccccttactggtttttattttgtttgttcataaagcaaaaagagtactcgctctggagcctggagagtgtggactggaatccagactagacaatttagtacaagaaggacaacagctactactgagtgcttgctctgtgccagccacactccaagctcttgcatacattattccaatgcatcctccctacaaccctgaggtgggtactattattatccccattttatagatgaggaaactgaggcacagagaccttcaggaaattcaccagagtcataaagtctgcaagtgctagggccagacgtgtgatctcagataggtttactcagcttctttgaccccagtggactcatccgtaaaatgggaacccatgcccaactctcactgttactgtgagaacccacaaagggaatgaagggagaaggcatggagccctggaactgttcttttcctttccttcctctcgcttgaatgacaaaggtcttcacgcctgctccccagcctcacaaagcaggtagaaaagtcattgcgatggtggggggtggggtagcaggctcagaattcagtgacaggcatcctcatacatggggtattattattgctgttattattgacatgaaaggctagaaggctctgatttaagtaattgggccacaccaagctctagctccaaacaaagaaagtgaaacaaggctaccagagaaggacctcataccaggggctccccatggtgccagattccaaaaacctgactccatcagccccgctctcaaggtgtttttctacctccagtggctttgggagaaggaggcccaggcccgccaggcctggctggcctctcccctagcccctttgaagtgcccagcatggggtgggctggaaggaaaaccctgggccacagaggctgtgacggcacctacccacccccacccggctacctccccctcattgtgcagcctgactgggcctttgttgccagagtcctggcgggggacagccagggacctggcctcattaagtgcctgacctcaggcaagccccccccacccagggtggaaggttaatgtggctgcccgccatgcaggcctgggcctccaggaggctcctcgaagggacaaaggaccagccccctgtctcctctccaggccccaaaacagctgccagcctgcagagcgctttcaggaggggggctggctttgatggctcagaagtcaccaggggggcctcctttccaaaccctccttcctcccaccctgtcaaggagacaaagctcacagggaatcgccggagggttgacgcaggaatgcagtccatcgtgggggaggaggctggctggtgacgggctggcccacacctttcttcgaccttccagaattccccagggctcaggaccttgcttccaagcaagactcatttcagccctcaccaaggtgggatggagtagacaggacaagtggtcagaataagtcagaagcctctcagtccctaacccaccaggtccttctgtcacctggtttctgggtacagaactgatgtcacctaaccagagatgggctgggagcagagcagctcccagaaagagagagaaggccaggaatcctgtgcaagggaacaagcacatgatgttttttaaaagtccctctggcttatcacatcaccttctaataggagggctcactccaaaatgctaattacctaccaagtaggctcctggagtccaagccaagcaccaggtagaaccacctagaaggccattcctgatcaattccctcatacaatttccagttatttggaggcctgcgtctcgtatgccagactgacacgcaggtttacagcacactgattttaatttcaaaagactctagggaaattttttggagtgttttatttgcttaagatcctggagcaaacacaggggctccctggggcacaacaggactggcccaggaagcagtaccctggaccgtgcagtgggatgggcaggagtgccagagttgtgcgttcacgcgtgtttctgcaagcaggtgtgtcccagcgtgtgcacgttgtcagtgacacaacaaaaggccagctgaaagccttacctacggtgcgggcaggcggcatgagcccgcggtgatgcgaatcagccttaaccagcccattgttggggagcaatgcctttcaagggacaaaaggcagagggggcaggaggatacacggggagaggcgggcacatctgtctgtggcatgaaccactgccccattacgccgcctttccccacagcagcatctgggggtgcgtgtgtgtgtgtgtgcagggaccagcccgactccacattgtcctgcccagccaggagatggagagtgcggcactcttacaaagacatcgattttcttccttcccttccagagcaagatcagatgagctcccggagtgacacgtccttaacttttcagtggggttttctttttctgacttgtttgtttgtaacatttttttttaaaccaggtctctaattgtgtcttttcttggctgcatctcctttgctcccgccccccgaagcaaggagggcatgtgctgattatctgagtgtgcagcctgctcacggggcatcctgggctctaagaatgccagggggttagaaactggggaggggtgggggaattaattgccaagaaaacacaaggctgtgctgcgactttgattccatcaattaccattatctttctccgcaggtccgccaaccatcccccgatccggccgtgtttaactttctttgccagtcgtgataccccgtcagatttctggcgctgccacgccgcccgcctgggctccttctgggctcttatcagcctctcccagtcagtctggcccgccacagctgttccaggccctcagcccctcactttatctgctcgcacagacctcggcctggcaagcggtgggcccggcgcctgctccacattccccaggaagccagctgggaacacagccgccctgctcccggaccctctgagagttcattaccagccagggtaccccagcccgtcagccaaggtgcgggccgcgctgccgagcccggccgccggagccgcctgcatcattaaaactccaaccttctgaagagaagaaagaacaaaaccacaaatttagattaataaagcatttgttgattctacagcaatttagcaggcctctaagaaacccaccagagacccgcggagctccagtaattttctgttatattatctttcttgtaaaatacttccccagacagagtccccaaaggggctcaaatatcactgtgactaaccaaaatcaatgtgcactcacctattgacatttttacatagtttttggatttagtatccagccgaaaacacaatcacctcctctgccaaggagccgacaggcacttagctagtcagctattagtgttacaaagggaaaaatggaagcacccaggggagctgggcgaggcggcactgacgtcagggggtaattgggtgtctgagagaaattgccagcggctggccggctcccccgggggccgcacaaagctgagctgtaactctaataaaggaaaggaaattctagaaaagggggctttgctacaaaggagcccaggcagacgccaaaaatagccctttggaaataaataaataaatgcggccaaaacatctagatctaaaaaataaaataaatcactgctccacggaagctttctggcctcgcctccctggacatctgtttgggggcgcaaaggctcctcccacaccgtcccccgccccctgcccccgttcttccctggaaccacatggattttgatgctggaaggaggtttgccatctgatttggcaaatagtatgtgttttcaaaagaatctaagtttgtcatgtcctctttcccagaggtggtatcttcattgtttactttggggctcacaaggaaaaggaatttctattgtccggcttttagttgttttgatgttttcagttttgatttgtttatttttgagtgctcttaccatgccatccccactggatgaaaattgaaggggctctggctgcctggttcaggcctccttaggaaaagtctgtgttcttgggaagtgggctaaatttttatcttacggctcttccacccactgaccctgaggccaagtgagggccaaagtctccaagagggaggaggacagaaaaatagtggaccccaccccacagcagctcccgagccagggccccaggccaggatatcagcctccctggggagtctgcagccctcagaagacaggggcgaggggctgggctagaagcagggtttcaaggccaaagaccctctgagacccagaggctgccaggaaatccaggcctccttgatcaggcagaagagggtggcttggggaaagagatggcaagaatgggattcccagggtcagattctatttcatcgctttgaaagaaaaaggaaaaagaggcccaggatttcaaaaaaaaaaaaaaaaaaaaaacaagaagaagaagaagaaaaaaagaaaaagaaaaaagcagaatgcactccaaccccaagctacttggaaattggtcggaacaaaggtcttcagctaaaaatgtcaaatcagcaccacagggctccctgccctctccgtctccaagcccctgctgaagcccacagggcctgctgggagcagaaaaggcccctcctgaggtctgctcatggcccacagccccacccatcatgacaccccaggaggcacagggcttcctgactggggcggaggggcagctggaatacagggggccgttcctttcctgatggaacatccaggattggcactggggaggaaaatcaggctggagaaaggaaagggatcctgcaactcacagcccagggaggggaagcaatgctcaggaacgcagccgccagcgccctggcaccaaatcacaaaccttgaatcaatgatgcaattgcttaattaatcagcctgctcggggtgggtgcagaggatctctgtgagcatctgacccaaccagctcctgatgggcaaacccccctccttgggccccctctgctgggcccacgggaccacagatggttgaacaccgtctgggagtctcaccaaggggggaaaatgtgagttcctgagtcccctgtgtgatccagtcactctggcagaaaggagggaggaggcaggagaaaggaggagggaggagggaagagggaggagggcagaggagggaggagaagggaggagggtcttatcagcaacttagaatttcttggccttggctgctgtaagttagctctctcaatgttattttcttgtcccagtcaatgagattgtaatagaaatagagaggcctcttttcagcaagctagtcagtgccagatttagaatgaaaaaaggcagcttaaattaaccctaaggcttaacatgtttaagtcttgtaacttttaaaaaaacagaaccaaaggtgagtgtgcaggtgatggaggctgagatgagtcacacgtggaagccggtatatgcacgtgtgcgtgcatgcgcacgtgtgtgtgtagggtgggggacaggaaggcacccctctgtcttttcaagacttcagcagcaaaatgcttgcaaaaaagtagcagccagccttgatatttcctacgctgatggccccaaccagcgacgaggatttgaaaccagttcgcacgggagattggaccatctccaaggttgattttctcatctttaatgtgcagaggggaggtgagaggaggagaggggaggggaggggagcaagtgggccaatatctcaaaccgaccccaaacggttaatgataatgagacggcagcgcgctacaggagcttaacagctctaaggaagaggggagacccaggagaggggcacggcagaggtgttttcaattaccaaaaagaaaaataatttatttttaaacaatacctcttcgacactgggtgtttaaagagaacatactctggcccctaaaatatcaaagtgagatttaaaaatagaaaagtcatttccccccttccccgttgcagattttactgtagcgttctagaaggcagattaaatgaaggaagctcaaacacactcaattttgtcctttagcaaattcttctctttcactcttgcatgaagaaaaaaaatctccccacagagtttttctcttcttcctggtgtggatctgggcccctgcagtgccctgtgtaatttccagttcctcagaattcaggtattaataaagaccccatggggacttccaacaatataaccctacattttgaggcattatgaaaggaaacccccaggggtctgtggctcaaatttctgaaatgtaggcattgtaaaaggcaccccaggggatgcccgcaatagaaatctgctgaattcaaagcattttggaagtcctggtgggagtcattactcccactggaagctttttacaaaacatgtgttgctgacatgttgacagattgctcagtgaagtgtttaggtgcatgcacaaggcgggcctttggagacgctcacactgccagcgagtctctgaacgctggaaccggtaccatccatatttcataacaggggaggccaaggcagccagggacgggagaagtgttctccaaatcagcagcgagcctcgcacccctctgccgaggagccacttcgagtgggccagccccatcctcgcctttggaagctggtttgtgcagcacagctgtgacggcccttgtatccctgccgagggctttactgaaggaatcttgaggcgacctcactgatcactgcaaggcgtcatgccgatcaaattgaggagggggcagggtggaggcggggggctggcgggcccctcacctccacccccagccctcaaggagaggctggatggcgggagggggtcagaacaaggggcacgcttggtcttgacagcattaagctcaagaaagtgatctgtgactttaataaggctgagaggctccgaggaattagctgcctaggtgatgggggccagagatggatggaaatgtattcatggcctggtgggccaagggccaggctggggccctggggaggctggctcacccacagccccacacgcttccaagctctcatctccaaaggagtttctcggccacagacccatgtgtgctggaggagcgagtgccaagccaacctgcctgtgtgcacacgcacacacacacacacacacacacacacacacacacacacactccatggcaggataaagcaccatatgctcatgttcataaaattttaaaggtaaaagcagatgtaatttgataaatgtgtacatgtgttgatacgaacacatgcaccaacacaggcgcgcaggcatgcacacgcccgcattccaatgctgggccctcctccctcctgggctctgcggttaccgctagaacctccccacaggtgcaccaggaccagagaggcgacctgcttaaccgtgtcatggccgctggaacacacaaagaaatctcctttagaaatttctttcttgaaaacatttattctttttgaactgtactctatccattacgtcagcttggggttttccttcattgaattttttttaaagcatgtgaaggagtaaaaatcatttctgacttcaatttaatttttaggcacaacggcatttagagtcagggatggggtgggggtttcccagggcagggtgcccatccacccagccctacatttttcagggactttacctgcaggctggaaatttactctggatctgggaccagaatcctatcctcaacctggtggcccttcctgtctttttcctcctttcaggagaaaattacatttcaatggacaaatggctcttcctagagaagggtgcaagattccactctcccaaggcccctcacagacttctagggacaaaggctccagagaggcacctagcaggggagccccatggggtcagcccagggaggcccagcaagggtggatccggctctgctgacttaatggattccttcccaccagctgtcctgggtgagaagctgctaaggcttctggagctggctggctcctaggtcgccctaactcgctgggctggcaggggttgtttatctcccagctcctctatgccccaccctgggttcaatgcatcaccagcttgtgcccagcccagtgcccggcacataagagatgaacaggagccctgtggtgagtgaagaggtgagtgaagcaactgatgagtgatgcgcccaggccataaataaaagccatttaagtctaccccagtagactccattcagtgcaagggaggaagggcaggtttccccttcagagtggacttcagagaaccctgttcttcaaagagggcctggaggcagaaagggatgactgagcccgggtctcagggatccactttccagagggcagtcttagcccctctggaacaccctggctgtgccatagccagagggggaacacaggagcaggggcataaagaactgaaaaggagaagggaagaatcttcgctagaacccccttctagggcatctcaactccactccatgacactccacgaaaactcccactaagcatgccacacctataacaggaaatccagaggtgacctccctcctctgggtccctcagtcctacccacagggctctgacacctttctccttggatgacagtaacccagtgaccaacttgtcccaatttgtctaggacttccccaattttagaactgaaaatgctacatacataccaggaagcccattagtcagtcagtcatgagcaaactgggatagctgtaccctcacccccaagactgtgagctctgtgagagcaggaaccagcatagagcctgatagagaggaagatgcagtgaacatttgcttactccatgcatgcatgcttgaataaatgaaggctttgttcccaggctccagtagatctggagggagtatgaaggtttgtgtctcatcacacacagaggacagaattccactcccatgtaactgctatgcagagcacacacacacaccagactcccaaacaccacagtgccacctcagctgcactgtgggccttcaaatatggctgccagagcttggaaccaggcatgaaaacttcccagctccaagggacctccacttccaactggagtctctcctgctcatcagcagccccaggccacctagaactccctgggctccctcctggcctggaagccacttacaaacctgtgccaacactgccacctccaggaggccaccctttgcacccactcctgcctagcccttccagcctctttgttgcccgagctattggcctgcacttttaaaggttaaatgacagcacggtgggctgtcctgtcttctttctgggaaaaaggtgggagggcacttgggatgggagaataagaaggccttaaatacaggcttatctggtacatcaggagacagatgtgaatgcaggagaattcattcattcaacagagtcaaggccccagcccttcacaaagcctgccatggtcacagcatggcaggtggatcactgggatggggagtgccctctgtctagctatagggcactgtaatacacacctgagcacaacctcacaatggaacagtataaagccgattaaaaggaggcttttggacaatattaatatgataagctgtttacaacctatgggtaaacaaaaacaaagcagattgcagaacaagaatgtggatggatgaatgccaaaatgactctctggatctctaggttataactggattttcttcttttcacttctctgtacttaatagaccttccacagtgagtttattttattttttgtgcgtgattttgagacagagtttcactcttgttgcccaggctagagtgcagtggtgcgatctaggctcactgcaacctctacctccctggttcaagcgattctcctgcctcagcctcccaagtagctgggattacaggtgcccaccaccacgccaggctaatctttgtctttttagtagagatggggtttcgccatgttggctgggctggtcttgaactcctgacctcaggtgacccacccaccttggcctcccaaagtgctgggattacaggcatgagccactgcgcccggccccacagtaagtttatatagcaagcataaaacaagaaaaatgtattttgagaaacaagggagtgtccaagtgctccattgcttctgggaaccccagagaaggcacgtggacgaccatctgtgtagaggtcaggaaaggcttccaggaagactggaaggatgggatggctttacagggaggcacactgcggggtggtgtttaacgcagagagaacagcgtgggcaagggcaccacacacttcaaaggcaagggtgaggtggggagtggtaagatagcctggaaaatagggccagacatgaccacaaatggccaccctaggaaaaaaaatgaattttggtctcatgggcactggaggctgtcagtcctcagaactgacccctcaccactccccatcaaaggtgaagccagtttgccttgaagaactagtttccatttaacaattggaccctccgtaagatgggcaggactgtagtcccaaaaggatagagccttcaagttctcacctccaggccagccatggccacagctgcctggccaatcagacagacacgctggaagaatcccatccctgggtaccagcattgaccctccagtcctgtgctctaaagggggctcactgccttgtggggaccagggcatgctgccccaccattcacaacagagccaggtgtgaactgggcccagggccactccaccgcctggaggcagacttccagccactggtgggatggctgccaccaaacacagaatccaggtgtcagaaggaaattaaaacaaatgaccctgccacattttttatcatccattcataaaaaatacaagagcaacatggaagaaaaataggtcacttcagtgagatttacagcaacttagagatctaaacatcacccgaaggtcttctgcctccatctggcttcaaaaggccaggtctgattgacccagaaacagaagagaaagtccagaacccagacaaagtgaggtaatggctccgggcaccaacaacacaagggcaccttcggcctcacatggcaggtggtcccaggacccatgactgccagccaggaaggagaaacctataaacaaacccccaggacaacccacacacctgcccatgctatccacagcagccagagggatctgttaaacacacacaccggatcctgtcacccttctgctgacctcttccaatggcttcccactaggcttggaataaaatccccacccctttccatggcctgcgaggcactatgtgatctggccccagccccatgccatgccctcacctcaccgctccctgggtacctacccccggggtccctgccggtaccccgacgccctgtgtcacctctgcttccccagggcctttgcacatgctctccccactgtctgcagtactctccccactaggctccacccacttacctcttgctcctctcagacccagggtcaagatgtggggagaacctatatacagaaaagagcatttgtcaggcatggtggctcacgcctgtaatcctagcactttgggaggccaaggcgggtggatcacctgaggtcagaagttaaagaccagcttggtcaacatcttgaaaccccgtctctaataaaaatgttaaaaaaaatagccaggtatggtggcaggcgcttgtaatcccagctactcgggaggctgaggcaggagaatcatttgaacccaggagggggaggttgtagtgagccgagaccacgccattgcactccagcctgggcgacagagtgagactgtctcaaaaaaaaaaaaaaaaacaaagagcactttccctactcataattcaaaataaaaaacactaaattataaaataactataaagaagccttgataaaatttacgtattatttacttatgcatcctctaatgctttaaaaaaaaatactagtgccctaagcacttccttgcagatttgcagatcttattttacttacttatttatttatttatttttttgagacagagtttagctctgtcacgcaggctaatgtgcaatggtgcgatcttggctcaccgcaacctccacctcccaggttcaagcgattctatgattcagccttaaaaaagaaggcgggctgggactgagctcatgagggcctgcagagtggagacttaaatccaaggtcagggcaaaacatctggagttcattgccaggactgtgatgttacagaaaaggaccgtgaaaggtgcgtgcgggacccaacacagaatcgtggccatgaatgggctcgctgaggacattcgacatcagcggtgccatgagaagccatgccaccagcaacaggggaaagctacggaacctgccggcagatctacagcatggagatggctccaaagatcaacctcttggtggaaaagaactggctggatcggcggagctgctgagcctgtggatacgacacccaccacttttttcttttcttttttttttcttttttgaggtagagtcttactctgcccccctggctagagtgtagcggcaagatctcagcccactgcaacctctgtctccagggttcaaccgcctcagcctccccagtagctgggattacaggtgtgtgccaccatgtccagctaattttttttgtatttttagtagagatgtggtttcaccatgttggccaggctggtctcaaactcctaacctcaagtgatctgcccgtctcggcttcccaaagtgctgagattacaggcatgagccaccatgccctgctcttccttgcagaacttagctccaactctaccacctcagggacccctccccgacatcctccactgcccacatgccacagggacccaacacgtgctacccgcacagcctttcacaggccatggatgtaccttcccctagaagcacttgcggaggctgtcattttcccactgcttgtctgattcttggactaatgtctgttccccccagcacaccctcagctccacagtgaggacaatgcctgcctcctcctgcttcagcacagggcatgggacctagtaggtgctcagtaaatatttgttgaatgaatgaatgaactaataaccccatgaatgaatgggcggggggtaaagattcacattacaaacttgctcttcagtgaaacagaaagatccatcactgagctcctgggaagagctgatttccctaaggaattcaaatagttatttcagcaaacatttacaagacacctactatgtaccaggccctgaggacataaggatgaacaagacaggccttatcctccagcagctcggcccagaaaagacaaacgcataaaaaactcaaacgttcagcagccgtttatatatatatatatgaaaacggagcttcggagccctgggggaaagccaaggaaacaaagctgacttcagaagcaccatcatttcctgcctcttgtctcccccaaccatccctcgaggtcaggacgctgctgttctcagcaggtgccaccctgctcggtgtaacagaggcacacaaatctgactcttccctgaagcaggggttcttcacaatgacatcatcttagtgcccgagaggctgccttttttcatggaagacacgtttatcaggttcctacaccacgccaggtacgatgccagccactccaggtatggaaacgagaccatggtccccgccctcaacaaggggtgcatctagttcagcagctctcagccaggggcagcaaccgcccttcaggagcatttttcaagtgccactgctatcgtctgaatgtttacgtccccccaaaatttgtatgttgaaacctaaccaagatgatggtattaagaagtggggcttttggcgggtgattaggtcatgagggttccatccctacgagtgcgatcagtttccttatcaaaaagccccaacatagcttattagtccctttttgcccttgcaccagagggcacatagaagtctccatctatgaggagtgggcccttaccagacacggaatctcctggcaccttgattttggacttcccagcctccaggactgtgaacgacaaatttctgttgcatgtaaatcacacaatcagtctcagatattttgttatagcagccagagcggactgaggcagccacaataatcagggaggttgctactggcatctagtgggcaatgccaaggatgctgaatgtcttgccaagcaaggaacagtcctcagaatgaagaattatgctccactacatgccacatgtagaacagttgaaactctagaacaaatctatcagcctaaaataaaccaacaaactctcccttgacttgcacacagttgctagagatagcgagccaaaagtacaaataacaataatgacaataatctatagtccgaagaggtgacctgctcgtcatgtctagttttggaccctaaaacacctcagctctcaccaaaattcttcttccacacttcccaggtcctccctgcctccatagttggcctatccttcctaaagtccttgctactccggtgtggttcagtagcatctgcatccccagggagtttgtaagaaatgtagactctccggcaccccaggtctgttcaaatggaactgcattttcataagattccaagtgatcataaggacctaaacgcctaagaagcactgcctgaagtcacttcagggccgactctggcactttctgctcaaaagtcaccaggcggcagaagtagtgagggagactccatccctgcatcctctccatccccggcatcctggtgagatggcacagcacctctgtgcagagcagccgggtgccactggaatgacaggtggctcttaatggtgggaaaacaagagaggggactccacaaaaagtcaaacaggtgtccagccttaaggaacccacctggggaagattctcatttaagctccataccagtcaagaggtgacaacacgtggcaatgctaaggaacactgtttaattcccgaggggcttgccagcctgagaggacccagaatgagtgtaaaatgaggttgcaatgtctccctcagcaccagacaacacctgtgccccacccccaggcttcacttggggacatggggctcagatccaagtcttatttcagggtttctctcccagctgcaccagaagctgccgggtaggcaggtactgactcccctctgtgggcccctcaagcacagtatgtaaagccaagttggtactagggtgacgactgtggaacggggtgagatgggatgggatgggacaggataggatggaatgagaggggtggaatgggatgagtagagcaggtgggataaaataagatgcaatggaacagaatgttggaatgaaggaaagagaaggttacagaggctgggcccaacgatgccccttctccttatcaaccatggaaaaaagtgttcctacagggagacgtgtacaagaatgtttactatagtgaacaactggaaacaccctaaataccccccaccaggggcctgctgcataaagcacggggcatccacactacgcaagccccacagcagctaataagaagtagggagatgtacccgctgaggtgagaagctctctgaggtctaatactaaatggaaaaaaagcaagttgcagaatgatagatccaatatggtatcattcattttttaatcaaaaatcaatataacattgtttctgtggatacacataacactatatttcactgaacgtaagacaccgtggatggtaaaatgcaccattattttacagaccactgaaaaagaaaaacaaaacccactgtcaattaaaccatgacaagccactagttgaaagatgcacctcaatttcagaaatgttaaaatgtgtcttagaatctatgaaatacagtattacgtaaaggtgtaggagaaggtctggaatcaagaaagccaaaatggtaataacagtagttaacaagggggtggggacagcctgaagcctatctttgaaatttttacaaacagaatacatttatggccagacgcagtagctcatgcctctaatcccaacactttgggaggctgaggcaggaggatggcttgagcccaggagttcaagagcagccctgggcaacacacggtgagacctcgtctctagaaaaaataaataaataatttaaaaattagccagaaatggggccacatgcctgcagtcccagacacctgggaggctgaggcaggagaatcgcttgagcccaggaggctgcagtgagctatgttcacaccactgtactccagcctgggcaacagagcgagaccctgtcgctatttaaaaaaataataataataaagaatacatttatgtattactgtgatatttgatcacatttaattgttttaaaataatgagggaaggccttctctgctcctcacttggaggcaaagtgatgctgataacataggggcctgcattggtcacagaaggaacgggcgcccgcactgctaatgcacggtggggctcgcgtgcctgagcaggtggggtgccgcaaagctttgtgaagaggagaaaaaaagctcttaggaatgtccagaggggaaagtgccattggaaaaaaaagaaacaatagaaagagaatttgatttcgggaaacaaacaattcataatccactgatagagggctactcaggggctgagggttggcccccaaaacagctccttcatctcccctcactgccctctgcaaaagcagtttggaaagtcataatgccatcctgaatgcatccctcgctagggacctcctcagactcaagcttctaattccaccttaatatccaattctgtgtgtcagggacggctgaacctcggcctgcagccgccacatcaccttgccctgcacacaaataaaaatagctttggtgctcagagcaccggttcccttgtcttatcctctgggggtcccgggagcggcgcgatccgcgagtggaaaccacgtgtgatggaaatacataatgaacaaagaggctccgcggatgcatccttgaccttcctgcttttccttgacctctccactgccattgtccctatgaagccacaaacagaatgacaccgtcgtgcaggtgacagccacagaatgccttccattgccaatttctccaggagttaagcagaaaatggatttaatcagaatgataactgattcatgtcgccatttatgcaaataaagttttggcagctcaggcctccatttgtacacctccacttgccaggcgctgggcctccagtctgacaaatctgctcctctgctccatcatctgtggccttacagagcaagaccaaagtgctggcaattggcttgtcccaggaaaagggaccaccaaaagctaaaagcccacagtcacctgacatagcctcagggtccaggagaaacagggcaccacccactcccccacacaaatcacacaggaaactgctataaactggggctgatctccaaaatctgacttctgagcatttgctcatccgcaggatctaagagagcccagggagtggggtgggtacaaaggatatttgccactgtcccctctagatccgcccccaccttggtccattcctgctctgtgttcctgcagcgactgcagtgggggaggagacagatttggggtagttattctcccagcctctgccctgccctgctgcacccctctccctcagcagcctccctacagccagtctctccaggtggcctaaatgcccctccccgcaccctggcaggttctcaggatgatgccccactcctggacagctccccttcttcccctgcccgcttctgcaaatgggccctttattaaatgctcctccatctcccggtttgagtgcgccatctgttttctgttgggaccctgaccaagggggtattctttaaagaatttttaagtaaatatgtctgcaaggtgtttgttgagactgtgataaaaaggcattcgaggaagcagtgtgaaagatgccatccgtgagactggagagacagaaagtcagtgatcagacacgcaggcccagagaatgtgggcgaagagggaatcttccagtaactcactcccccgctgccagggcccccatccctcccctgtgatctggctgtgtggagtcaatgaccagtggctttctccctgcaactccatcacgcctcccacagggcagacaagtcagcccggcagtgtggtaaaggaaggaggagagagtgaacccaccaggcacagttgcttctgaagcccagctctgggtctcttgcttaacgccccagcagtgcttctcaaatcccatccccaggagccggagcatcttcctgtgccctgcagacggctcattctcccaggagatcatgggctccgaagggcgggagccaattgtatttattcatcacctcacacatgatggtatgacggtatgacgaagcacccggtgcttacctccttattatctgtttccccaaccagggcagggatctggtctactcagggtgctgctatatttcaacacgcagccagggcctagtacatactaggagctaaattaaaaactgatggggccaggtgcggtggctcacacctgtaatcccagcactttgggaggccaaggtgagcagatcacctgaggtcacgagttcaagaccagcctggccaacatggcaaaaccccatctctactaaaaatacaaaaaattagccaggtgtctgtaatcccagctacttgggaggctgaagcaggaaaattgcttgagcccgggaggtggaggttgcagtgagccaagatctcgccactgcactccagcctgggagaaaaaaaaaaaaaactgatgaggccgggtgcaatggctcacacctgtaatcccaacactttgggaggctgagatgggtggattgcttgagttccagatcagcctaagcaacatagtgaaaccccatctctacaaaaaaaaaattaatttaaaaataaaaatgggtggtctgaaatatgaactgccccctccactgaagaccgaaatgcaccctggggtttgtcccgcggcccctgctctccagcccccaggaagccatgggaagagccatttctggaatgggaagggaggtgtgagttgggtgtggcttggtggaatttgaggaggggaaggcttctttccagtcccgaggagacggcccagctgcaagcccccaagaattcctggtgttcgtgccatccaagggaacaacttagcaccacccaggccacttccaacaaatcactgagtaagtattccctgagcatttactatgcaccaggtctgccacaaggccagagacaggaacaggcatgagggagacagcacaggacgggactcctaagagggtcaccttcgagtggcagagacaataattcaaaaacatcaagcaatcactgccataaaggaaataaatggtgtgatgtgtttggcgttgaagggagccgctgctgcaggagacgggggagggtgtcagcaaggagggccgcgctgaggaggtgaccttggagacacagaaggaagtgagagagctatccacgtgaaaagctgaaagaacacccggggaaggcaggtggtgcaaaggccctgcagtggaatgagcacggcctgttgacggctcaagaggaggaactgaggccgggcacggcagctggcacaagtatcccagtgctttgggaggccaaggcaggaggagtacttgaggccaggagtctgagactagcctgggtaacttaccaagaccacattttttcaaaattaatataaaatacttagctgggcatggtggtgtgcacccatagtcctagctactggggaggctgaggtgggaagatggcttgagcccaggagttcaaggctccagtgagcaacaatcgtgccagtgccctccagcctgggtgacagagtgagaccctgtctcccaacaacaaaagccagacacagtggctcacacctgtaatcccaatactttgagtagctgaggcaggaggaatttttgaggccaggagttcaagaccaacctgggcagcatagagagaccccatgtatgcaaaaaatcaaaaaagtagctgggcacagtggggcatggtggtgcaagcctatagtcccagctactcgggaggctgaggtggaaggattgcttgagcccaggaggtcgatgctgcagtgagctgtgataatcaagcaggaggaggagaagccgcaagaggcacagggccaggcaggggagtggattcatccccagggcagtgggggaggagcagagtcagatgcaagctgtcctgaggacagcggagggcagttgaggagaaaaggctgggtacaggctgggtgcccacaggcagatgccagccattgcccctcccaagtctccctgctgcctgcccctcagccaccttccttccacctacctcccacaacacaccccaccaaccctcagaggggtcagacccgctccagcagatctgacctcatcacccccatcatgaggcagcaccaacctgctcagccaagcccttggagaggctgagacactccatatccaagggcggggacagaggtgcaggtgtgctcccccaagctggctgccattcccccacctgcagagccacctcgcctgcctcagtcttcccacatgcaccctcatacccatgacgtcatttccaaaggcagccaaatcctagccagtcaactccaaaataaaactgtttaacacaaaatgaagcattttataatcccctgtacattttttctctgagttggcacagagtgtttaaaaacactgccaaaacactcaaccaatagtagcgctttattttagaccagtgccagagttaaatttccttgctcttttcctgttccgaatcccccgcctctccctgctccccggcttttgctgcgacactagaagcagttcctcctgatcgcccctctgagccactaggccagtgggctggggtgctggggaggctgtgaccagaggaaagtggaatccgcattacgggatgatctgctgggagcactccttgacctgcaagccccagtcagcgggagataaatttggttggtttctcattttgtttggggatgttctttatttttctgtattagggtgtcatgttagggatgtcaatcacaggatctcaaggtttgaaggaacctgataaatccacatgcccatctctcagccccaagcctgcatcccactctcctcccccgccaccctctgatgtgttcatctccaggcttgcaaagactctcaccaaccaaaacatcactccttacacataggccaggcaggtgtccctggggacttctggaattggtcctggtctggcccttggagtatcaacattaatggagaaaggggtggacaggtctcatccccactcccccactgccctggcacacagaggcatcttacccagaggcaataataaaagcatcagccactcaagccataccttcaccatcataggaacaggcccccatggaactggtagggctggctggacttccagccaagctcttgcctacccctcagttcaggaggtcaggtcacctgctgtctaggttaaatggcctcagctccttctctcttcaggctgcttctgcggccagcatccatccccacttcttctgctagcagcaccctgatttcctctggggaaacttttcaggtctgctattcagagcacttgacttgacctgagccaaaagccatcatggcattcctcagagccaggagatgcaggaagactgggtccttcgcccttcactggagtccctggattcagctgcacctgaagatagtcctacacctaggtttctatttacatgagccaatacattgcactgtttgatttcagctggttaggatttggttgtctgacactggtcggcagggaatcccaaccttccaacttgcaagcatgaccctgagatctctccttctctgtcctccctgaaccactccctccagcaacacacagaacagacactctttctgcttctgctgacatagcgtcagagcacagtaaataaccctttggcagtgaaccggctcctgttcttcatttccacaccactcatgcacacattggccagtactgaactactggactaccccacagagggaggggaccaaccaactcataggagtacattcaagaatcccctggccaaagttatcgaggggcccagtaagctacacaagggcaggaactgttgtctgttttgctcacccagtgctcacccagtgttttgctcacccagttcccagcacacagtagatgcttttaaaaaaagcctctgtggctgggtgtggtggctcacacctgtaatctcagtactttgggaggccaaggtgggaggatcacctgagtcatgagttcaagaccagcctggccaacatggtaaaaccccttcctactaaaaatacaaaaattagctgggtgtggtaatcccagctactcaggaggctgaggcaggagaattgcttgaaccaaggaggtggaggctgcagtgagccgagattatgccactgcactccagtctgggtgacagagtgatactctgtctcaaaaataaaagatctgtgaatgaacgcacacgtgccaggggatgctgtggttctaaggaacacacttctctttcatccgttaagtttgcttgttcctttgagtgcctggaattgtggagtaaggaatggaagaagagagcatcaacacttttcagctctgtcttaagtctgttcaggctcatataacaacaataccagaaactggatggcttctaaaccacaaatgtttattgctcacagttctggaggccgggaagtccaagatcaaggtgctgggagattctgtgtctggtgagggcgcatttctcatagacaacacagtcttgctgcgtcctcacatggtggaaggagctgggcagtcctctgggtccccttttgtaagagcactcatcccattcttccagagccttcatgacctaatcacctcctacaggcccactgcttaatactaccacattggggattagatttcaacaaacgaatttgggggaaaagcaaacattcagaccatagccagttataataaaggactcttctagaacaactcccctctatttgcctcttttaccccaaaatcaggtcaggatcccagctggaggctattcctatcctcacccacaggcatttctcaaagcttttgcaaacctcaaattggtagtaaccgagattgattactcagggaacacaattttcagatctttatgcccaacagaatccagaattagcacaagcacctccaggagaaaggcagcagggcctctctggggggctctggcctttgcttttcccgcccaggggtgagacagaggataaggagggcaggaagtgccggcctaatgaaaaagcagacctgacgggaaaggaagagcagctccacgtgacgggccctgagctggctcagtgacactgaggttttagagctatacactaatacactgggggaaaaaacttattattgaaatatctacagaataaagaaaagaccttgttagtgcaattttagaatacgtagctgcatccctctttctccctctggctgatggcaaatgatgtggttttttggtaacacttgggtgatatagtctggctctgtgtccccacccaaatctcatgtggaattgtaattcccagtgttggggaaggggcctggtgagaggtgattagatcatgggggcagatttcccccttgctgtgctggtgatgagtgagtctcacaagatgtggttgtttaaaagtgtgtggcacctccccctcaccctatctctcctgattcaccatgctatgatgtccttgctaccccttcaccttccgccatgatcgtaagtttcctgaggcctcccagccatgctgcctgtacagcctgaggaaatgcaagtcaattaaaaacctcttttcttcatcaattacccagtctcaggtagttctttatagcagtgtgaaaatgaactaatatactgggtttctcaggaacgcacgagagaggttcagcatagctggctgatttcagagttgcctctcaacaccatctgggcacctgagccactcaggctcaaggctccgactaacttggtggctgcccagcctctctccagcctggcctgagacctgaacataatattgtaggggccaagccgctggtggatgccacgagggcttgacacaccattaccccaccttccacctcccagagcactgcccccaaaggaccaagcagcagaggttcagggggaccatggctttatggaacacccaaggtgggggcacaacttctatgaagtttgttagaattcaagggtcaaagtcactcttccacaagatgcaaacaaagaaaaggtccagtgcaaacagtgtgaggtccgtgggtctggagacctcaaagacagtgagctcgatgtggcattcccagaagcacccatgagccaggcaggagctgcatatacacgggcacctcctgccagaaaacatgggtgccctgcaggctgcactagtcccctgtccaccctgggagctgcaatcccaccccccaccagcagttagcagataacctcagagagtgctggctaagctaccacctccctgtgtgacctgggacaagtactacctcactaaggagcctggtccagtcagtgccctggctgtgtttgagagactggttctgccattgtttcaaccacattcaaaccaaaaaaggtttgaggatatacacaccaaggattctgcttccctaaaattctaagattacctgactagacactgtcaaaagcaaaagtattggttatcaattgataactgatacctgacaatctggcatttcattgcactcttttactacttcctgtttgtctgcatgtaattcctacctcctaaagaagatgtctgtggctcctgaccaccattcaggggagcccctccccagctctcaggcccagtggtctgcatggagctgccctgattccccgcacccaaccctgacccttgctaacatgtatgttgtctccctggccgcatcatgggcgggggtgagtcttggtcctggccattctacagagtcaacctcaggacttctaccctggcaatggtaagaggctgctcattccattgtcactgctgagtcgaaaaggtggagcctggaggtgctggggcacctctgctgatgtacacacggtgatggggttcatgtcaacagacatggggcagtgtctctggaggccctggaggaccaagcttgaggccagccttacatctgcatttctcagttcctggagccaatgaatcctctattttctgcttgtcaatttgagccaagtctctatgcagatagcacattaactgaggaccaactatgtgctggcagccaaaaggatcacagcaacttcatcctccagctagactatacatttcccttaacgggaatgaatgaacacccatgcacaggcattcacggccccgaatacacagcaggtatggtatcactgcttgctgacaggtgccctctggaaactcccaagatgaaatggacaacagcaggctggacccagaccacaccgggaacacatgtacaaccagcctaaaggccagtttggtgtacatcctgggcccaggaggacaccggaagctttggctgctgccaggaaggtaacagaaaccggggacagcccacctcgctccccaagaaccatctccagaatcaacccccaggctcatcccaggggctttgtacagcagcaacacccatcgtgccaggcgccacactggatcccactctggcgcacccttggaaaccaaagaatccaagaagctcaattattcagaaaatcatgaaggtggtcaagcaggctgggtaggaaagaagcaaaaacctcctccactttggagagtcctcaaaacctccagaaagacacatagactgtagacacatagacacggtctatgccttttttcccatggaaaacacaagaaatgcagaatcttcccaccttgacccctgccttctatattgttaatttgtcatccaattttggggaggtttacaggcccaacagtgtgataacagcattcgctctatgtaatcaagtcaagggagggatgctctgcaacctgcggacttcgcaggcggtgaataaaaatgtcagcaactaagaaacaagtccccaccaccaccacattaccaccaggaaggaacccaagacacagctgtctgagccaagactcagaaccaccgtctatgcagcctgctggttccccagcttactccggatggttccccatcagaagccatcggagggcagggggcaggcaatttagggaaggcttccacaaatgccaccagccaagcagacccaggctggccggtggtccaccctgcccatccacttccctcccaagtggaagcctgctagcaggtcagcatcttcctgagagctatagagaataacgtctctgttcatcaaagcccctcttaaggacactagagaaggaggctgtttaaagaccaccacagcacttcatcacacaagtcaaagcatccttttgtgaagtgaacaccttctccactgagctaccttttataatagcctccacatccctagagcccagagggtccctgctaatagcacacactaaagaaacacttattgtatgaacgaaccatctcttccatctctaaacttacccttctgattatacattaattgaggacctactatgtccagaacttctgttttttctatctcatatcccaaagcactgtatccatggcatttccacttttcttactgcacacacccctttgccttgcaggagggctgtagcctccttagccccaagaacaaacattccttgagcacctactatgtgttctagccacaggccaaagcaatcctgcggagagggaagagaataagaccccaagcctggacatcatggaacacaacctgaccagtgagatggtgttggcaaactttttgatctgtgccattctggtatttttaaaatggtatttccttatggtttaaatttgcagttcccttactataaacggggttctaattttttttttttttttttttgagactgagtgtcactctgtcgcccaggctggaatgcagtggtgtgatctcggctcactgcaagctccgcctcctgggttcatgccattctcctgcctcagcctcccgagtagctgggactacaggcacccgccaccacgcccggctaattttttgtattttcagtagagacggggtttcactgtgttagccaggatggtttcaatctcctgacctcgtgatccgcctgcctcggcctcccaataaatattttttaaatatttaggatcccactagtatttctttctctggttccatttctgtccatttctgtagtttgcacatgggagatattcaaaacatctaaccaccagtgtggcaccaatggatcagagacggtacagaccttggggaaggccaggcatctcaagcaggcttggctgtgcctcaacctagcctttgccatgtttttttgtgttgatttattggctattttcttagcatttgtaggagttccttacacattaaggaaaacatcttttgcctgtgatatgtgtccctggcttgatttactgtggttttcacaatgtagaatttttttatttttatgtagttgaatgttttgactttggttttatggcttctgacactggggttatatttagaaaggccttcctcactctgatactattgaattaaaatatttaaaagctctctgttttcttttagtattttaaagttttctttttatgtttagattcctgatccacttgggattgagtttggtgtcaggagtgagggaaggatccaatttcctttttgggggatggccaccttttcatcctaatcccagttgctgagagagccatctgtcctccactgtcgtgcagggacacccttctcatacactagatttccagttgtatttgggtccatttctgtttcacaccacttcgaatcctttccgctccagagcaatctgagctggttcctgtccccactccctgttccttttccagaagattccttctgatgcctgcatacccactatttcttatgaactataaattcagcacatccatttctaaacaaatcttaccattgctttcattagctaacattaagccaataggttcgtttggaggaaattggcatatttatgatactgaatctttccacaagaataagagtaaggtctcttctgtgttccctgtcttccccccaccataattgattttgtttgtctgtcctctccatgccgtttgaatgtttcttactgggtttgctccctggtttttatacattttgtggctgacataacgggaccatttcttgctctgtgtttcctaactggaagctgtctgcatgcaggaaaactcttaagatagggggcggatatcaattgtgctcaagcccctagccttttgcgccatgtgaagtcaactgacaccaaggccccgagtgcattccctgtgggcagaaggagcccacacccagcacctgtgtatcaggtagcacagtgtctggcactggccccagccccacactgcacgaccaaaacagagccagttcgaggagcgccgcaagtcagtaaggcagggagcccctcatgcttttggagcaagaaaggggcctgagccagcacaaaaaggcaagcgctggccagccggccgacagcacacggctggcaaaggtgccagctccacacagcaccagccctgtaattggggcccacaggtcactctggccacagctgaacaaaccagggtgtaattaactttccacccggcttgttgcacagcagcatttcaccttcgccagaaaaggagggcctacctttcacaggggccagggaaacactctttggtcccagtcctcaagaagggatagcggagaggggagccgcaaaattaacccaccaggaacacattttttgctgttgctatttcaacaaagtcccccctcttgtttttttggaagttgagcattcaaaaaagccatctggagtttagtttgaaattgctcacagtccccaatctgtgttctcaagcacaggcaagctgttccgacctcagagcttgcctttactgacacgatctgtaaccttgagcaaggtcctccagctctctgagcctcagtcacccaattgcaaaatgaggacgaatggtagaaaatagtgcctagctttgggaggcccaggcaggaggattgcctgaggccaggaggtcatgatcaacctaggcaacatagcaagacctcatccatacaagaaaaaattaaaaatgagccaggtatggtggggcatgcctgtggtcctagctcaggaggctgaggcgggaggatcgcttgagcacaggaagtcgaggctgcagtgagctacaaatggcaccactgcactccaggctgggcaacagaacaagaccctgtctcttaaaaaactaattaattaaaaaaaatgaagacagcgtcaccttggacaccaaaggtgattgttataaagactaggtgagatgattcattcattcaacaaacatgttgaattctactctagcgctgggctagaacataacggggaacaaaacaggtatggctgttgtcctcatgcagcttaatagtagggagagagatgggtgagaaacacgtgaaagacaattacagaaagggatgggtgctctggactgtgtgggcgtgggggctgcagagggccagcagggagggctgcagggcgtgtgttccaggcagagtcccatagtgcctcgcgggcagtaggcactgaaaacacaaagaatatcaggactacagccttcactgcagtgtggaggaggcaacacctgctcacacatttgcccccagcaccagactgccagcccctggagggcagcacgcaccccatctgcttcagagccacctctctagggcccgccaggagcctggcccaactcagagatcagggaacggagctgaagggaagacaccaatgctgagctccaaactggtcctgaaggcgatttctattccaaggcaagtgcctggagcccgcagtcttactacctacaacaaaaagccatatatcaggccagcagcccctttagcaaagaggccaaagaccccaaaagctgtcaagtgctccagccccggggacctgggctggcatgttccaggactggcacagcacaggcccctgctgacagcccactgtggacactctgaggaacagcactaggaaagtcaggtctcaagcatgacagcgcagacggagcacccacacgccctccagctgccagcctcttaattcaggccaaagcaggggtcaacataaattgcagtatctctaaaagggagtatttgcaccaggaagtgaaaaatccagactacaggcccacaggtgactggcttcagtgagcacataaaaaaccaccatcaccccatgggcaaaccaaacctctcgcacctgcttctatggtaccccaggcagttcctagagaaactttctaaagcagtccaagtcctcctggctcctagaagatgatgataaacaccccctgctgcagtttaaaggacccaaatttgcttggccagcgcttcacaaattatgacgttatttgttccaacatgatttaaatcagtgagacctgaattgacagggactgcccatccttggcaattcagacagccaccaaatcctttgccatttcctgacttggtgcccacaaacaatgtctccattaggaacagagaagcccatcacacttacccagtcagcccctatctacactgtggcaaaaagcctcatctacagacatcttagtctaaatttaatattttcagagtatggacacagtacctgcaacccaagcttcctgcccttgagcactgctatttaaaagacagagttccccctagcaaaaaaaaaaaaaaaaaaaaaaaaaaatggcgaagaccaggtaaccacatgggaaccccttcataacatgttatgtgacaaacacagaacgtgaaaacgtatgtgctcacaaccccaagcatgcgaacgtgtggcatcctgtggccaggggctggagaggaacaaagaaaaatcaaacagacatcagggcgggagaatgaatggagaggactggatttttgctcttttcagtttgtgtcataaaaatgcaatgtttgatacctcatgggtttaaggttggtttctcctcagacacaaatgagagcgagagggagagagaggaacaggacttgatggagttgtccgagaccttaaagtccacgcttcaacagctcatgggcccggcatgccactcctgctgaggacaacagagaggtgccttctcgagctcccaactggaaatgaaggctccttagcacagaggccgggctccaggttggggacgggggggtcttccatcgtggccattctggcatgaagctcccctcccacccctgaggggtaagcatccccccacctcagaaaacccccaaacctcaccacagcactgtcccagattctgagggagcaaaacgctgcccccaatctccccctcaacaccaccccaactgccatagaaagatacagaagcagttttcaggaagagccacattcacggtcaccgcccacaaatacacccccgacaccccaacacacagcactctccccagaaggccaatggcttgcaagggctgaccctgccaggacacacccgtttggggaggcacgtgctgcctccacgttccagcagcaacagtccctatgaaggggagggttgttcacaccccaggtcacgattcctgagaagcaggccctctgctccaggccaagtgggcagaccctctggttcctacagaaacatctgcagggcaccatggtctgcccagcctgcgcccagcgcggccctctcggacacggtctctattgggcttctatcgagtgaccagtggtgagagtccagcagacccatcagcctggccagggggagcctgcgattgcacatttatatcagttccaaacctttaaatcagaggccaattttcaaacaacatcatctgctaaagccccaggtataaaacagacttttaaggtgaatcgctccgactggactggacatcagtgccccctcagtctgacaggccccagtactcacttcctacaccccaaacacaccacaccatagccccagagatacctctgggaacacagttcgaaaaccactgcacaatggaagggtgtggaggcattccaggtagggaactgttttgaataatacatacgcaattcccggtggtttatcccatcattgagtaatcctaagaaccgaagacctgggggaaagtaactcctcacacatctaggaaactatcccaggctgggtcatgcctttaccaggcggtaatgaatttctcagggatgcgcttaggcaaggttgtttccctcattctttcaaggaatttctgactcccttccaatgctccaggatttgggggtattcctagctcctgcgtccccacggaggtcattagcagggtcctgttaggaagcgggcaggagtgtcggtggataccaccagcatcaataaggacagctggggaccctgcaaacagggctgccatggatttcacctggagtcaaaggctgatgagagaagggtttgccactgggaggaggattcttcctggggaccaaagcacaattagctaccagttcttatttctggctcagactctcacatatagcccagtttcccagtttcctttttccacctagaagtgccaccattcttttatttatttatttattttccttttttgagatggggtctcgctctgtcacccaggccagagtgcagtggcatgatcttggctcaccgcaacctccatctcccgggttcaagcgattcttttgcctcagcctcccaagtagctgggactacaggcatgtgccatcacgcctgggtaatttttgtatttttagtagacatggggttttaccatattggccaggctggtcttggactgctgacatcgtgatccgcctgcctcagcctcccaaaatgctgggattacaggcatgagccatcgtgcccagcccgaaatgccaccattcttaaaagtgagactgaaagacaggagaatctccttgatttgaagggctggaggaaggggcagcctctaagagctgcagggactcaagaaagcacagcttagcagaaggtgtggggccctgctctaacaactacacagaatggcctattctcttgcatttagaaaataaagagaataacttttcattagatcaattagttgattataaagtaagtggcaatattttattctcttatagttaagattccatgttaattcttggctaaatcaagaaatataccaacatctataatattattcctcaagtaggatgagggtcaatagctcagtgtccagaggaggtcctagcttggccaccaaacagatatgtgaccccggccaagcaatcaccttttcctccctttgccctagtatttcccttggggaagtgaggagacttaaaaagctaacctcataggtcccttctaattctgatttagaattgaaaattaaccatcacctctgcctctggttgcaatatcacaaattccaaatgactggggtttggattactgggccccaaaatgtccaaaactgtaagattcctcttaggtctattattattattattattattattattattattattattattattttaaaaatatctgttcctccagaggttgagaatgggaacttggtctagccagccctgtgcaggcacagatgtcactagagggcaaatcatagcagttccccaaacacttaatttcaaaattccaagatgatatgaggagtagaaaaagcaagagctttgggtgccaatctaatccctaccagtaaatgttcccctcaacaagtgatgggttccctttagaatgcaggcctgagatttcaggctttcttccacaaaccagtatccaaggagcttcatcaacaaccctgatggaagaaggtctctcaggaagactgtgtaaggaacacaggtcctatggactccctctgcagatctcagagcccagaaatgtgtcatccctgtagcatggcttccacatcccagggaatgcacatgccctctgactccccaccccaatcaccccagacaaatacacatatacacacaaaactcctgaagtcttcagtagctcctagaaaactggtcttacacaccctctccaaggcaccaagtaaatggagaacagagctccagtcaaatctagcagaagcagctcccagctacccttctcctcctactcagagaagtgtgaggtcaagcacagagttggaaacaggtccctttttcacgggctgtccttggcctttgaaatttcctcatcccatcagaagctctgcctcggagcttactcctttatgcagctttccacacttaagctgcttaactttgcactaacaacctcttaattactgcgtttccaaaaggccttccagaaattcagggtgcacatccacccattcatggcctgagtaccagagcacagcttgcggggagagggggccgggacagagcaccaccatctaattcctgcctgccggaaagctgttgcttttatttttaattgtatttaaaaggcggatacagggtacccaagacaccacaataaaatgacattaactgtaaaattacattattaattctttaatctcacttgaggcttcaagctgttgctatgtccaattacccgtgtaaccacctgtcagagtcctggggctgttttgcattacctccaggacagcggtgggcccggtggtccgtcaggtctgccagagactcgaagtcctgctgacagtgatcgcaggtgtaaattgattcatcctccatgtcttcatcatcctcatttctctcctcttgacttgtcacgctgttcctgtcttccagcgcacggctggttttctgatcgcactctggctctccttctaggcctcctgccaacaggaagaatacagtccatgtcagctgatggggtcttgggaaagggttttaaaagaatcgcccggcatttattaagatacatttaattactctacctcccggggtccattatccttgacacctctcagtatattaatagatggggtttttttgtagcatgtggtgccataattctcaaccagattctttaattcttggtgcaaatcttctagggggatttcctgtcatctcccctctgtgcacggatgctgggggccgtgacccatcggagaggtgaaaaaccttatttgtctcctaaaaaccagattcagttacacacctttttaaagcctccatcagctgttcctaacacacctaaacttttagttttccccacagccttgcaatttagagctgggagatctcttagccaagttcgccttccacacaacaggcctcccagggcagtgacgttggctcagttctttgcaaagatgtccaactctgaaataaaggaagtacacatgtttgaagaaccatggatggtcgaatctcaagcttaaaatgcatccaggctgggcatggaatctcacacctataatcctagcactctgagagaccaaggtgggaaaattgctgaaggcctggagtttgagaccggcctgggcaatatagcaagactctatctctacaaaaaaaaaaaaatttttttttaattagcctggtatagtggtgtgtgcctgtagttctacctactcaggaggattgctagagaccaggagttcgaggttacggggaactatgatcgtgccactgtactccagcctgggcctggaccctatctctaaaaaatataaaataaaataaatagtgtcacctgtgacctggtacaggcctagacagttagaatcagtcgtggaatgatctcactgatttctttaaaataaaacagctactgtgcttagcactgtgcagagagtggctaatctatagggaaaagtgaattcgtaatcataatgatgccttgcaattgtgctgtgttccgtgcttcttcaaagccaccattatatatgcacagccccatttcacagtcttgcatatcctaaactcaaagaaggctcaaaggatcatgtgatccaaccccctgcagagagggacagctttgtctcacaggtaaggtacctggcatccaaccagaagaagcaacagcccaagcaccctacagaggctcagctcaacttcgtgactcctggtctagttcacttccctgcacaactgtgggtaatggagcacagccccaatcttacagattaataagacacaccaggaacttgtaaatcaaagtgcaaaagcgtgtggtaaatataacccacagaatatatcagtaatcctaataaatgtcaatggataaaatttgtgtgttaaaatgcagagaccctcggattggaaaataaaagtgtgtgttgtctcttcccacagcctgtcctggaaaacagatttacccatccggaaactagctgcactgatttaaatcaaagaaagagatcttattatccataaaggtgtttttgaaagcatatgtacatatgcaaaagtgcgtgtatgtgcacctgtatgtacatgtgtgtacatgcaacatcacagttacaggaaaaggctcagtgcacaacctgcaaacccctgagggcgggcgccaaagcaagaaagacagacacgaagcaaagaatgcactcaattcaaggtggaaaccacagtcctgtgaatatttcaatttggaaacagataatgttataagggctctatttctcctgtctgcacagaacatgcccttccaagcacccgacatcaagaacctgggaacacaaatcggctcatcggagagccagctgcttccttccaaggcggggaacgttgcacgacacgccgcctggaactgcgcggaggcagtaaaaatcaatgtttccatttgtggcccatcaaaacatctctcttcttaccaattaagggatgtacagtttttaggttcttttattatcagaacgcgccaactcctggcaatacagaaatcccattaaaagtcaggcagcatatttatctcagggaatctgatctgccgctgcagtgagggtaagaaatagaaagcaaagaaatgagaaatatcatttggagccttcgatattgtaagtcatcatacaaccatggttacacagtcaagtgcccgtctccgaaattcctcgtttacagtctttccttaataaaaaaaaaatgttctgtagaaagggaaaataaaagagccataattctggctttatctactacaccgaccctccagataataagttacaatcagcaccacacttgtgctactttacttaacacacaatttaatagacatatttaaattatcccctcgttatttttttgccgtatttacttggcagcactttctataatagctcatctaatccacaactggaaccacaaacatcacaatgtatttgatctctttaaatctggtacatcctgttgactcgggagtagataaatcagaatgtcaactctcaggtttttataaggcaaaaacccataaagtcatccaagagtataaatctgttttaagcaactgtcacctcccctatggccggctactaatgggaagggagggtggctgtgcagaaagggatggagacgaaggcgagctcaggccacacaaaggcgcggacctcatcctctgggctcccaaggggtcccagcctggccctcagggaggtgacacaagacagggaagactcaggggcctgaagaagttttggggagtgggacttccctgaagacccaagggcccctctgctgattcagcagaatcaggcgctggagaacaggaaggcctccaccccaggcagggtttgcctcttgcaatgcactttcatgcccaggagtttctgaacctcaccataagacaaaagaataaatggtgttatttttccatttgcagatgagaaaactgagcctctgcaaggccacccaaagccatgccaggatcgaatctacacgttcacgtgttcattaagcagcacacctttcctgaagtccctgggcctgttggagccccaagctctccaaggcccaggaggcagaagttctaacaacagggagctccaaggacatcagacctacctggagaccgtctggggttcctcttttccaggcccacctgatcggttgctcagtaagtcctggggatggaatgattggaccttccctactccttcaacccagctccgcctgtcctgtgtgctgctctgtccagccccagaggcccctcaactggtccctgtcctgagtctggacatcacctgtgcaaactcagagaacatagggcccagaggcccagcacctggccctgccttgtgagtcccatcacaagcgctggctcatttcaatgacctgggctagaactgcagctcactggttcctccaatcaccccagagcccagtgaagcaacttcaacaggccgaggagaaggccaatggctcaatgcttttctgcagaggcctccagggctggggagggcttcccgaaaacagccggctggctcctttccctctggctcctcccctgtcctcctgggggctgtctgcagcagcatgaagacagctcgctcagggaaggcccgagccaaatggatttcaaatcagggacctctccctcagggccatgtgcatgggacagaaaccgaaccagtgctgtgaacgccgacctgtccgtccagctgacaagattccctacctcccagagctcatgctttccacgatggacaactgttttctgatgtgcacacctgcatccttttgcccaggcatgccccaagaacagtgagcattgattaagcactcaatgcttaatcaagtgcaggcaccttatgagttgatgtcatcatatccccattttacaggtgaggaaagcagagctctgggaagtgacagagcttaagtgaggccacagagaagtggtggggctgagtttcaagcccactgcatgtgactcttaaccactctactacatggtttcctcacagtaagacgcaatgaacacctgagccaggtgttgggagtttgtaaaacccctcaaagtcccatgtagggtcctggtcacagcccctaaggttcagcaacggctctgctgatctctctcacttatcgcccatctccacagccttgaaggtcatctttcaaccccataaacttccaagtctctttggtccagggcttcccactcctgatctccagcaggaagatttccgttaagtcttcacacagttcccaaagatctccaccagcctgggcacctacggaagttggggccccattactctttccccagggctctcttccctttgcagtcagagctctcagcatcacgtgcactcatgcttttgtgggctaatttgtctactttctctctcccttggcaggctgcattttccacagactgccacagcaatatctcccaccccacctgcccttctgcagggagaccttgactccctcatcataacgagggaccgaattctcctccacagtccccctcggggctggccagactcagtggctccttgaccaacaggatgcaacagaagtgctattctagacttctgaggctaggtcagaaggaggcttgcagcttccccctgcatctcctgggacactcccccttcaagcccagcagccataatatatgaagcccaagccacatggagagagagcacataggggctccagtcaacagctcccagcttccagcaccgacttcagccatgggagcacaccatcttggacatcccaccccaagaagcctttggatgacagcagctccaaacaccatgcggctgcaactgtacaagaaacacccagtgagactgccagctgaacccagttagctcatagtactgtgagaagtagtaataaattattgcttcaggccattacattttgggatggtttgttacgtagcaatggatagccgaccttctcgccccacaccggactataagctccatgagggcaggagctgtgtctaatttagctcagtgccacctcccccaaccctggcatacagagggacatatagtaggggctcaataaatgttgaatgaatggatgagtgaattaattgattggtttcaaaaaagcaggcctctgaatccccacacaggtagaggcagaaggaggggaaggggccacagtgcagtttattgtctgacgataagtattagattgaatcatataaaggtgccattttttaggtcaaaaaagttgaatattggcaatctcaaatggctcagcctcacatatgacgaggttgccctgtcctgccagcttcttcctgcagccaggaggaagagggtacacccacaccaggaaaccccactacaccacacccacccaaacccagcttccctgaacccaagatatggacttgggggacattctatgagcaaagagaggcaataacaaaacctttcacctcaatcatgtttcgctggaaagcactgaattttcaggccagtcacaatggcttacgcctgtaatcctagcactttaggaggatgagacaggagaacctatggagtttgagaccagcccaggcaacacagtgagaccccatctttacaaaaattttaaaaatcagccaggcatggtggtgcacgcctgtggtcctagctacttgagaggctgaagcaggaggatcgtttcagcccaggagttggaggctgcagtgagccgtgttcgcaccactgcactccagcctggataacagagcaagagtctcaaaaaataaagtaaaagtagtgaattttcccacctcactgagctactgcccttaagaaagggcttgcattcaagatgatgacgttgagagcagacagcggaccctgcagaaacgctgtgcagcaagacagatggccccatgccctctagagggaaggagcagcagaggccttgccagggacagagggccttgccagggacagagggaggtggcacagcctcccctacaccctgaggggagctgagtatggtgtgagcatctcctggtaccattttacactcacactgccccatttcgatgaggacagaaactctatgtggtaggtacaatggatatccccattctgcaggtaggtgcaatggactcacccactttgtcaatgaggaaaaaaaaaaaacaaggctcaggagcccattcaaagcacgtgccaggaagggcagagaggaatttgtatccaggtcttctgactctagatcctgactcttttttttttttccaagacagagtttcactctgtcacccaggctggagtgcaatggtgcaatctcagctcacggcaacctctgtcttccaggttcaagtgattctcctgcctcagcctcctgagtagctgggattacaggcaagcaccatcatgcctggctaattttcatatttttagcagagacagggttttgccatgttggccaggctggtctcaaacttctgatccacccgcctcggcctcccgaagtgctgggaatacaggtgtgagccaccgcacccagctgatcctgactcttaaccactatacggaaaggcagaaagggaatgcctgcaaaatcacggggcaggggacagctggctgggtccactgccaggaaaaggggaacggggagaggccccaggggaccagactgcccacaggctgccaggtctgagaacagcacatttcctaccttcccagcagggcttcgcaaggtcatgagccagggccaccagggcctcaccctcccaagggccagctagaaaagggtcagccaatgtcggcccctggccagcacacgaatcagaaggaaactcacccagaaggatgcctcttccttgctctcgtgtcccgggagtcagctagtcagcagagagccctgggcacactgaaaacctcccagccaccatcagaggtcccacctctggggccacatggctgagtatccacaagatggaggcagggggccaggagctgcctccatgcacccgagacagagagacctaggacagagcttgagagacatgcgacaaaccagggtcaacaatcacacgcactcacccattctttccttcattctttccacaaatacttattaagtgcctacggtgtgccaggcataacacatgcacatttgctgcaacatacggggtgctccccaaccccattcatcttggcggcctcaaagcccacacaaaggctggcacagaaaagatgcttaataaatatggggtgggcaaatgagtgattagatgaataaatgaatgcccaagaggatacgctaagtagtaaggggccggcatccagggctggggctggtcggggacccagattccggtcttagctccagtacacctcagcccccaaccatgagtgaccttgaccaaggcaagtcccctacctgagcctctgattcctcataggcccaaaagaagcctgaatctcatgaacgccatcctctccaacctcacagtggggaggcggggctcacctgaatgcatggccactatgagacaggcacacagctcagctccacatcaggggatataggagccttgtggggtttcgaggggataggggaggccagagcagggatggacgggaggagaaagggtgcaggggagaagggagaccagtggagcggagaaagtgagagagccaggaacactgccaggtgagagtgagagggcagcggggtcagcaggaccagcaaggccagcaagccctggaaaggcttccccacctctcacttcttctcccaatcagatttggatgggagaccataccacccacccctgcagaaagcagaaccaccaggcgccacattctaggcatatccaggggttaccagagaacccaactgtacaggagccatcgggacactggggtagaggagtgcagtggagctgatggaaccaagttgttgaaataaagacagtcattaagtaatgacacatacaagcagcagatggctggatgcatgttccagggactgtcggggatgacagagaaaaaacagaaaagaatcacaggctctgaagccagcctgtctgggttcaaatccacactccaccatttagcagctgggggaccatgaacaagtcacttgccctctctgggactcatttaattaagtcacataattttaataaggtgatatatacaaagccagatgcttggctcatagtacagcttgagacaatggtagctggtaagcactgtcttgctgctgggttatgattcaaaccaacatgtgcagcatcgcagtgcagacaaaagctggaggcgtcaaacccggaggggtctggcaggaggcctcacatgctcctgaggatgcaggaggacaaggaatgtcatggcacaggccctcttgcaaggcacgaaaatgtccatgcataccaaaagaaaaaaaatccactccatcaggagaggaaagtcctgggtccaagtgtgaatcctccccttcccagactgtgcgatcctgagtaaggtgcgagccacctcctccgtgaaggggtgtgatcagcttacaacccacaagcccactgttcttgtgcccgccctctgtaggtggctgagggaaaaacggtccaggaagatacctaccatttccaaagtctttaccctggagcaacacgtttgtttttttgtttttgtttggtttttttttttttttttttggagacaggatcttggtctgtcaccgagggtggagtgcagtgatgcgatctcagctcactgcagccttgaactcctgggctcaagcaatcctcccacatcagcttcccgagcagtcaggattacagatgcaccatcagacccaggtaattttttttcccccaagacagagtcttgctgtgtcacccaggctggagtgtagtggcacaatctcggctcactgcaacctctgcctcccgggttcaagtgattctcttgcctcagcctcccgagtagctgggattacaggcgcctgccaacgcactcggctagacccaggtaatttttaaaatttttgtagagatggggttttgttatgttgcctaggctggtctcaaactcccagcctcaagtaatcccacctcagcctcccaaagtgctgggattacagaagtgagccactgtaccccgccgacatttctttttcattaaaaaaaatatcctccaccctaacagcctgcacgtttcctaaaaacatgttcccgagggcaagatgccttttctgaatctgagcaccaggtcaaagccctggcttagcctctattcagtgttcgtttgggtcctgctcacagagaagaaccctctcctccatgaacactctctcaagcaggccccgggaggggtgtggccagggctgggcaaagagcccaccaaccccaattccgcactcggcttgtgcatccattgctggccccaaattccaaaaggcagccattatttatcttcaggtttaaaatatttgcagtgcaggcagcggggtaacatttaacactcagcctaaagggtccccttggcagcagagctctaggcaaatattttaacacataatttgctgtccaagttcggcttcttaaataaggaagcaacttcctgatggctgtctggggagaccccggtgtccctatcggtgcctgtggctctgtggatggaatttcaagccaaggtccgtcagagacattgaacctgacctcggctacatcacacaagccttgctgggctgctccgtctggccatgagggactgatacaggacaaccctctgcagaggcccacagaaatgactagaaacttccagagaacgtatcttcagttgtcagcaagtctagaacctaaaggactagcagtgtgatggcaatcgcctccttcaggccagaacttccaattcctttgtatctttcgcctcgtgacccccagcccctgtcagggagacgttaccaccagacctattttacagacggcaaaactgaggctccgatggctgagacagccccctcagtcactcggataacgagtggagagaagctctcaactccaattcccccaccaccacacaaattacagaaatgagtgtacaagcgaatggggtgtggagtgagcacacagaagcccacccagggaggggtctcaactcctctagatggtcagcactgcaaacacacctgctgcttttttttttttaaagaagaaaatccatggctcacagctgtaatcccagcactttggggggccaaggcgggtggatcatttgaggtcatgagttggagaccagcatggccaacatggtgaaaccctgtctctactaaaaatgccccaaaaaaataaaaaattagccgggcatggtggcgcatgcctataatcccagctactcggggggctgaggcaggagaatcacttgaacctgggaggcagagattgcagtaagccaagattgcaccactgcactccagcctgggcaacagagtaagactctgtctcaaaaaaaaaagaagaagaaggaggaggaaatccaccgttctctataaaatttctggatgatttctaaatgttgacttcaagttttaagaaacacagtatgggctaaacaatatgccttggagggctggtccagcctgggggctacccactgagggtctctgccatggagtgtgtccagcaagagcccctcagagcccctagagcacagggtcatctgctcattcctcaccagaaagagcagtcagctgagcagtcagctaagcagtgatgaaagtgtctcttctttagagattcaggaactgagttcaagtccatttttgtgcaagaccttggttgcttgtacttctgagcctcagtttcctcacctagaaaatgaggatggtactcatgctgtggatgctccctatgggaccactttccaggtgacctcactccaggtctctgcccaccaggcgctggtcagcagtgagctccctaaacgttggaaccatgtcagacacaaatcctccacatcttcaatcagtcaacaaacatttactgagcacctactatgtgccagcccctgttctagatgcaaacacatgaaagaaccatacacagctccatgaccaggacaggctgacatttggtcacaaggaccttgttttttatgggtgttccatacatgcacgaatgaatgactctaccctccctgcagggctcagctgccacaaaatccccggaaggtaaagagagatggcagcttccccaacctcacagacacttgcactcagctctcaactacagtgggtcaggaatgagtggaaagaaaagaaggcagatgagagggagggaagaggggaggagggaagcaggggggagaaaaataaacctcaaacaccccctgcaagaaaaaatcaaatttatttttccagcaagtagttaatggtgtcactcctccaagccttacaatcttaataaaactgatctcgccgcgtgcagtaatgaagaacagtcagacaaagccaccctggaaccatgaaaattgtgcactgttacctcctcgtgacctcctgaggcagtgaccattctgccctcgccttgctgtcatgttttgtctctgggaagggggagatgggggagcagggccggcggtgggcaggggagggaggatggtcaggcagcgtggggagctcgataaatccagctaatttgtggccagtgctagtgcctgacactcctaattgctctcagtcctggagcagaactcaaggctaggatgctggggcgcaaatcaccccccttgtggctgcaaaaaaaggatcccggttaggggaagaaaagcagggagaggagggatctgtacccctaaaaccagaaccagtggccaggctaatggagtttggctcagagccaaggataaacagaggcggtgtgaatggagagcccagagcccaggggccaggcatcatcgctgtgcattccgggcaaggtgtgccctctctgggcctcagctgccccatctgtaaattaaggcatggaccacagagaagcaattttaaaaaccatgcaccttagcagctcaacactgtgccaggggcaggcctgaggacagaactctaagacaacacctccacacccagggagccccgctgccgcccgccttccacgccagggtcccgcagcagcactttgcagaaagagcctcactgtcaaaatagaaagtgtgtaaaagttcacctgcccaactcctcctcaccgttcaggtctcagctcagtgaatctgcacccccacagggtcaggcctcccctgtgagctctgggagctcgctgggcacctctccttctccacttatcatagcagtcctcatgattttatttgctggatgtgcgaaggtctcctgggcatgcaagctccaggcaggcaagtccgcatcagttttgttcactctgcttcccccttctccacctctcagcacccagcatagggcctggtacacagcaggtgattaataaggatgtgttgaagaagctgtctggaagggcccttcccactctgacatttaaagatccagccacaggtctgtatttccagggagggatgggacaacaggaatgaagcccgaagcaggcccctggtcctgcctgctgccccgggacacagggggctcaagggactccccagacccggctctagggcctctattataacccaaaagccagcagctcccttcccaccaatgatcctcctaccaacgagcctccaggtgggcctggagggccaggggagccccctctccctccagtcgcagtgcagaggctccacaaaaagcctttaaaaattaaccagttgccaggcatggagacagcctggtgcgcagccacgttccagggaatacggaagtggcgcctggagaaaagggagcaggactcgtggagtggctttcccgtgctatcccaccccaggaggagtacactcagattccaaggagccgctcccagtaaacccccatctaggcacccactcactggaggagggtggcagcctcagcccacctccaaggatccatgcaagcagctggctcctccaggagaccccaggggtctccccaccgcttaccctcatccacttgctcaggtctgccggctttctgccgacttcccgtcagtccccaagagggtgtttggagccccacaagtgggctgtaagacattctctgatgtctccagaaacctggattctggaagcaaggcacagaacaaagccaatggcctgggcagcatgacacgtctgccacagaggtccgagaagcctcagcacacacacagccaggcagggtgtccccatgctcagcacacatgtggccaggcaggctgtccccaggccgagcacacacatggccaggcggggtgtccccaggctgagcacacacgtggccaggtggagtgtccccaggccgagcacacacatggccaggtggggtgtccccaggcccagcacacacgaggccaggcggggtgtccccacgctcagcacacatgtggccagccagggtgtccccagctcggggttggggtgtacccagctcggggtcagggttttgatggggactgcactcagaccccccagccagtgacagcaaggcctgtttggcagcctaggacccctggattcacattcctaggcaaagagatgcagagacatggggggattagccacaggccaaaggtcaagtgaaccgcaccaaggaaacttccagacccaccccagggacctggctgcctctgcctgatggccaatatcagtgtgatctacatgcacacgcacaccccacaccccactcaccacccccaggctcctcctcaaaccatcacttaactcggatttcaaactgctggcgatgttctttagtcaacatgaagcagaaaccttttattaaatgctgctaattttttattgatcacactgtgaatcatttcattttccattaccgcaaatgtctcctatcagagctccacgatcaggcttctttcttcattcttgagtaacttgtcacttttaatcagttttcagtttcggtctggctcaaaaattagaaagcgggctctttgtatcattattgcttttgtttaaaaaaaaaagtttccatgcaggaaaggttattatactcagaataaatatacatgaatcaaattcagatgaaattcctccctggctctaaccaattttaccattagcttttataatttttttaggtttattttcacagaaagactgctcataattattgctcgtgctctcccaaaacacttatgttactaaagtgcgaaatgtcttctaacacaaagacagatctctgggaagtaattacagaaatgcattcaggggcaataattctatattagctgtcagcagcagacatcctctgaaaggcacttgttatgaaggaattatttgtgctactattgaaggcatggcaggcaagcccaaacttaaagactgcatctgatcagaaacatgggctccctcatcaagggtcaaattaagtttaaatcattaccttgaagcccagcaaactcgtacctgactgtctattgtgaagacatttttgaggcgcactcgagcgcgacgtggtcttcccgttcgcagcgtggtgcaattacccttagtctcaaaaggattctgccaggagcttgtcacaatagggagagaggaggtggcagggtgtctattaaatgctaactcgtgtcaccaaacagaattttcaagaattataaattgccgagatgccttgccgctgaccccctcgtgttaagaagagcccagaatattatcaggaaagtgcaagaatttgcatcaaaggcaggaaaggactctctatggggagcccacggggatggagctgaggggactgggacccagtgaactatcccctcaccccacagaaggtccaactgggatctgcgccccaacaccagcttactcagggcagagaaataccctaaaatgaggacaggtgcagggggatctgaggaagtacgtaatttcatctgagctttgtccctaactcttggcatgacctcaggccagtcacttcctctccccgagcctcagtttccccacctgtaacaacatcctacatcaactctgtgtggagggcattctgtgagtggaatgcaatgttggcccctgctgttccaggctctgtttccccacctataaaagtgcaggattaatttcctgcaccgttaaaggaatcacctggccactgggtgcgggaagaaaatgtgggacaaagagcagagcagcttcctgtgagagcgggtctcacagatatctcagatctgcttggactcatcgagcctcagcttccccacctcaaaagaggacaagctaaaggtcatagcctggggttgcccttatcaatcacagtgaagcacaaacccaggcttctttcatctgctcacctactgctattgccaaaaagacagggtactttctctttttttgagacagaatcttgctctgtcaccctggctggagagcagtggcacaatctcggctcactgcaacctccgcctcctgagttcaagagattctcccgcctcagcatcctgagttgctgggactacaggcacccaccaccacacctggctaatttttgcatttttagtagaaatggggttagctggccaggcaggtctggaactcctgacctcaggtgaaccacccacttcgacctcccaaagtgctgcggttacaggcgtgaaccaccacgcccagccaagactgggcgctttctaagacagctcagggcaagaagcaaaagaactacttcctcctaacagctggagcccatctacccgaagcagcacctcacggtgcccagcagtgctcagcagttgtggcacccctagccgtagcatcctgacctttccctgacctccgagctcggcccatgacccaagtggggacactaagacacaatccggagatatgctagaaccaccgggaaagaaggtacttaaagtggggagagcagagcgggcagacagagatcgggggaaagagtttgagccatgcccttcgactcagtcactgcccacagaagcttatatcctagaaaactcctgtttgtgaaagtccgccgtgagagtatctgctgcaggatgatttgtaatagccaaaaaaaattagcatctacatctccatgaacagcagatcgatagatagattgtggtacatttacagagtggacaccatgcagcaattaaaattaatgaaacagctacatgtatcaacacggattaatcttccaaacataatgttgagagagggaaaaaaaaagcaagttgctaaagataaactatctatatggtaaaatatggtatctatattgttttaaaacatgtatatcagtagtatttaaataccatttatatgtatttccagaaacaagacatacagggaaatgaagaattgatatcatctataattaaatatcacatatctccagaagcaaggcatacagggaagtgatgaatgccaagccctaacggggcaggaagagtagggcactctggcactcagctgggtgaacgattccttaagctgaaaggtatatcctggacagtcgttattctcttctgtttatctgagatatttcatttaaaaaaaaaaaaaacaccattgctgagccactgaaaatttttagatcataaaagtttttaaaagaacagtgaataaattggagaaccacagggaagcacagaattttagatggagaaggcactgaagaagacagccaatccaatccagcgctttctcagaatctgtgacgcaagagattgtccccagggcacaaggcaagttagtggcagaaccagggctattgccccagccctgtgctccttccctccctccggtgtggaggagcctagccctggttaggggatgagcttgaataaatggtactgaggtgcacagtggctgtcacttgtagtcccagctacttgggaggctgaggcaggaggatcactttagcccaggaatccaaggccagcctgggcaataagtgagaccttgtctctataaataaataaacaaataagacctaagtatattgttctctcagagcaggaacttctatctgttcactgtggaatccgaagcacctagaacagtgcctggcacgtagtaggtgcacaataaccccgtgttgaatggatgaatgaaggtagactgaggtgattaaagtcatgcacatcattccataaagcagaccttcttggacaagccccattgctggacaacaccaagttagtcatttttcagtaaatgcagattttccacctctgagtttaaaaagaaaatcacttctcaccaattttctgaccctcctgtgggtatgctgagattgtgagtcatggctgaggctggaaaaccaccttcggggagatgagaatggaaaacggcctaattcaaggaggagccaggtactgcctaaaacgcgtcttggcccccttccaggagtgcacatcgaacggaaaaaattactccaactctctccgtaggagaacatctgccagctggccgaccaaagtagctggttgctaagaaatcacaccgggtgacatcacctgatcacttactacaggcaagacatggccagggtcagagttcaaaacagtttctggaaatctttccagcgaagccccttttccgtgcagggatgggaggatgggaaagtatcttgatgggtacccacctgtgaccccctgccctatgacagaggtactattacagatagggaaactgaggccccgagggggaaggtcactgctagagggtggtagaagaggggttccagcttcttctgagcatcgaggtgcttcccgggataccaggttctgagccccgctgtgtgcacccctctcatgcagaaagaggtcaacagagaagtccagcgcatggtaaagaccagcgtgaccacaggctgcagcttttccacatggacaatgcggtttctatggagtccaggggctacggtcccatctccacggcattaaataaagagacgaggaaggtggcgaaacagcataggagagtaacctcctctcaagccaaggcaccactccacaggggtatctagcagcaccaagtctcaccaaagacagaagccccagaagtgaggtcccctgggagccctgggctatgccaggagcaggagtgggtgcaggaaggacccagcccacccccacaagaaacgcccatgccggggaatctgcccacactgcaacaagcatcccaggtcctgaccttgacagggatgcagggcgtgcattcggccagcctgtggtcttacccggctttctccccagaactgcttctgtgtttctgagtatctttccttcccagaaaaaaacgatgctttactgttatttctgattacaaagataactgcgactgatgtcaaagatacaagccatacagaaaagtataaagaaaaatagtaaaaaacacctgaaatctcactaccagagcttggggctgtgaccactttgatgagcgcgatcccgcacatcctctcctgcgtttacggacacgcgcagcaatcgccgtgtgcgaatgggatcctgcgccacacgctgatttgtaacctttctacactttgttccactcgcccctgggccatggtcatctcttccagggatcgttttgagagtctgcctttaaagtttcgtctggagggaaatcacacgggtccacaactcctagttaaatgtgaacaggccccagtagtgaattggggaggggtgggggtggggtttctatcttagaaaaggtttcctcgctttgcaaatgggttcaccctgggagtctttgcattaaggagattctccctcccgcgaacgcatgtgtctctggaggtgcaattcagggggccacctgcttcagcattgctgccatccactctccccacatcccagtccatccgtgcagatggaaagggccatgtggtggagagttggggctgaccttgaagggaaggctgccgtcagcccataccttgccgaacagcccatctctggctgtcactcacacctgtgcaggcaagtgcaagctcacctatcatgctgctgctcggggtgagtcacatcggggctgcttccttgcacccagtgatctggggaaaagtttaggaaattcctactctgggaattctcagttggcggcttcctctcctctttctcctccaccaataccccttcctaggcacaaaattgtgaggcttcctgggttttgtcactaacatttaaatatggggcttcaagtcatcaccctccaggggccaagtcaggggtttccaagaagtccctgcattcctctgtcctgggggatcccaggtgggggaagtgggctgggtgtttctgggaagcagactcctctgggaggtaccttcctctctttctgccaactgccagcactgagtcacagaagacgtgtcagccagacacagggaggagggccagagcccccagggtcagccagacgctcctctccagaagagaggcgcaggggcatttaaggccatctgtgcactcacaaaacactcacggagaccctgcaacgtgccagggactgtcccagagcaaaaccgggaatgaggtggacagatcctctcagggagtttaccctctagtggggaaaaagacagaagatgcataaatagagaaataaaatcattgctgtgagtgatcagcgcatccaaggaaataaaataattgacgtgacaggggctggaagacgccagctccagccagagtggtgagggagggagagcctcactgaggaagcagcgtgagccaagctgcagggaaccagacggtgatggtgacagtgatggggagcagcaagcacaaaggaacctgaggcatggagcatcgtgcactccaagaaccaagcggaggccagtgtgtctacagcacagagctgagagacagaggcccgacggcgacgaaaggcccgaggaaggcccaggacacgccatcaaatcctgaaatcagaaggtgctgggagagcccctcaagcggcccagagtccagtgcacacaactccattcaaggcacacatgggaactccagactgaagatagactgcaggtgctcatgtcacatacaagactgtttgacagcctccgtactttaaaataactcagcttggtcaaatcttttatttttgttgttgttgtatgagacagggtctcattctgctacccaggctggagtgcagtggtgctatcacagctcactgcagcctccaactcctgggctcaagtgatcctcccacctcagcctcccaagcaccaccacacctggctagtttttttcaaaaatctgttgtagagatgaagtcttactatgttgcccaagctggtctccaactcctggccacaagcaatcctcccaccttgtaatcctagcactttgggaggcagagatgggagcccacatgagccaccgtgcccagcctaaattggtcaaatcttattgggaaacatttctaacatgagagttctgagttagcaatatgtacccagctccatgcaaagtgccttggcctgggcactggctgcaaggtcagacctgggttcaaatcccatcatgacctcagccagaactagtcttctgatttattaaagagtaaatgatcttcaaacccatgctgggcttctgagtgtcgggagaggaagaagcagtaccacccatgcatgggctctgctccccaaaataatgatgggatcagccttgccaactcagcaactatgacagagagtggagcttggtgttgtctgccccagaggtgcactggagccacagtctgtttttcttccttccaaggctaaggttcagtggttcagaactcaaactcccacccaggcaggacagtgaagaggcccccacagcccagggagggcaaggtcttggccaaaaccccacagcaaggagggagcaaatgcagagcagcagctcatctcaggacccctagtgcccaccccaggctctcctggcccgtatcaaagtgctcacccccaaatccagctcctgcagaagaaagcagaattgtgtggccacatttccccctgcctgatattcactacctcaggaatcaaagaatgcgggccactgtgcccgtgacgtggcccaggaaggcattgcaaacaggtggcctgatgcctcgcctggcttccatggcccccaggcaagaactgcacaccggaattgggagagggggtgcacaccagtggccctcccccaccccacatggcttgggcctggggtcttcaacatcccttcctgacggtgtcccagccacagaaacccttgcataaccacctgggcatccacagcaccagccatttgacccagtaggggtctgggggagcaaggctggtccccctttctgaccatagcaacatcaccagagaactctagccctggatatctctccaagcctcctgtccttttcaaaggggagcccagggaggccagggagactgtctagggaccacaggagggtggcccatagagcaagcaggcttgctccaggaggtcacagagcacagaacagaccccacgggctgatcaggaggagaaaaaacctgcacaaattcatcgggacaactgagggcatgggcttgaccttctactgactggagatgcatccccgtgtgaccctaggttaattacttaacctctctgaacctccatttcttcatctgtaaaatgggaggttgctgtggagctcattcaaggtaacagagagggtagcatgagcctcacatgtcctcacccactcaacaagtcaggactgcggggctgctgtgtgccaggcaatgtcctgggctgggaacacagcagtcaaccgcagagacaaaatccactaggcagcaaggaatataatcatcagaaaatcgaccaggcacagtggctcacgcctgtaatcccagcactttgggaggctgaggcaggtggatcacttgagggcaagagttcaacaccagtctggccagcatggtgaagccccatctctactaaaaatacaaaaattagccaggcgtggtggcgtgagcctgtagtcccagctacttgggagactgaggcaggagaatcacttgaacccgggaggcagaggttgcagtgagccaagatcatgccactgcactccatcctgggcaacagagcaagactctgtctcaaagcaaaataataataatcagaaaatctcagggggtgataaatgcaaggcaagtattgaaacaaaggtgataggaggctaggcgcggtggctcacacctataatactagcactttgcgaagctgaggtgggaggattgcttgagcccaggagtttaagaccagcctgggcaacatagcaagaccctgtctacagaaaaaaaaaaaaaaattagccaggcgtggtgatgtgcacctgtagtcccagctacttggaaggctaaagcaggaggactacttgatcccaggagttagaggctgcagcgagctgtgactgcaccactgcactccagcctgggcaacagagtaagaccctatttaaaaaaaaaaaaaaaacaataaaaggtgttaggacaggaactgttgaaaagcaaagaggcagcttcagctctggctatcaaaaaaggcctctctggagaaaggacatttgagcaaacacttgaatggcacgaggaagccaggcatttggctgggcatggtggttcatgcctgtaatcccagcactttgggaggccaaggcgggcggatcacctgaggtcaggagttcgagaccagcctggccaacatggcaaaaccccgtctctactaaaagtacaaaaattagctgggaatggtggcgggcgcctgtaatcccagctactccagaggctgaggcaggagaatcacttgaacacgggaggagaagggtgcagagagctgagattgcgccactacactccagcctgggcgacaagagcaagactccgtcaaaaaaaaaaaaaaaagccaggcattaaaaggtggaggaagaatagtttgtttatgcaaaggccccaacccaaggccaggtcaggtggggtttcataaagaaacggggagaagtttggctttagtaactcctccttgttgagcaaggcagtggcattgcccccacctaacctgccctctctctacacacttttagttttcaaagcattcatcattgcatttatcagttccctcctgcattcaatctggcgtaagctccaagagggcaggaaacctccatccagggtcattgattaatccccgatgcctagcacagtgcctggtccagaagagattctcaataatgtttgtttaattaagtaattataggcactcagtaagtgctcagtaaatgtgatcatcagggctgccaatagggatcaagctgctttggaatgagatgagactcccatccctggaggcatccaagcaggacctagaagaagacatgctagggaccctcagacccagaagaggcttccaggtcctcttccactatgaaagctgtcaggtctgccctatgcccagtgcaagggatggaggggcagctcgggctgcctcagggacagacagcgtctcagcagccgtaacacatgtgcaccaagccggagaagccgcctgcatttctcaatcactagagatgtatttgcacctcaaagtgcggcctcctgcactgcttaatgaggaaagcaatcattatggggggcttgcgggcctggggtcggaaggaaagaaaaaactttttttgccaacattgtgtacagagtgccaggcagaatggacttaaatcctccctcaaagggccccctgggcagggcacttcctgcagacaattggaacttggcctgtagggttcaacttcctttgtgttaactaatttctgactcagggttttcagctatttctttctagaacaatacactcactgcaacagtccgccggtgcggctatcttccgcggtggcagcggcacgctctcccctgcctccctcctcagcaggaggggagggaggtgtgaaaagccatcgaaaagaggtggctgggagcggtcaagccctgtccccccacaagtgcaagtctcattttcagctctctggagccagaatgcaagacaggaccccaggaggggtctcggagcccccaggatttctgggcaagcaaataacaaagcaggcgggaaaagagggcacagcccccagaagaaaaccttcctccctcggtcattaaccgagcccaccagaaccctcccgcctcctcgcccgctttcccgtttctgtaatctttttctaatctgcttgccgcttcctgcttcctccaaaccaccttaattgggaactctttagttcacaaggaaagttcatttctgctctctgaggacacctatcgagggtaagccaggctcttcatcataattcttaccagacatggctaataatgaccctctttcgctaatgaaaaaaacacacacatgcacacattgtggctgcggtaattaagcctgtgacgagttgagttggagagaaattagatttatttacacgctgttctgttgctgatgaagcacaagctatcgggaagctttctcattaaccctcgtttacagggtgtgtgctcttttgtgcctctacgaaccctctgtaaattgtagttggttaaaaaataataataattagccattcttagagtggagttttctcctataactctgttaatcctcgagttacactgcccagatgctgatggtaataaaatgcccaaaggacttcaggtctgagctgcagccacatcaatgcatcagccaacaagtgttgccggaatgcctgccacccgaagaccctgtgctagggacccggtggagtcagagacggccctgcctcggaggagatcatgaaatcttcctactggaaaggaactgggtgagtggctgattgaggcagaaagaatgatgcaggggccagactgaaagccaggctgagtccaaggttcaggtagaagaaatagggagccactggaggtttgtgagtgagggaggggaggcaaatgcagtgtttaagcaaaattagatgacagcccacagagatgactggaaggtttcagagacaagggttttcaaaacggacttgctgttttgaatcctgggggcagcctgcatcagcccaggccgcctatcaccagttacgacagcctgtgaggtctaagaggctctaagtgtgtggcccaccactatcttaatgacagctctctctttggagggactgtcattttattaaacacacatacagacattaaaatgcttcccaatttcagaaatgttaggcaatgacaaaatacacatcttagaatgaaaacagcatgaacatcaagcgcttggaaaacagccttttggaaggccagtccccgccacactgatacggaattggacccctccccggagttccaacactggcctagacaaagagcacccggactgccacagatgactccatggcacctttcaggggcatcttcccaccaaatgcgtgtctcgaaaggtccctgcccatcccttaagcttggacccagggaagcttcaagttggaagggacctaagagaccacctcatccagcccagctctcacctgcatggaaaggaggaggtggcaaccatcaccacctcccagggcacacgggcaaaaaggcacgggtcatgggtgggctgagaacagggggaagcacccatgatgagttcggacacttgtgagcacccctgaggacaagtccattgcgagatggcggggggaagccagcatgcgcggggaggggcagacatgaacaggcctcagaacccatgtccacatggctgcataattccttgttttcttctagagtgtgtggcacttttaaaagccaaagtcctgccaaaagacagaaaccccacctaactatagtgagaagtcccattttgtgtcaccaacacacaatagacaactggccctgtgcaagtgtttttgtttttcttataaattacttgtcacgatgcacaatgacagttatttcttttccattacgctgtgcaatgttgggactgaatccaacactcctgtgtcctccacaacaaagacaaaaaaatagacttttaatcaacgcttatttataaatgaggccaagaatttccattctcattttttcctgtttccatgtgctattggagattccataggttcgtgatgctcttcctgactcagcttaaaactggctacaccgacatctcctacagtctgaacttctaacaaagggagccttcagtaatgagtcataaaaccactatcctgttcccatgtagagaagattaggtgaataaggaggccagccccctgctcctaccaacagcaaggcttgatcagccacctgcttgaagttaagtttccaggacatgaggagcacctgcatggtgaggactgcagaatgctgttgacccagcatttgaaaatcaccatagccctctcccatagaactcacctgtcagtaacttctaaaattcaacacatccctcaggctattgtggacacccaaaccaagccagacacgtgaccacctgcctccaaatcccccttgggtggggtgaggagcccggctcagcaggaaatacacccctgtcatcaattctggtgaagaaaggcctcaaagacaaacaccccacgtgccctggacagccccaacagcaaactcaggtttccctgccgtggcaggtgggagattaatttcccccagtgtactgaaggggaaagaaagggaaagaaagaatgacgcacaggatctcctttcccctcatgttaatcctcccctgacccgccctcggctcctcccctccacactgttggtccccctgcctgtggtcaccctggttcaggactgcggtacctcctccccaggtgactgtaaaacatccctggcatctccagcctctcatcaaactctgagtgaacacctgctaaatggtaggcacttcctgcctcgccttcacctgccaaaggtagaaaatggtttacccgggagcctaatcaccagaagcttccagatcaggaattgttagaaaggaatttgtttttttgagacagggtctcgctctgtcaccgaggctggagtgcagtggcatgatcttagctcactacaacctccgcctcctgggttcatgcgattctcctgcctcggcctcccgagtagctgggattataggcacccgccaccatgcctggctaatctttgtatttttaatagagacagggtttcgtcatgttggccaggctggtctggaactcctggactcaagtgatccacccccctcagcctcccaaagtattgggattacaggggtgagccactgcgcctgaccaaaagaatttttaaaataatcagctgggcatggtgactcacacctgtaattccagctacttggagggctaagtagggagaatcgcttgaagccaggacttcaagaccaacctgaaccacatagtaagaccccatctctacaaaaattttaaaaaatatccaggcatggtggcatgcacctgcagtcccagctactagggaggctgagatgagaggatcgcttgagtctaggagtttgaagctgcagtgagctatgatggcaccactgcactcccagcctgggcgacagagtggtctccaaaaaaagtaaaataatcatcactacaaaaaaaaattactccctcatgttccttaaagaatggcactccaagtctaaattatagtggcaaggggtacacacgtgagtgacagaactttaaaacaaagcaagggtgtgatcaccataaaagtcaagctagtgattctttctggaaggagaaacagggatggggaacaaggataagccttccgaagtagcttgcaaagttctatttctagacctgggaagtggtttcaatggcgttcaccttataaaaattcactaagttctacattgactttgtgggtttctagatctgtgtttcattttgcaataaaaccatatttttaaaaaaataataaaaggaaagcttgctggctgggcatggtggctgtggctcacgcctgtaatcccagcaccttgggaggccaagacgggcagatcacgaggccaggagttcgagaccatcttggccaacacggtgaaaccccatctctactaaaaatacaaaaaatcagctgggtgtgttggtgcacacctgtaattccagctactcgggaggctggggcaggagaatcgcttgaacccgggaggcggaggttgcggtgagccaagatcgagccactgcactccagcctgggtgacagggcgagacgccacctcagaaaaaaaaaaaaggaaagcttgctatccccttgcctaggtgcaatgcaacccaagagccagcgaatggctgcagggtgacatctagccagcccagggtcaacttacagataggtgctacagaccctaacagacaaccctggcgggaccacagcagcctcaggagcagcacatactcatgaaagttctcagccaggagtgcgctttgcagggcaatggctgttgaaaagcatggagttgcacttctgcaaatccagacaccctctgaaacttcctgcttttaacccctgtgacagcttagagttaagatcccaaaactctggaagtgttgtaagtttggaatgtgttgggtgcctaacattccaagtgtaaagtccttttttgtgtaattccacaacctccttcagacgtcacaggaggtggccctgtctgtgcagatgagactagggtccctgctgcacctgccctttggccctggttctctttagagagattgcgagttgtgggtgttcccctgggctgtagctccaagggccaggatcactttagacttgcttacactgtaaccccagtgcctagtgtttgcttagtgaatgggtgaatggatgggtagatcaatgggtggatgggtgggtggggtgggtagatggatggattaatgactgaatggacagatgagtggatgaatgggtggatggattgatgaatggatggatgcgtgggtggatgaatgggtggatgggtgggtggggtgggtagatggattaatgaatggatggatggatggatgaggggatgaatgggtagatgagctgatgaatggctgaatgggtgggtggggtgggtagatggatggattaatgaatggatggatgaatgggtggatgggttgatgaatggatggatgggtggatgggtgggtgggtggggtgggtagatgtatggattaatgaatggatggatggatgaactaatgaataaatttgtcaccctttcacaagagctttcctctccagcatatcctctaggggattaggaatcatatttgccttacttgccacggacccatcagcacctgagtcagggttcggcacacagtaggcctccaatatatttttataaatgaatgggtgaagaaaaaccaactgtgctagggatagaggatacgaagatgaccaagacatggtcctgccgccaaggacctcaccatttagccaggaatggagaaacacacatcagacaatgtgatgagggcaagcagcacaagataggagcacagacagaactcgaactgagcagagaatgagggagggcttcccagaggaggggacctggacctgactcttgattgaaaagccagaaagtctccccctgagactcaggacagcacccctaggcggtggttggggtcccctccaccccactgacttctcccccgaccatctgctatatccattgcttccaagagtcatctccccaaattccccctgccatgccgtcaccaccacctccctccaacacacacacacacacacacacgtacacacacgcatacatgcatgcacatgaacacacatatgcatatacgcacacacgcacacatatatacacataaacacatgcacacgtacacacacatgcacacacatacatgcacacacacacacatgcacacacacaccctctgagaaggccctttgcctcccaaacacagtgtgacctgagagaggttcagcccaggttacttgccctctctgtgacctgggtctccccagcaataaagggagacaatgacaatgtctacctcataggactgctggtggttaaatgtgagaaaccatgaaagggtcctgcacaacactgggcaccatagctgccaatagctccattctgactgccattgctacgactgaggaggccatactacagaggaaagcaaacctggcctgtgccagcctgctcccatgccacggcagggccttcaccctacacacagatccccagcgagcctgctcaaatgcagattctgcttcagcaggtctgggaagaagcccaagattgtgcgttactagaagctcccagtaaggagaacgacgctggtcccaggaccacgctctgagtagcaaagactcagcccaactgaactcattacctcacctgcaaaacaggagccataaaaaccacctcccagggctgttgtaaagagtaaatgcagcaacatgcgtgcgtatgggagccctcctgcacccagataggcacagagtgggtgctgagaaaatggcaactccttcctccatttcctccctcctcttctcccactaaccagctaattctgaatactattgacctctgcacaaacatccaaggtacagtaacagtgttcaaataaggcttaataagggaatgaatacatgaacgaatcctttaaaaagagagagagacagggtctcattctattgctcaggctggaatgcagtggcacgatcacagctcactgcagcctccaactcctggactcaagtgatcctcccacctcagcctcccaactagctaggactacaggagcatggccagttaattttttaaaaataattgtagataagatgtctcactatgttgcccaggatggtctcaaactcctggcctcaagtgatcctcccacctcagcatcccaaagtgctgggattacaggcatgagccattacacccagcccaaatccatatttaaaagctgctcagcaaaggcgttgaggcccagcaggctgagcctccgtgcccagacacctagagaagcattatgttcagaactgccagccctttcggaaaatgcctgtgaatctcaatccccacaccaggttgtattagtcatggtgcacgtcccccagcgccccagaaggaagtgggcctccactgagggcctaagctcaggcagtgtccacctttccccatgtcttccctccatctctggctataggagcccatgatgcccagacagaatgccccacacagaagcctgtggccagcccttcgcagggcacaaagaccccgagtgagcttcccaacctctctgtgaggctggtgagccaggaatgaccatgtctgtgtctagacaagaggactaatgttcatgaggtcaagcaatttgatgaggtcaggccaggaagaagaaaagataggcatcctgcacctcattctagaacaatttccccagcataagaaggcccaagacttactttacaagtgcagaggggaggactggagggctggcagctgtcactcaggaggtgcaaggacactccagactctcccactaccttccgctctcgggaacggcctaggtgggccctttgactcttaccttcaacaccccatctgaaggctgactgagcccaggcaaccagcccaacgcttggtcttggaatatcttattctaataattgagggggaaataagccaagtaaaaagcccacaacctccacatcactgaaatgaaaatgtttaatctcatcagttcttttcacgtccctttcatgatcatagctcactgcagcctcggactcctggactcaagcaatcctctcacctcagcctcctgagtagctgggattacaggcacacaccaccatgcctggctaatttctgtatttttagtagagatggggtcttgctacgtcacccaggctagtctcaaactcctggcctcaagagagcctccttcctcagcctcccaaagcactgggattacaggcgtgagtcactgtgcccagcatccctttcttattcaggtttaactcacaaatcttaagcaaactgggtgacagcaggtatttttgttgttgttgttctttgtactctgggttttttggtttttgtttttgttttgttttgttttgtttttgagacagggtctcactctgttgcccaggctggagtgcagtggaacaatcatggctcactgcagcctctacctcccaggctcacataatccacccacctcagcctcccgactgggactacaggtacatgccaccacacctggctaatttttgtattttttctagacatggggttttgccttgctggacagcaaggttttacataaatgagcacacaaatcaaggtatgggacattccctgcaccccagtaggttcccacatgtccctccaaaggcagtcacttcttcgcctctatcacagacatccactttgcccactccccagcgtcacaggaacagacacgtgcaccccacttctccgctgcctctgcttcctttgctcaacatgatgtctacacgagtcacccacacttgggggtggcaactggttgttcatctttattgctgcgttcatgccttcctgttaatttttgttttccaaagggtcagtttccacccaatccttttgccccatccatgtcaccatgaacaaacagaagaccacagatcagatcagcccgttccttccttcccaccatttgctgggtagctcgtttaaggtttaaagcatttccatcaccatgtctggcaaccagacaccactcagcggagagctacctctcctctgacggacctttgtgcagaaagtctcacggctgaggcagcctgctggccccacgggcaggaggagacaggaaaggggctgtgtctgtgagtcacccactcccacagccaaactgcaagagggaggaggtcgatgtacttttctcaggccaaagagaggatgtgtgtggggaagatggatgttggcaagagcccccaaccccacagaggacccctcgctcccatgccctgctgcggggaacatgagagccactcccagatacgcagcctctcaccaccagtcccctccagcataagagaagaccatgctgcactgggtcccactcaccccaccattcctgaacaaattaaagcaacccagtgtccatcaacagaggaagggataaacaaaaagtgggctagacacacaatggactatgattcagccttaaaaaagaaggcgggctgggactgagctcatgagggcctgcagagtggagacttaaatccaaggtcagggcaaaacatctggagttcattgccaggactgtgatgttacagaaaaggaccgtgaaaggtgcgtgcgggacccaacacagaatcgtggccatgaatgggctcgctgaggacattcgacatcagcggtgccatgagaagccatgccaccagcaacaggggaaagctacggaacctgctggcagatctacagcatggagatggctccaaggatcaacctcttggtggaaaagaactgtctggatcggcggggctgctgagcctgtggatacgacacccacctcttttttcttttctttttttttcttttttgagatagagtcttactctgtcccccaggctggagtgtagtggcacgatctcggcccactacaacctccgtctcccaggttcaagcaattctcctgcctcagcctcccccagtagctgggattacaggtgtgcgccaccacgcccagctaattttttttttttttttgtatttttagtagagacgcggtttcaccatgttggccaggctgggctcaaactcctgacctcaagtgatttgcccgcctcatctcccaaagtgctgggattacagccaccacccccagccaagtgcctccacctcttttcttcctgcaaccccattcttggttacctttctctaccttcacctcaatcccatgtatgcaaaaaggctgccacatagagaagtaaccccatgagccagcaatgagccttctcttttattaagtgaaagaaaaaactgagtagaacagtgtttgccagggcctgggaaagggcaatggggagtttgtgttttaatgggaacatcgtttcattttgggaagatgaaaactttccgaaggtggatggtggtggtagctgcactgaaaggtgaatgtactgtaacgccactgaactgcacacataaatggttaaaatgataaatttcatgtgacatatattttactataataaaaacaaattttcctgggtacagtggctcaggactgtaatcccagcactttgggaggccaaggcaggaggatttcttgatcccaggagtttgagacgagcctgggcaacatagtgagacctcatctccacacacacacacacacaaatattaattagctggacattgtagcatgcacctggagtcccagttacttgggaagctgaggcaggagaatcacttgaggccaggaagtcgaggctgcagtttgccatgatcgcgccactgcactccagcctggacaacagaacgagaccctaccttgaaaaataaaaaaataagtcaaagaaaagggaggaaattctaatatatgctacaagctggataaaccttgaggacattatgctaagggaaacaagccaggcacaaaaagaaaaatactgtatgtctccactcacatgagggcctggctgcagtagtcaaattcatacagatagacagtagaatagtggctgtcagggcctaggcgacggggaatggggagtgagtgtttaatgagaatagagtttcacctgggaaaatgaaaagaactctagagatggatggtggaggcagctgcacgagaatgtgaatgtacctaatgctgctgaactgtgcacttaaaatggttatgatagtaaattttatcttatgtattttaccacaatttctaaaaagaaaattttaatggaggaaaacagtagaatactgagaaaatgtatagcaggcagatgcaagaaaattcaaagcagaagtcaggatattaacataggaccaaatgcaattcaagggaaatatcattaaataagacaaggttgtttcatgtttttttaagtgaaggtttgcagctccagcgagcctaaaggaggagccaggcacagcggatgaggaaatctcctgcccaagaagtgacaggaaggctcctctccctgctcacacaggctcccaacatcactcccaggaaaacaaggtttgtggcaggcaagaaaacgcaggtgcttccgtcagctagagggagacctgatgccacagcactgagagaccctccttcagacatcctcacccacgctttttccaagcctgtgaccttcagagcaagtcccaggctctgggggactcccagtcctttggcttcttataaaacaaagtttcagatcccgggaggcccaggaaactcaaaacactacaggcctgagcctgagcctgagccgtggggaagctgctagcctctaactgaggcccagtctgaaaccaacaggcagattctctgcatctcggcaataaaagcaacagcttcagcagtgcagaccgagcctcggtccctcagaggccaggctcatcacagcactatctcctttctcacttcccggctgtgctataaactaggacctctgatcccattttacagatgaggaaactgacgctcacaagtcaagtactaaggttaaagtcccaagtaggaggtcctgggatgcaaacttatgacctggcaaactccagaaccccagaacccaattctttttttttcttttctttctttcttttttttttttagaggcagggtctcactctgttgcccaagctgtagtgcagtggtgcaaacacagctcactcactgcagtcttgaactcctgggctcaagcagtcctcctacaccacaggtgtgtgccactcgtgcacagataatttttttattttttttgtagagatggggtctcgctatgctgcccaggctggtctcaaacagctgccctcaagttatcctcctgcatcggcctcccaaagtgcggggcttacaggccaccgtgcctggccccagaacccaattcttaaccattagactgtgatggtcttctgagacattcaaacaacatgggggacttcaaagcctggagaccagggaaggccggggaaagcagaactcgaagtgggccaaggcacctccatctttgttcccagccaagaggctgcatcaggtacaaaaagaccaaactatcccttagccatcatcacactgattcatatgaaccattctgagattccacagcactgggatctaggaatcaatttgatccaacagcccatggagcgctgttcattgtcactgacatctaattagatgtcattcactgtcatccacaactgataaaaaaggaaactagtggaatgatcagagaggggcatgcgcagtcagaagtcacacagcaagttcccactgagttaggcctcatcctttaatcccagggagagtcagaccccaccaggcaccccaagaacatgccctcaaacacagcatcgaggacaacattccagcaggcaccaggacacagaaggaatcctctgaagtccacgcatccttccagccaggccaatacgcactgtctgcctgccagcctgacacttgggcctttgtattttattgctaattaatttggatggagatgtctttaaaaccaggcttacgtcgggtcctccccactgtctgtgaaccaatttcattacaacagaaaccgtgttgccaaaatgagaaatcccctccttttcaggcctgtgcccttgaaggcatcttattagaaaagaccatttcttaattaacatttttgatctttaatccattacacatccctctaatcctgtacggaggtgcggctggcccacttccgcaggctggctctgggctgcacgaggctggcaatttcagcgctgagggctcgcgcacagctggactctgccgtggacagtctgcagctcccagacaccacctctgctccagccatgggtacgtccctgagcgggagccgggaacgggggcgcggcgcggacacccccggatgggccagtctgcagacgagagttcatttcattaacccgtgagccccaactcttctcggcccagaatggtttcaagcaaaggctgttttagcagatccggctcccgcaaagcatgagagccgctaggctgggcttcccttccacacgtctcctgcaacctggccacatctaaacgaagagccggtgtcatcaaggtcacggcacatgtactcccacgccatcgcctgctttggaaagcagtggacctgcctggtgaccctgtccttcctggaagattttcttcatagggttctggggacctgcccgctcccagttttcctccttcctccctgacacctttctccatctcctcagtctctcctcatcatcccatccttcaacgtcgatgtcccaaccttcaatgccgatgtcccaacctgcaatgtcaacgtggccctagacctcagctcctctgtattcagtctatgctcaccccccagtgggtgcatctgtcccagccacacactcatggcacccaaaacacatcttggtcccatcctcccccgattgccagaacacacgttcaagtaccccctcaacatctcacgggcatctcaagcttatcatggacaagccgaacttttgagccacaccatccacaccgagctgccctacgccctgacaacttctcctagcaccctgcatctcagtgagcacagccccagccaccagctgcccaggccaaaaaccttgcaggcttcctcagctcctctccttttctcatgcccaacatccaatccagagacaaactcttttcaacctacctccaaaaagaaacttgggcacatgcctgtaatcccagcactttgggaggccgaggcgggtggatcacctgaggtcaggagttcgagacctgcctggcccacatggcaaaaccccatctctactaaaaataaaaaattagccgggcgtggtggtgggcacctgtaatcccagctactcgggaggctgaggcaggagaatcacttgaacccgggaggtggaggttgcagtgagccgagatcgcgccaatgcactccagcctgggcaacagaatgagactctgtctcaaaaaaaaaaagaaaaaaagaaaagaaaaagaaagaaagaaaaggcaagaaaagaaaaaagaaactcagaatctgacctctgcttacctcctgaccttgctcccaaccccataagcttgcacctggatgagtacttggtcagccccgaccatctcttccccacacacaactagagggacctcttccagatataaacctgatcacgccactgccctgtgcaaagccctccctggttccccatcaactcagaagaaaagccaaggcacccactaaggctccaggcctgaaatgagacacttctgcctgctcccctcgacaatctcccaacctcacctccttcctttctgctccgtctttcccctctctccccctctcatctccctgacctcacgctccccccaccacctcatttcacacccccgtctccctccctcatctccaagcccacctctccctcctctgcctggcacttgctctcctccaggcacagtgaagtcccttctgtcccacagtggggaacgcctgggacactgcttccgctgctgtgcatggctctaacgccccctccttggtacagaggcctctctgaccaccccaacacagccggccctctcctcctcacctcccaccactctatctatctggtcaccctgctggccacccctagtgaaagcatgtggtgcatttttattcattgattcattttttacttttctagtgccatctccccacaagactgtgagctctgagcacagcagagactttgtcagttctgttcctggatgttcaccagcacatggtaggtgctcaataatatctgtgactgaaagaatgaataaaagaatgaacgaatgaatgaatgaatgaatgggccctcatggatcctgccagtggtgcaggctcataaccatcacagcccttcaaagagaggtcttgcaacaacagcaccgaggctcagccagcagcaatggaaaaagtggttagacattaagtagaacttcctggtgctagaagtgctgagaaactgtccatccatgagtaaatgtatagtgtgagcctggtgctagattactggggttagggggagtaggggagggagagaacctgctccacggtgggaaggagacgaagcctatgaatggctgaggaaaaggaacaagccagcatgtggtcgtcataggctctgaagggcaggataggggttcatggaaaggacaggcccccccagaagactcacgtgcaaagggtttgtggaaggcagggacagcggctgggccttggaagactgccactttggagtaggtgggaaaggggagagagggtgctctcggaggggcacaaggcataggggccaagatgcagacgaaggacaaagtgcgggcctacaagagatcatctccgggccctactacatcacccaccaacgtggctctcccagccaactgccccagtgaagcctctgttgcttccacctggcccagggcactaagacttcccaaagttgttggtggcctctgaatccagccagccaccccacaggagcctccccacggcagcaggaggccatggcttccagcccccaccttccctccctcgcaccagagcttggaggggtgctggatgctggaggagtcggggccaagggacggaggagcagagaagccaatcttcccctctgccaaggcccaaggcacctccaggtcaggccccgggaagtgggctgagaggtgttgttcaggagtaagactaagcataacaccaccgatggagactggtatcatttggctgtgtcctgtgtccccacccaaatctcatcttgaatttcttttttttttttcttttttttttttttttttttgagaaggagtctcactctctcactctgtcacccaggctggagtgcaatggtgtgatctcagctcactgcaacctccacctctcaggttcaagtaattctcctgcctcagcctcctgagagtagctgggattacaggcatgcaccaccaaacctggctaatttttgtattttttgtagagacagggtttcaccatggtggccgggctggtcttgaactcctgacctcaagtgatcctcctgcctcagcctcccaaaatgctgggattacgggcatgagccaccaagtacagcctcatcttgaattgtagttcccaaaattcctatgtgttgtgggagggaccctgttggagataattgaatcatgggggcagtttcccccatactgttctcatggtagtgagtaaatctcacaagatctgatgattttataaggggtgtgtccccctttgcttggctctcattctgtcttgcctgacaccatgtaagacgtgcctttgctcttcctttgcctttcaccatgattatgaggcctcccagccatgtggaactgtaaggccattaaacctctttttctttataaattacccagtcttgggtatttcttcacagcagtatgaaaatggactcacacagagaaaattcagctcccacataccctcaccagggttctcccaagaactagagccttagccagggttctcccaagaactagagtcaagaggatccacatatggatatatggagaagtgttatgagggcctggatcacacagatgtgttatgagggcctggatcatacaaaagagatgtgttatgagggcctggatcacacaggtatagaagctggaaacatcccaccctgtgtcatctgcaagctggaagcccaggaaagccgatgctgcagttcatgtccaaatcccaaggcctgaaacccaggggagctaatgttgtcagtcccagtcccaggctgaaggcgcaagaaacaggagtgccgacgtccaagggcaggagaagacggatggcccagctcaaacaaagagaacaaattcacccttcttttgccttttcattctatccggaccatcagtggactggatgatgccagcctgcaccggtgagagccgtctgctttattcagtccagccatcaaaatgctcatctcttcccgaaatacctgcacagtcacactctgaaatcatgtttcaccagctgtctgggcagcccttagcccagtcatattgacacagaattggccatcacacctgccctgacacattggtccaagcatccttggtgaacccgtgggtcaggcacaggctcacccctgttgtcccagcttcgggggcaagggagtgccaggttctaaagttagtctatgaggcaaatgtgtcttagagtcaaagttattccccaaaactctttcctctcccctaagatacaactgctgtggcttgagatacatccatggagaatggtttggtccatacatcaagcatgtgggatgaaaatacatcttaaaaccccagagtcaaatttacctgccccacaaggggccacagagaccaacacccgagggaacagcagattctcacccacatcacaggttgtattagtccattctcacactgctatgaagaaatatttgagactgggtagtttataaagaaagaggtttattgactcacagttccacatggctggggaggcctcagaaaatgtataatcatagcagaaggcaaaggagaagcaggcaccttcttcacagggtggcaggatggagtgagtgctgagcgaagggggaagccccttataaaaccatcagattggctgggcactgtggctcatgcctataatcccagcactttgggaggcctaggcgagtggatcacctgaggtcaggagttcgagaccagcctggccaacatggcaaaaccccatctctattaaaagtacaaaaattagccagacatggtggtgggtgcctgtaatcccagctactcgggagtctgaggcaggagaatcgcttgaacccaggaggcgaaaattgcagtgagccgagatgccaccattgcactccagcctgggtgacagagcaagactccatctcacaaaaaaaaaacaaaaagcaaacaaaaaaagccatcagattttgtgagaactcactcactgtcacgagaacagcacgggggagactgccctcatgattcaattatctccacctgttccacctgacacatggggatttgggggattacaattcaagagatttgggtggggacacagtgcctaaccacatcgcaggttccctgagtaagccagctcctgttgactgcaattgccaatccctttacactgttattgtcctcattttttggcaaatgtgcctatctatgttgaaggaagttaaatgataaataatgacctgtacataggcatatgttgttgtcagcaaagtaaagggtgagtggaatctgtgctatagtgcagctctgccacaaacttgctgtgtgacattgggcaagatgcctagcctctctgagcctcaatttccacctatgaaatacaagaataatgataataccaatggtcaaagtgcgcccgcaaggactcagtgaggcaatgcctatggaaatgcctgcttgagggaggcaaggaggcagagtgacaaccacatgggccttggggacagtgagctgagtccaaatcctggcccagccatttaccaactggctggccccaagtctctgcaagagcatgcaaggaatgccagcacagacatgcacgagctcaagggcagaaccacaggagcctacaacagtcagctcccaaagcgaagccacactgtgcagctatggccctatctgagctgtggccgtccctgatgggtgagtcctacgcagctctttcccaggctccttggggtcctcaggccctgtggctttgcagaagtcagggactgtggctggaatcccaggctggccacctctctttgcttcctctttccacgtttggagaaggcatttcctccccttccagccctgggccagtgggtcaggtttccacccagatggaaagtcccacccagggcccccagaggacagctcaccatggaaactccacagggcacccgccagacacggagtaagtggccactggcaggcctaactggggcaggctcccagtcctgcccaccaggagggggaggtgggcaggagagggagagggggctccagccagactttagatctcagacacagaacaacgttcctacacacgcagagcaaaaagtgggtgatcgtgcgtgcatgcaggtgtatgcatgtgtgtgagcatgccctgagccctctacgcattctgagcctcagtttccctaactgcacccctgttggaggctggattggactcagataagatgagtaaatgcaatcatccagtaagaagtaagcaacaggtgggtgggctctgccagatgaagacccccaggcctatcggaataaaccacagccaaatgacagtctgggcaaggggaggaggggacaccgtgagtgaggtgcctcccatggtgttcagttcaaaggagaagcacataaacagagcttcccaaactgtgttccaagattccgggcttagggataggtggtagtcaaaaaaagggatgaaggacagattctgagcccaagagttttaagaaccctctctatgactcaaagcatccacaggcatgttgagggcccttggagatcctgccttaaagaaacccattcaattgcacttaaccaggcacttaggaaagttaccccagcagctgccccaccagcccccagacgcagcccagcaaaggcagcattgcctccgcccagctccctccaggctgtactgcatggaactccagggttgtgtggtgcactgaggcacggagcatttttccagggtcaattgaagaaggaactctaagaaagatgtttctgcatcgtgtgccaaattgttactgagatggttcctgctgtttgtccattgattaatgaggatccacagaataaattcctcagcattccaagccagggggaaaacactggtctgtcccaagctcttacataatacagaagcagctttgattctatttctctttgggccttggctgccaggaggctcaaaggcatcctgacccttcccttaggttttgacataattagtctcttcaactattatttgagctccccactgacccacaggccacctcgacagcctttcattagtaatcatcacagttagcacttattggggacatgctgtgtgccaggcaccatgctggacacatgtcatgtaccctctcacttgtccttataatggtgccacaaggtaggggctttgttattcccattctacagatcacaaaactgagctctgggaaggtgcaatcactgagtcaagcccattctcacagtgaatacacttaatttgtgctgtgtgtgttcacctgcccactgctgcctcctcactctagaatgtgagtcctggaagtcagggacccaactgtgcccttgtggcctagaagcacacagacgcctgacaatactatgatgaataactggtggtgaatcaggattgaaataagggcctatctgcctgaaaacccatgcccttaacgctcgtgtctttttggtctgcagggtttggtaaacctaacgctaaacttaaccttcagtgtaaccctaaccctgataaccaaacctatgctaacctctagcataatcccaaatgaattaattaataagccatgaaatgctccctgcctgaccctgtccttggctctgtggggcaagggctctgaacacagaggcttgggccatttagggagaggagatgcaggagctcaggtgacagcatagatggactcaatgaagatggtgggagcacatggagtcggcagcagggagagggcagcggagacggaaggctgagtttccctcctgggaggcctggccagacctgagtagggcagaccaggccaagcggagctggagcagcggtcacagaacaggaacgctgagccgacccccactcccaggagcggctactctggcctgcgagggccagcccagcgggtggggaggcgatgccctgcccagcttcctgccccattccaagctggccaggagccccacagccagcacaggaaataacaggggcccccagaggccgcccaggcaggccctgctccgaggccacccggggagggaaggaggccattgtcggcctttgtttcagtttccccagcattacccaggctccaagaggccactgggagctcacaaagcttccccccaacctgcagctgtccagcctcccccagccccgaccctggggacaggcctgccaggcccctggtctcttaaagaggcaggtgcagggtgtaaaatgaagtcacatgcaagttgggggttgcggggcggcccatgcaggccacagcaggccaggcaggcgaacagacagatgcaccaagactggggtctaggtccacaccagggtcagcccagcactgggcccaagtgcaggggtgcaaatctttggatggaaagaatgtctagggccctgagggtacgacaaagaaatggaagaaagaaaacagagcaaggagacaatctggacatcttgaacaccccgcctgggcactgttcctgatccttcaagggagacagcccagaaacaggctttttctgctcatttgcatgcctgggtgtggatgagtgaatgctgcatatgtgtgtatgcctctgtatgtgcatgcatttgtaagtgtgtgcacatgcgcactatgggtatgttggcagtgtgaacacactcctgtatgcacgtatgggtgtgcatctgtgttatgcatgtgtgtgcatacctgtgtctgcaggcatctgtgtgggtgtgcattatgcatatgcatgcacttggctgtgcgtacatatgtgtgtagtatggaggaacatgtatgtgaaggcccatatatgtgaatgtgtgtattgtgtggagtatgcatatgccaatgtgcacatacgtgtgtgtttacatgtgcatgggtggtacatgtgcattgtgtgcaaatgtgtacctacatgtgtgtgaatgtccatgtgcattgtgtggagtacatttgcactgagtgagagtatgagcatatatatgtatgaatgtgtgcatgcatccttgtgttggtgtgcatgtaatatgtgtatgttgtgtgtgcacatgcatgcacacacaatgacttgtgaatttacacatcaccaccaaagagcactcacaggtttttgcccattagcaatcactcattcccacactgaccctggtggcttctcactagtggtgtgtcgctgcaatgacattagggattacagcacattctagtgcccgtcattccaccaagatgcagtaagtctccactgagtcccaggcactgtgaattagcaactacagaaagcgtgccctagactcagacaaaaccccaactagctgtgcagactggactagtctctttagctctttggcctcagttgctcatctgtgagacgggaatgctaatactgtggttaacaaggcttaaatgagataatgcatgtcacagccccctgtctggcaccaagtggatgctcactagatggttattattttttaattgttattgttaagacagtgataattgctgaggatacgacaggaagcaaacaggcactgtccctgcctccacaagcttgccaggtttgcaaggcatttagccttgataagtagaatagcataagtaaaatatatcatatttgccagactaagcatgagtctgatgtgctaactatcacgtatggccagcagccatcagttaaagcaatcaaccatgacaaaggagaacaaattatcagtggaggtaaaataataattttttgaaccagagaggcatcagatagccaggttcagcataatctcatgtgtgtgagagtgtgtgtgtgtgtgcgtgtgtgtgcacctgcctgcacattcaagaatgttaagggaatgtcagctgacatgacagcagcctaacccctgtgggctgcctgcagtctacagcagggcaccattgaccatatccaacccaggagctgggccctgcagagtgtccacccaggaagccaacacacgccaggtggtgtggtcaagctgattttggccatttcctaatgggcactggcccatggccgcacagtccatgtgtccagccccacccaaggaaggaacctgatctcaggtcagcctcaggcctctacctttcagagcagacccagcccacctcccaccaacccccaccccacctggccttccccacttgggaaacaagccatgcctcaccaaccacggtgaacaagaatggttccctacagactcagttccaccccaaatctgcaggaaggtgaagcggattgccccaggcactgtggccatgcccagagattgccagtcacgatgtggggagaaaggcaggaagctgtgacgatgtgacgagaaggaggggcccatctgagccttctctgtcacccatacagacgcaaagctcagagctaagctcctatggcacttccctccacatggtgtcaatagcaaaagtaaaggtacagggtgccaggtggcaccttaggggttgagcactccatacggatttcccgtgccatcctcacaatggccttaggaagtagaattattattctccccatttccgatgagaaaatgaaatgacagggaggtttagtaacttactccatattgaacagctaataagtatctagacctcaaacccagattttgctctaaacaaagtgaacaaaactcaggccctgcacttcccaggacaaatacagacgaagaagtagaggtgagattctgcatcttggcagacatttgccaggcacctgccaactgccaagccagggctgggctgtggagacacagagaatcagacttggtcactgtcccctaggagtgagcagagcatcagggagctgggtataagagaaggaacattagaaccaagcagagggcagcgggagcactgagggccaggatcaggagctctttggctcagggggcacaaaattatgtcagggctatcatgggaaacttcctggaggaggtgtcatttaggctgagcttcaaaaaatgccaaggggacacacacagtctatggaccagcagcatcaacatcaccctggagcctgttagaaatgcagaatctcaggccctacccagacctgctgagtcagaatctgcatcttgacaatttgcacacatgttcaagtttgaggagcactggtgcaaaccaccccaggacgcacaaggctgggcaacactggagggagcaggatgggcagcaactcccccaaatgcatgaggagttatgccattggcaccccaccccacacaccccaacccacagacatgcctgactgtttacaggcaggcttcaagtcgccaaagaactattgatttccagtgtccaccagcaggacagcgggatccttggggacctaggaaacagccaacaccaaagagaggcctttccatcctcagggagcaccccagctttggagaaagtaggactggcccctccttgtctttacaatcctcattactgaagtcccccgaaaagcccaacagcaccaggagaggaggggcagggccatgggcttgctggggcagatggtcccaaatcaactgagcaactgcgctgcaaaatctcaatgccaggccagggacacgagacaaatgacagcatccctgccatcagggaagccccaagtccatctcaagtgggtggaaatcagcaagacaagcctagctccgtggaagcgaagtcatcagccagggtagaggtacaggaggaaaacaggagtcagaagacgcactgcacacgtgttcatttccacatgtcctgggtaccagcacacttgagtccagagcacacatgtgtacatgtatgcacaggctctgcatacacatgtgcacagcaggcatgtcgacgaggaagccaagtacagtggagcccaatgggggccccaaggctggtgcagagccagaggaaaagggtgggcaggaaatgccacctcctcctcagagaactggtccaaggcagccccagggagcccaggatgcagcacaaaccagcaggcggagcacaggggtgctggagcctccccctgccaggggtccgagtcagggctgcagctacctgggcatacttacacacaagcacacacacaagtgcatgcatccgtgtgcacacaagatacagaatgccctaccccatagactgctcaccatggtaacagagtggccacctctcagctccagtcaccacctgacgatttctgaggccccctgtgctagagggggagcagctctaacaaaggcgcagcccgggctgcctggccaggggtccatggagccaacccgccagcgcatgcctgccacgctcccccggtgagctcagggccaccgcgtcttcctacccagcctgcctggctccacttagctcaactccccacaggctccccagccgagctaatgagaaactccccagctggccccatataaaaatgcatttcataagtctttaaaatgctgggaaattctacatctatttagtgagacttttttgctcctttaaaatgtcccttggtcctcatcaagaagatgattgggttgagggctcaagcacaaaaggtggacgccaccagcacaccagccggaagccaaagggcgcccaggcagcatgcaccacgggccacagccaggcagctccaggcaagtatcgtgggtgggtgggacatcccacaggtgacccaatgcaggacggtcacttggggaaatgtgtaaagtgagacccagcggggagcaatggacagagaagaggggaacagtctctccagccttgatttggggattgaaagaaaaagttagaaggtgctgggagcccctgagaaaatctccaaaggagaaaaaaaaagaccacccacacgaagatgttcatcatggcattatttacaacagccatcacctaaagcagtccaaacgtccaacaggggagaggcggagaataacattcatgcccatccactcaagggctccagcacagacactaaggtgagaggtacgtgggtcccaggatcacaggaagctcaggtccaacagggactacagggaaacccactgcgagttcagcgtggacttcatctagaagcttatagacgaatggagctcgaaaggggactgggagaaatgcaaacgcaagtgcagaagcgcaggggtgtgggtggagtttctgtgaagctgttgaaataataactatgcactccagcaaaacacaagcagggcaggaggcagctccgcgtggttcagaagtgcaggcgggactgcacggagtggcctcgcctccccatggtgaaaggcccgggcttctggacatttctatccatttccccagccaaaacctcggggcaaaggactgcaggggatgaggctgtcgccttggtcaggagcagggaccctgaccattctcctcaccccaacttttacccagaaccaggctaaaagaaaaatgggaggcttcaatgcattcttcccaaggaggtcccaggacaccagctaccccattgccagctctacctcccatctgagcaggtcccagagactgcagccttatccccaccttcccctgcaaactggccccatgcccaacacccagatgtggaaggagggctggggatggggctggaggtggtgtgagtccctgcagagagcctggcccagtgttttccaggcctggctttgaacatgggagatgtgtgcaaggtcttcaaaacatgtacctcctctccttccaggcagcaaatcctgagagctggctgcagtcagactcttctacctgacccaggagtgaccggggcacagagctgattccagagagtctcctctaaaacaaggcatgggacccactttctcaccggcatgtctgccatctacagttgaggcactaaattcatgcatgagcggcctgggttcaaaccctcactctgccacttcttggctgagtgacctagaaccaagttatagcatctctgtttctcggttttctcacatgtatgtgaaaagcactggaaaggagccctggctcctagaagcacctcgtaaatgggagtgacggttcctattaaccagagcaagaagacctgtcccatggcaggaaagcctaaaagtctgatcacagtgcgacaccaataaggtctcaggctgcgggtccatcacggtcaactgataatactgagtgttcctctcaaaccacaagtgtgtctgtcaccatgccagaaataaacttacctaacctgcccaggcattcacaagaagtatgtgtcagcaaactgtgtcctatctctggcccatccacagacccttctcctactgcctctccctgctgctgttccagagctgctatgctggatggaagccatggagcagactctgcccaaccagtcccagaacccagcctggagaggtgggagattccaatgagactctgactagacaattacataaaaatgacccccttacccacttcacgctaagcatggtggtacatgcctgtaattccagctgcttgggaggctgagacaggaggattgtttgagcccaggagttcgagaccaacctgggcaacatagcaaggccctgtctcaattaaaaaaaaaaaaaaaaaaaagatgagcagcttcagctcccagatcaaactcagtcacagggaaagaggaggtaaatttccacatggtcgtgttggttccctgaaaccccacatcatagacctcaggatcacgcatgatgtttctggtgtctgccacttagagacctcattccaaagggcttgtgggaagagggaggaaatgctgaaggtaagatgtgtctccctgccaggctgggatgggcgggagagacaggggttaggggtagggttagggttagtaccaggctgggatgggtgggagagggggtgattagggttagggttagagttaggattagtgccaggctgggatgggcaggaaagagggggattagggttagcattacagttagggttagggttagtagcaggctgggatgggcgggaaagaggggcgttagggttagggttagagtagggttagggttagtagcaggctgggatgggcgggaaagaggggggttagggttagggttagagtagggttagggttagtagcaggctgggatgggcgggaaagaggggggttagagctagcgttaggtttagtagcaggctgaaatgggtgggaaagagggggggttaggtgtaggggtaggtttcgtacaaggctgggattggcgggagagagggggggttagggttagggctagtgccaggctgtgatgcgcagaataaaggggatttggagacgttggtaggagggaggtcaaaggcactgggagcctttggaaggctgacgcttgcagatcacaaggtcaggagatcgagatcatcctggccaacatggtgaaaccccgtctctactaaaaatataaaaattagctgggcgtgatggcacgtgcctgtagtcccagctactcgggaggctgaggcaggagaatcgtttgaacctgggaggtggaggttgcagtgagccaagatggtgccactacactccagcctggcaacagagcaagactccaactcaaaaaaaaaaaaaaagaaaagaaaaagaaatccatgagttgtccagaatgagataccttcatgcctactaggaagtttagaatttacaaaaaggaaaataacaagtgttgacaaggacctggaaaaagtggaatcctcatgagcagtgggaatgtaaaacgcctgggaaggtctggtggctcctccaaaggttaaacataaagttgccctataacccagcaattccacgcctacaaacacacccaaaagaaataaaaacaagcgttcaagcaaaaacttgtacattgccaggtgcggtgacacacacctgtagtccccactacaaggggaggctgaggcaggaggatcccttgaggtaggagttcaaatccagcctgggcagcatagctagactccacctctaaaaacaaaacaaaacttctacatggatattcacagcagctctattcacaatagccagagatgaaaacaaccaaaatgtcaatcaacaatacccaaacaaaatgtggtcctcccatacaatagaatattatacagccctaaaaaggggtgaaggacagacacctcctataataacatggatgaaccttgaaaatattaggctaagtgaaagaagctagtcaatggagattatgtattatatgactccactgacaggatgtccagaataggcaagtctacagagacagaaagtggatcagccaggtgtggtggctcatgcctgtaatcccagtactttgggaggctaaggtgggtggatcacctgaggtcaggagttcaagaccagcctggccaacatggtgaaaccctgtctctactaaaaatacaaaaattagtcaggtgtggtggcacacgtctgtaatcccagctactcggaaggctgaggcaggagaatcgcttgaacccgggcggtggagattgcagttagctgagatcatgccaccccactccagcctaggtgacagaatgagactctgtctcaaaaaaaaaaaaaaaaagaaagtggatcaatggttgcctggggctgggaggggtaggagggcaggggtgatagctaaggatacagtgtttcttttttattatttttttctttttcttttatttagttagttatttcagaggcaggcaggcaagttatcactctgtcacccaggctggagtgcagtgtcatgatcataactcaccgtaacctcaaactcttgggctcaagtgatcctcttgcctcagcctcccaagtagctgggattacaggtgcatgccaccatgcccagggctattttgtttttattctttgtagagacaggctctcactatattacccaggctggtctcaaactcctgggctcaagcaatcctcctgccttgacctcacaaagtgctgggattacaggcatgagctaccgcgcctggtccagagtttccttttaaggacatgaaaatgttctaagttgactgtagtaatggtcacacatatctctaaatataccaaaattcactttaaatgggtgaattgtatgatatgtgaattatatctcaataaagctgtttttaaaaagatataagctgggtttgtttgtttttatttttttaagaatctaaagatttcttatgaaaatccagctttctggcttttcttttaaaacctctgaagatctggcaactctggacccagccagaattctggcaattcatggcccagccagcaggagctgagggccagccatcccctttgcaaggtctgtgtcaccatccaccacggccccctcacgtatcagcccacctgggccactagcctgccttgggtgggcctttgagtttgtgaccctggcaaggttttcccatttgcaaaggactttcacatttgtaaggagttcacacctatggcctggcaaggcaggagaagttggggttggcaggagaagaagaatgacccacgaactcccctgaagtcacacatgaaaccctgtgtgtgtccgaaagagaatccacacagttccactggatgcccaaaggcacctgtgactcaaaacaggttaagaactcctccagctccacacctccaaggcacccccacatcttgactccagatgaagtgctccttcccctgggctcaccattagcagccccattcaccagcaagtggcatgagtgggcctgcgcactccgctccccacgcccccgcctccggactgcaggatattgccatgagctgatcatttcgctcctttccctgccaggcaaggccaggctctccatcactgtcagggcccccgctcgagggcacggaaggagcaagcctggttgtttctgggggcggagggccacagggtccccactggcagggtggccaggggaggccaggggtgagtgaagacacaaactgcgcattctgcttctttattgcagttctccatcacacacccaaggctgggaaaagcaggggagaggaaggcgcatgaaaagcttgcgctctgggccaagagggccccccaagaagaggggctgctccatgccttacagctctcccttcctcctggtaaactgccctcagcccagggacattgggggcctgtgagcaggaccacctatgccctgcagccaccaggcctgtcttgccagggaccttccagaagtccccataatgccctgccttcaggtcctgctcagctctccacctcccgatgccaagtggtgcagaggtgaaaccacaggctctggcttctggaggacttgggttcgagtccctgatccacagcttgccgactggggaccgtggattcactactgtacagctccaagctctttccctcatctgtcaaatgaggatggggattctcagtagcagtgccaaggatggcctgggaggttttgctcccccataatcttctttggcatctgctgccattctctgatgtggccaagtgacattttctcagtttaatgaaaagtattagacaaaagcagctttcaccaggcctttggccctggtgtcaaccagatggctgtccctaaaccaagcccacagagaaattatggagctgctgctggaagtggcacccacctcacagagctgtcacgatggctcagcgagatgctgcaggtagagtcttcactcagtgcctggcatgcactaagtaagtgctcaataaatgtgacatcgcccacgtccagggctacctcccacactgacttccgcctgccacccaggcttggagccgtctcacacgcccagtgctcagggaataaaagctgactttaatagcccaattccaatagaactgggaaggaaaatttacacatgcacagcacaaactattaaaaaaaagaaaaaaaaagaaaaaacaccagcaaaaatgagccaaagaaaacaaaacaattcctggcctggctgtctggctgtggattatccactgccagggatgctctgccctccctctccccatagctgagcagagaatccgaaactggcaccgtggcgagccacggccatggagtcacaaggagtgtgcatcctcctacatgcacgaggcatgctcagctcttgcctggaaactggcaaatcccacagctcccactactcccaggcaccccagagaggccctaagactggctgcccaactatggaattacagaactacagaacccagttccctagcaccaacaccacccttgccttctgcaagctgggagacacctcactgcctaggggatgcagctggggtgcttgacaccccccctgcccagggctgtctgtctatagcaatcactgccagcaccctccttgcacgccactgctgttcccatctgtctgcatcacctccagccccaccgggaaagcagctgggaaggaggaccttctgtagacaacactgggctgagtgctttcctagttcaggggttcctacagtgggatcctctctagagcgggcagcaagcctgagcccctgcacccctcgtctctcaggaggactacatgtctgagacacggcgccttatggccttgctgtttccgccaaccatggggaacgcactccccgcacagaaggagacacacggggggctacacagccccttcccccagcctcctatctgcccagtgctgaccccaaggcctgtcctagtcctggaccctcctccctagaatttgagcaccacttaccacgttggcttcagacaaggcccctctctatggaggaagcccctgtcaccaagggccagggcacctgcagccacaacagtgcccaagcctgggtcaaccaggaccctggagactctgcaggcagcattagctcctgctggaaaggacacggaaccaggggccacaggcttgggttcaagggcttagtctcctttcccaaatttcattgaaccatcttcaagcttcccgctgagtctccgtattctgtactattaacactttcttgtcaactcagttttttcacttaaatgaatttagcatcatcgtaagtcacaaatgtctataataccacacattagacacataaccatgaaaacattaaatgtttatatacctgatgcctaaccgcgtttctgaaatactgacccagagcaaatctctcttcctgcttcagtttccacaactaaaagaggagaagcttggactgaatgttccctcataggcctcctcaggccttaggattctgcaagactgaagcagctccagctcccccacaaatccagaaaaagctggtcaggatcccagggcaggcctggcccaaggcaggggaggaggacaaggaaggggatcccggcgcctgccggacagggagccaggggcatcactgccaagagaggccctggctgcatgaggagcaaacaggagagcgtgggccctcattcaggagctcccaaagacctctcaaagccagttctaatctcagtactcatgggaaggctccaagctacaaaacttcacagtcagaaaaactttactcatccacctctttttacagctaagaaacagaggtacaggaaagagcttatgcggggatcctgactgtcacgtcacccccgacaccccacgagtctgagctccctctattacctctccctggaggcatgagctcagctctgccagccctgagaatgcagagcagccccttccagggagggaaagaggaattctgatgtagactggagtttaaaagtcctattaaagtggcttttatgcaattagattggaatgaatgtgcagtgacgcccatagcagggagcttcaaggcttgtgcagtgggaaaatcactgcccatctgaactgtagccacaagaaggaaatgtggccctcgggagaataagggaatattagtctccgtatgtaatagattttattgaccatatggaactgatataaaaatcgtgttgcatggggtagtctggattggaggcaggaatgtgacacgaagaatatcatttccataaccagctgggtggctttctgagttcctgggccagcccccaggaccccctgcaactcttccaccagcccccgggcatttacctgctgctgtcacggaggaatcccaggccagcgagaagtctgaggcctccccctcttcaactgaaagagagaacagagatgggcctgtgagtttgaaggctgtacaaatagatcaggtaaggcacagggcgaggaagaaggaacatttgtgggggtccttattataatacccatcaccaggggagagggggcaaagcctacaaagaggcctttattggtttcacagagatgtaaaatgatcggaataaaacaggaatagcaagcaagttaagtgctggatcagttatggtttccccagccctgtgcccctggcagacatcactaatcaatctcagcactgcctcaagaaaccaataaggttgctctcagagatcagcaaagtggtgagtgctcatgaccctgctgagacctgacccacagatagacctcaggacacgctgaggtcaactctcccaatgacagcacgtctgagcactgcaactcatgagctgacaacatcagaaggcaaccagcctcccccccattccacccaggaccccacagaaccaagctgggcagagatagggtgtccccaccatcccacaccccaggacataagcccaggctggtagaggccatgcactaggagaatatgggagaaacactacacagcataacaacactcttgtcctggaattaatcccagtctggggcatgtaataatattaaagctgggttatggactttgtaaatggaactttgtttaagccaaaaatgtgcatacacagtatttttcagatttaatggcctttctagctctgcatatgtgcaggctgaagccaccatgaaccacccagttctctctgcactgtcgatgttcttgctggcaccacgtgggtgcacactgagccaggcactgtgctggggctttgcagccatcactgggtttcgtcttcctcaacggactctcagaggggtgtctgaggtcttacaggtagtgagagccacgaagagtttgggctcaaacccagggttgtctgtctccaaggttgctttgaaaaccactgttgaccggggtacaaaggatgctatccagaaccctagcaactcaggctggagggcagtgaccccaacccaccacatggaaggcatgtacaacacgcaggcagccaccttgcgagtggagcaagcaggctggcttgtggtcagaacctgagttctagcgcaaggcacagcccaccttcaaatctcagctctgcctcttactagctgtatatgacctgagcaaatgatctaacctctgggtttctgttttcccacttcaaaaatggagaaaataacggtacctaagccatagggctgctgggaggattaaatgggataacgtctgtgcagcattgggcactgtgccggcacagggtaactgcccccataataatgtcagggctgtcatctgctagaacagtggcccaaccaaccgagtgggggtcgatgccacaactcaaacagtcctgctctacgtggtgctctacatggtgcaatctacccccttgactatgtaaccatggtcttcctcctccccaaagcctcacagaatgggtttctctgaaccctgagaaacagcacatgcaagagggaacatccacgagcaactagccaaggaatgctaatgaagtgtgctctcttttccaagcccgcatcctgagagtggacaggcaggatcaagacaatgaaatgcacagataatttgagctgggacccaagctattgttttacttagctagttacagctggggtgggttttcaaatgtgcagctttataaatagcaatcaagacctcgtgtcagacaaaattgatattattcactaaaatgattccaaccagacagcctccaaaacatgggtggctaatgcctaaagccatcagaagcgggccatgcacggaaggagctgttgttaacagcattcaatgctatgccaaaaaatcagtttcccttacatttcatcttttacttacacgcacacatgtaaatatatggtgcttctattaagagactgctgccagtgtgcaaggttaccatgctgccattttgttagacaccttccacaaggtctccatgggtccctaaaccttaagaatgacgtaaaggtatatgagctgataaagaggtcagatatgttaaatttgaaagaaaaagcacaaaaaatatgttcagcagaatcccttttgagtgcattaaaaagacatgtccagggccgaacacagtggtttatgcctgtaatctcagcactttgggaggccaaggcaagcagatcacttgaggtcaggagttcgaggccagcttggccaacatggtgaaaccccatctctactaaaaatacaaaacttagccaggcatggtggtgcatgcctgtagtctcagctactcgggaggctaaggcaagagaattgcctgaacctgggagctggagactgcagtgagctgatactgcaccactgctctcagcctgggcacaacagaacgagactccatctcaaaaaaaaaaaaaaaaaaagaaagaaagtggatcggtggttgcctggggctgggaggggtaggaaggtaggggtgatagctaaggatacagagtttctttttgatttttttttctttttcttttattgatttagtcatctgcaggtatcagggcattaatacatgaccccagttctcctctgacctctgtgcacccaggtatcaggacaaatagtctgcacacttacacccactcaaggtggtttagttaagaagtgtgaccacccaagtcactgaacttgaggatgccccaaagatgtcaagtcatcctcttaggaagatctggcctcggccataatgggaaagagaacagggaaacacccaacattttggagctctgggggaaatcaaagctctgtgctgggtcccagaagtccagacaggcctgcaggggtggaaagaggaggaaagtggcccagtgctaactggctggggaggtccagagtggcagatctcactacaggcttcctggtccctcactgcaagcagccgcatgacacaatgcagtccctggaaccacatccctgtgtggtgagggatctgtgggtcaccttacttacgacttgggtgttaatgcgttttcctacaactgcaggcaccaccccactcacatgccctcctctagcccatattctgttttttgaaggtagaagcacaccttcaaaggtgaatatgggctagaggattcaaaaaacagaaaaacaaaaacagaatatgggctagaggattgttttatgagacaggctcatgctctgttgtacaggctggagtgcagtggtgcgatcatagctcacttctcagtcttgacttcctgggctcaagtgatcctcccaccgaagcctcctgcatagctaagactataagcgtgtgccacttcatctggctaatttttttatttttatactttttatagagacaaggtcttgctatgttgctcaggctggtctcaaactcctgggctcaagtgatctccacctcagcctcccaaagcactggggttacaggcatgagccaccacgcctggtttttatacattcttgatgagaaagagtcaacacccaaccccccaccacccccataaggccctgtgctacccagcaatgagtgtgaggtttttttctccccacagctgcactcttctgtccagactggatctccagcaatggcatcactaagcaggggcagcaggcacagaggaaggagggcccgtctgcaactggagctggggacaggtggccccaacccacactggcagcaggcactctctgggggcccaagcagcgagcccccaacatccctaagagggagttctgctgccgagccccactgcacactgaagactcgcagctcagagaaaccccaatccgcacaggggccgatagggacaacacaccaaaggggctacttggccggcccgcggcgcctcctccagacgtccctagctccatgtctagttgtttaatgtatacaataattggccccactgaagccaagagatacacaccccaccctaccccacttcaaggggaacacagtactcctgtggatgatgggcatttgtaaggtaggtgggtggccagggtgtgcccacactggagggtgcacagggtataccggcatagggacagcacgtgaagcaagtgtgtgcacacagagaggaggcatgggggcaagtgtgtgacacagagcagaggcataggggcaagtgtgtgacacagagcggaggcatgagggcaggtgtatgcacacaaggagggcatgcagggtggatgtgaatacacagggagggggcacatggcagagcccgattcaccacgatgctaatgaagccccagctccagagccctttgcaaactcaagcccctctgcacactgggaggggtcccagcagtggggttctgtagccctacatgttttgtaacctttgcaaaggaaagatctgttacctacttaagacctctctgtctctgtctgtctctgtctctctctctctctctctctctctcgctctctgagatggggtctttctctgttgtctaggctggagtgcagtggtgtgatcacagctcactgcaggcacaacctcctggctaaggtgattctcctgcctcagcctcccgagcagctggagccacaggcacatgccaccacgcccggtggatttttgtagttttttttgtttgtttttgtttttgtttttttttttttgtggagacaggtttttgccatgttgcccaggctggtcttgaactcctgacctcaagcaaccctcccaccttggcctcctaaagtgctggggttacaggtgtgagccactgcacctagcccactttttctatctactccaaactctcttccatcccatttcctctcctgtcggtcaccttgagaatggccacaggcattttgcactctttgtctcaaaggactcccccagttgtttcagccatacggccccccacacaagctctgtgctggggccaggcagtggacttcgagtaccctctgttcaagcacacgtgcaggcatgcacacgctcatgtgtgagatgcagaaaggctctggagtggcccaggtcacatggccaggctgcagctgcccactcctgccccatggtctaccagctcctgctcgtgattcccagacctgaccttgcagggcagcttccggcttagcccctgctaacccgaacacctctcattattccttccacctattggtttcctaggcttttatctgcctccctcactagggcatggacaatgcctgtcttgttcattgttgtatcccagtgcctagctcagtgcaaacatagtagcaggtgctcaacaaaaaacaaaaattttatttttggaaacagagtctcactcttgtcacccaggctggggtacaatagtgtgatctcagctcactgcaacctctgcctcccaagcaattctcctgcctcagcctcccgagtagctgggattacaggcgcttatcaccatgcccggctaaattttgtatttgtagtagaaacggggcttcaccatgttagccaggctggtcttgaactcctgacctcaggttatccacctgcctcagcctcccaaagtgctgggattacaggcatgagtcactgcacccggcccaaatttttaatcaataagcacacaggatgtgtggtgacatcccagagggcctgcagcagggatgggctttgttcagaaccaggcagtgggcaaggcagccacagacacacctgtcccctccacgccaccactgtccccaccccatcacactagagtcacaccagctctgggagcagaaggtcacacatgccaatccagctccctcatggcgctcacacttgccccggccttgagcacaaaccactcctgcctggggtcaggcaggcactgaacagaaaactctggccacagaatccagttacagagtggatggagcagggagttcttcctgcccatgcaatgggaatcatcatcgctcatcagagatgggatccttcccagggctgagtgtgacctcaacaatcaggtggccctggaagggcccaagggcaccacagtagccctgcgaggagctcctgctaaaacacttcaccggacagggccttggaggccccgcccccacagggatggagggggctacacagggaggtaggaacgggctcaatcttaagactcccagctgtcctgggataatccccccaagctgtggagactgatgggcaacgtccagcagcctctggacaagggctgctgcagaaagcccttcaaaggagcacccgaacacatcctgttaagagaaagggtgtttgcggccatctctgaagtcctggggggcttccagttccctgtgtgagtcaagatcctcaacaatggacaagaaggggctcaaagaggccagagggcccttagagggcgcctgcttggtggcagcaggtctaagaccagctctcactattaaccatggttcctggggtgcattaagaaggattctggggctctgccagggcttcaggcagatcaggactccacgttgactctcagctctggggtcagaagttgtgggaggctgattgacgaatgggagtatagagctccccctaatgctgtcgccccaactccacagcaggtgcataagtagctacaactctcctgctctgggattggccacagctcgtcccctgtgcactagcacaggccttgccaccaccgagatcccttgtgtgccaggcctctggatttcagatatccagtggcacagagcaagtggcactaggcagacacctgcatgcaccacctcctccaggtcacttgctcctggcctggagagtaatgccctccacccagagggctccccaacacctcacagaggcagaagagatggagctggagagggaaacagaaagggaaggtgaaagctgggcatggggtctggaaaaagggcccagaacacagcagtggggcccagacagggctggggccctgctcaggagtttgtcaaagtcaggcaagatgtgttttggcagagaaggttcaggtcaaaggcaggaaagctcgggggacagattctgaggcagacagtggcaggaggtgaatgagagacaaacagaggctagtgctggtccaagggtcagaggaggcctctagtagggccagggaagaacccagaatgctcctttctgaactccaaaatccatgctggggccacttgctcagcctggcttgaaggctggaagaaggctctgggtgtgagctgctgtgcacaggcacaaaagggcactgttctggggaaaggatccatagatttcatcagaagatctagaaccacctccacccccaaaataactttaagcacccatagaccaatggctctcatttgcaaagtgttctcagctactttccccaaggccttgggaaacctccccatgctttgctggcccgtcccacccttacaacatcccatgcctccccagagacatccctgtcccagcagaggtggtggccaggcaaggggcacgtgactgcccctccttagctcaaccttagggaaaccctctcacacactgcaggccaaggccacaacaggtaaaggggacagcgagagacccaagtctcattgtcaagcatgaaacagagcatcactgcttctgacttactactgagcaacctccaggaatggaaaagcatagaccaggcagggaggccaagcaggtagagcggtataggccaagcactgcacagaaggccaagcaaaggtggcgagaaagagctgaaatgtgacccacactctgtctacccagcactgtgtcctggtgcagggctgtgaatgcccagagaaaggggtgcccattcctttgcacaaaagcatagccaatcacttttctacagcccaagatcatctttggcatcacgctcctaggtcaaatgaccagggtcaagtgcagacaaacccaacgaggaagcccacatcctccaggctcctttcaggtggcgatgtgttcaggcagtgggtggggtgggggtgattgcatgcaaaagccaaggctccctgcagctaaagctaaaaccacccaacacctccactgacaggccccttggcaccaagctcagaccatcagaaaagccacaatatgacagtcacatcacaatcacctttgtttaactcccgtgattcaccctgaccacttgctgaaaagagaacaagctgtttcaacagcacaggtaagatcgcctgccattatgccctgaagtgagagtgaaagggacaggaccctctggctctgtctcatgggtctctctgtccacaccctgccccccaatatatgggcatctcaccaaaaggaggctgggtctagtatttaaagaaaccgattttttaggccaggcacagtcactcacacctatgataccagcactttgggaggccaaggcaggacgattgcttgagccaaggagttccaggccagccagggcaacatagcaagatactatctccataaaaaatttaaaaagtaaccagacatggtggtatgtgcctgtcatcccagcaactcgggaggctgagatgggaggatcacttgagcccaggagttcgaggctgcagtgagctatgatcacatcactgcacttcagcctgggtgatacagcaagaccctatctgttaaaagaagaaagaaggccaggtgcagaggctcatgcctgtaatcccaacacttatggaggctgaggtgggcagatggcttgagctcaggagtttgagaccaacctggccaacataatgaaaccccatctctgctagaaatacaaaaattagctgggtgtgatgatgcacacctataatcccagctactcagaaggctgaggcacaagaattgcctgaacccaggaggcagaggttgcagtgagccaagatcacaccactgcactccagtctgggtgacagagcaagactctgtctcagaaacaaaacaaaataaaaaagaagcctgttttcagacaacacaactcctaaccagaaatcttctaaccaatctagtactttttaaaaataaatacatacaattttttttaaaaaaattaaagcagaatattccaatgtgtgaagaaaaaccattgttaagaattactgatagatggtcagtgggtctccacgtcggcgcttgtataacaggcaattttggcaatgcttgactttctccttaaactgactttagaaccagcacctctggaagctgccacgctactacagactcctcataaactgttgccctggagaattgtaggcagaggggctaaaagcctaaaccttgcttagccactgtgccccttcctctccttgccttgctatatataaaatagaacagaaagacaccagggaataatccaagaattccaaaaagtaaattcatctgtccttacaggaaaagtgacccttgcagaagtcacgcagcagagctcatctagctatggctgtgaggtagaggagggaacctggagagacactataaaatgtaggggtgtgggaagtgggctctggaataggctgctgtcccccaagtgatcacttgcaggccatcagatctcaggccagagactcgatccaccctgatcttctgtctctgtaaaatggggataatcagaataccaacctcgcaggaggttggagaggaccaaatgagatgataccccaaagcacttagctccagggaaacatgcaatcaatgtgagctcatgttactgggataattcaagctccccttctcccgccaggttcctggctggctgctgaggtttcactctccctggaaagacaggagagctgagttttgagcagtgagatcaaatttcccactgcgatttagcccaccccgccccacccacaggaatgcccagctagagccacagatgcctcagcatcactgctttcctgttcccactacagtgcagggatggtgtccctaaatgtgggactatttggaggtgacagccaaggggctcagcttctgtgccagctcatctccctctcaccctcctattccccatgatcaccccaaaagagaaaggctaggagatctctgcagaagaagcagacactaaccccagtaaaatctatatcttcggcaactctgcagaaaggtgactcctctcctccatctttccctaataaaaacatgatgatgatgatgatgtgtaaaataggacaatgagtgtgaaacacttgaagttttctttgttttgttttggtttattttattttttaagacaggttctcactgtgtcattcaggctggagtgcaatggtaacatcttggctcactgcggcctcaaactcctgggctcaagggatcctcctgcctcagcctcctgcgtagctaggaccacaagcacgcaccattactcctggttaattgttatatttttctggccaagcgtgggagctcacacctataatcccagcactttgggaagcagatcacttgaggctaggagttcgagaccagcctggccaacatggcaaaaccctgtctctacaaaaaatgcaaaaattagctgggcatatggatgcacacttgtaatcccagctacttgaaaggctgagatatgagatgcacttgaccctgggaggcaggggttgcagtgagcagagattgtgccactgcactccaacctgggtgacagaatgaggctctgtctcaaaaaaaaaaaaaaagatatttttctgtagagatggggtctcactatgttgcccagactggtctcaaactcctggcctcacatgatcctccctccttgggagttttctctaagtactaggaaaagggtttttccactagacccaggacagcacacatgtggaacacctgccccagctcctctatcttgcacccaccatagatattgccaactgatcggggttctttctctaaattggcacagatgcagcttcaaaagtctcaacagcgagggttaaaatcttgggtttctctgttctggtccatagaacttccctgcaagcacctggacatgacacacacacacacacacacacactcctgcgcacacacttgaggatgtgcccaatgtgagcaggaaaggccacccttcactgagcccaagtggcatctggcacagtgccgggtatcccacatactggctccccttccatcctcccaggccccctcagagggagcccttaaaatcctcacttttctggtgaggaaacaaagccccagggagccacagcatttgtccagatgccagccacggaatcccaggccagggcagatgtttccaagcatggcttcagctcaaaggcaaaacagggaagggaaggaaaaaggggagccgtgaacacccagccattcacccctcgttctgtcctggtccagcccagccatggggtaggaaaagaaaaggaaactgaatatcacaaagccacctgatgtggcaatgttagtggaaagccagaatcaggaactgagaagaactgaagacaacatcgcaaaggcaggaacccacgtgaattaaaacaatgtcttttttcttcttctaaaacagtccctcgcagctctgtcagaagaggagccaagcctgggtacgttggcagccccgggggactgaggagagcgtgccctgccacagcctgcctctctgtgctggtcccacgtgggtgaggagacagacgccagcctggcccaggtccctcacgtccttccccaccaccctgcaccagaactgtctggcactggaggcttttacagatgtttcctcagctcctgcctgaaagtcagggctttactgacccatttcaaagaaggaagaatagagtcccaaataagagaaatagctcacctgggggcccagacgaggcggcaaaagcagactcagaacccggcattctagctttcaggccctggaatactcctggacaatgctgcccacctctgaataagcagtgaagtgcaactgagccctcacctgtgccacacactgtgatgtgcacttcggttgcacaaagtaattctcagaatatagtttccagaccagcaatagcagcattacctaggagcttgttggaaatgcagaatcccagaccccatcccagacctacaaaatcagaatatctgagggtgggactcaggaatctgtgtttttgcaaaaccaacaaatgactttgatgcgtgcttaagtttgagaacctatgagtaagtacatttattaaccccattttacagatgagaaaactaaggttaagcaatttgtcaaaagtcatggagctaggatggggtatagccaggactggatttttatttttttagagatacagccttgttctgttacccaggctggagtgcggtggtgtgatcagagctcactgcagcctcaaactcctgggctcaagtgatcctcccacttcagccccccaagtagctgagactagaggaacatgccattatacccagtcagttaatttttaatttttttcagatgcgtctcactgtgtggccaggctggtcttgaactcctggcctcaagcaatcctcccgcctcagcctcccaaagtgctgggattacaggagtgagccaccatgcccagctgggagtagaattcttaaccccttgattttacttcggcctccaacaggcagcaggtctggttccagattgagtaggatcagtcaacataggactggactctcactctctctcactctgccccgctcccatgatccttaagatccttaggtccctccctgtgccagccccaggagaccctaagaagaggagagttcatctcttgggtctccctaagcactcaaggtccttggggtgaaaccatgagagacaatggtgtgctggtcaatgtctaacagggggctatccaggagaacaagaggctctggtttgtagggtttgccactttctgcagtgtaaatgcccccactgcagccaacatcaagctaccaaacaggacactgctgagcagaataaatgtgcacgatcagcgcaccatgggacaaaggcacagtgtcacaggaggaggaggaaggagagaaggggctttggcagcctaggacgctgcagagaccccagctctcccacccaccccacctgccctgcctaggctttgcccctatgttccaaatatgtcagaaacacagaattcactccaagtggccctttgcttattgtttcctagaacaaacgtctctttctttctgtaaaagtttctgacataagtaatccatgtacaacgtagaaaactagggaatacatgtgagttaaaatgaagaaagtaaaagcacaactttccagtatgtaaatacattgttacaacattaaaaacaggtagtgctctgtattccgcttttctaactcagcagtacccagtgaacatcctttcacatcaaaaacagagaccaaggaccagcccgatggctcacacttgcaattccagggttttgggaggccaaggtgggaggatcacttgaggccaggagttcgagaccagcctaggcaacatatcgagattccgtctctacagaaaaataaaaaaaaaattagctgggcatggtggcatgcatgtgtagtcgcagctactcaggaggctgaggcaggaggatcacttgagcccaggaagtcaaggctgcagtgagttatgatggcaccactgcactctagcctgagtgacacagccagaccttgtctcaaaaaaataaaaaataaaaataaacggagaccaacactattatcaatgatggcctgagtcccatcacaggaggctccaaataaccaatatcctgttgctggatagccaggctatttccagctgtctcctcctgtaagagaatccacgctgcaacacatgtatggtcacaagcctgttcgataatattccttaggtcagaagcttgattgctaggacaaagagtgtacccatttttaggcttttgggatacactaccaggaggcatttggctatttcctcctttaacaagcactgagcacctctagactacctagaagtctgcgctaggtagcatgagagagatgagaaaaggaagctgggttttgaccttcaaccactagatggtgaatccacagtgacaagtgttacccatcactgtgccccttcaagggctggcacacaggagctgagtgagtgaatgaatgaacaaactacggtatgctggaggttgctaaatgcatcccaaactcagaacaagacaaaaccaagtagaggacctggagtgcagacacaagggaggggcagggagctagggaaggggaaaggcagagctcaaggtggggtctctgtctccatagccatagccccagagcagactcaggggtggggaaccggcccagggctaggatgagtttcttttttttttttttttttttttgacagagtctccctctgtcacccaggctggagtgcagtggtgagatctcgactcactgcatcctccacctcccggattcaagtgattctcctgcctcagcctccccagtaactgagattacagatgcccgccactacgcccagctaattttgtatttttagtagagatggggtttcaccatgttggctaggctggtcttgaactcctgacctcaggtgatctgcccatctcggcctcccaaagtgctgggattacaggcctgaggcactgcgccccgccttcagatgagtttctacttcaatcagagttaaaattctgatttttttacactaatatgcaaatcccattttcaggaagaatgataattgtggacaaaatcttaaaagtccatgggtctcttttttaatgtaagcaagttttcctgctcaaaagtaaagttcagaaaaaaatctaatcaaattgaatttaactaagcaaagaaatcaatactagaggaaatctaggtagcctcgccccacccagtctagcatcacctgggatccggcttatgaggagacctgggaacaggcccagggcttccagcttctcatccatgtccccagagtcagcctgaccacaggctacaaggccacctcctctcctggtcagaaacactgaccagagctcaaggtcacctcctccaagaagtcttctccagccatggactgaagttagttctcacctgcagcagggtgtaattgaagcaagatgccttaggatcaaatcccaatccaccatattttgctgtgtgacttgggcaaatcaggtaacacaccaaccctgtgcacaccaaccctgcaaggtagctctgaagatcaaacaagatggtgtgtataaagtgcatggttcaggacccaatacccagtgcctggcaaatggaaaccctgatcccacagcttttttttttttttttttttttgagacagagtcttacttactctgtcccccaggctggagtgcagtggcctggtctcgactcattgcaacctccacctcctgggttcaagcaattctcctgcctcagcctcccaagtagctgggattacaggtgcccaccaccgcacccagctaatttttgtatatttagtagagatggggtttcactatgctggccagaactggtctcgaactcctgacctcaggtgatccacctgcctcagcctcccaagatcccacagcattatatgttgcccacaaccatactctcagcccctttagggaaagtctctccatctcctctttctcccaccttccagttcacttggcagcagactgtgcacatcagagacactagagacaaccatcacatacctgtagtgagaacacactgagccacctcttcacacgttaccacgttcatgctgatactcccaatggccctacaaaagcaggtactcatcttacaggtggaaaaaccaggggctaaactaatttttttaagtggaccaaattatggaagcagagggagatggagcccagatttgaagctgggtctacatggctctgaagttcaccaggccatcctgcctctctcggccccttcaaaacaaacagtaattaactggccaaacttcccagattgcctgtaccttctcaaaataaggcaaagctcgccaggcaggtaagggttgaaatgactccttttttctgaaccctccagtgaccagtctgcagaggtcagtattgggtgtgccagcccacgttgatcataaactccacctgttgcttgctgtgtaaccttgggtaatggactcttcgagtctttatttccacatctataaaatggggatttaaaaaattccatttattttaaagacaaagtgaaataacacaggtaaagatctcagcttagtgcctggcgtccaacgagcaacacgaaataggatgattgcttctgtgcccccagccagtccatccagggttgcaatgtgtgcggaaaattccctttctggggaaccgcctgcctggaccttaacagggagggcccccggcctcccgggctgccctctcgtttaatcccatctctccctgaggttaatctcctcgttcatacatgtatttcatttcatacagtcatctctgcatggtctcgttaaccagaaacgtgcagcatataaacgtggatttacaatggggtctggctcctgcatcctgtttcgggggcaacactgggctctcgcccaccagctgggaaatgctgatggaaggtggtggagcggggggcaccccagccccccagggaggggccacacaacagcccacacaaccgccagatgaaagtggcagcctgtacttcaggaacctgacagtgggcacatcagcctggggcccagcccctcactcagggtatggtacagaggacccacatctgcccaggtctgtttgctgtttcgggtggaaaggaagaagcaggtaagatcggcaccccactctctttccttctttccactttcatttgaagaaaaagcactataaagtagaaactaatgtttttttacaaccccttaacagcttgtcctctgtgctaacatactgtaaataaatgtcagttcctggttatacatgtggtttattttaaacacgagcagaggaaactgagtctgtcattgaaaactgatttgtgtatgtatgacgtgtgtgtgtgtgcttccatctggttctgaacacacagatcacccatccatctctctttttacacattgctcttcttcctcatactttttttgtggttaaaaaaaaaaaatgcacagcaggccaggcgctgtgactcacgcctgtaatcccagcactttgggaggccaaggcaggcagatcacaaggtcaggagttcaagaccagcctggacaacatggtgaaaccccgtctctactaaaaatacaaaaatcagctgggtatggtagcgcacgtctgtaatcccagctactggggaggctgaggcaggagaatcgcttgaacccgggaggtagaggttgcagcgagccgagatcgtgccattgcactccagcctggaggacagagcaagactctgactccaaaaaaaaaaaaaaagtgcacagcataaaatgtaccattttagcaatgttaaacatacactacagcagtactaactccacacacattatcttccttctctttcatattaaaagcccaagccaggccgggggcggtggctcacgcctgtaattccagcactttgggaggctgaggcaggcggatcatgaggtcaggagatcgagaccatcctggctaatgcggtgaaaccccatctctactaaaaatacaaaaaattagccgggcgtggtggcgggcacctgtagtcctagctactcgggaggctgaggcaggagaatggcgtgaacccgggaggcagagcttgcagtgagtggagatagcccactgcactccagcctaggcgacagagcaatattccgtctcaaaaaaaaaacaaaaaatacaaaataaaagcccaaaccttccacagaaacgaactgtaatgtctggttccaaacactttttcattccacaaagacaccccggggtaggggcaagcacaatacttcacggcttaaggagtttgtatttttaatgtctgatttgggagggggacatttcactggcacagatgtgctcccgacttggccccattgcccacccaccgtggggagcttgcatgtggaaaaggcctttgggggaccccaggcagctccacctggcagctggtcccaccaaggcaggccctccctaatccaaacctgcctgccatcccaagacaaccccaaaaccttcactaagcatgccaaccatcccaggggccgtgacagggtctgcctgggcacaggctccagagcagcaactcagcctctccactgtccctgccccggggctggcagggacctccccagacaactcctgccaggaggacacacctctggcactcagagtcacgggatgcttttcttcccatcaactccctgctttttcttacattcctttttttctagcttctccctaagcagcgttactcaagaaatcacacatttggtgtgctagtaacaatttttctttctttttttttttcttttatagggacaaaatcttgctctgtcaccaaggctggagtgcagtggctgcatcatagctaagtgcagcttcgagctcctgggctcaaaccatcctcccaccatagcctcctgagtagctgggactacagatgtgcactaccacacctacctaattttttaattttttgtagagacagggttttaccatgttgtctaggctggtcttgaactcctggcctcaagcaattctcctgccttggcccctggaagcactgggattacagatgtgagccattatgccaggcccaatttttctaatagacaataaaataaacataagaagtaacatgttcctaacagatgaaggaataaatatatataagtatgaagaaaagagaaccattcacctatcagccacctgaatcccacaagcctccggtgcaatgtcccattttggggacagtgggcatgagaagtgctgggcacctctgataaagaggtgcatgtcagttgtcctaaatggatctccgggaacccactcagcccactggagttcagcaagggctgagtgttgcatgccaagggcagtgctgggcagaggacagtgggaggggcgggggacatgctggctacacactctggcaagcagtgaagtactcccaaaacctgtggctcatccaccccccagggccgttagcagaggggtggagaggggtggaaatcacgacaagtgtgactatttcccaagtgcacctgaccacctgcccccatggcccagggactccagctgtgcattccctacgcacaccagacagggccagagagacccaccaggctgcggcaaggctcaggggaagccaagccagaagacacggcctcagaaaggttcagcaatgggaaaggataccactgagggccagagcccctggcaggaggcacgtccccgagcagggggcacactgagcccttcctgccccaaccacatctgtctcatcccatagccctgcacggccccacacttgccagatgtggccacccgtagggaccaagttcattttccgcgtgtcctgcgataatacttggttgtgtttatttaactttctgcttcgaatggcggagagatgggccaggaaaatcagtttggctcccttcgatcaaaacatagcggcccacacataatgcgaggacacccacacagagaagctctcccacaccatcagaaaaagcacatctggtccacggctggcaggggccggcccggccctgggggcccttggaaaagctgcctcgtgcaaagcggcataggctgcagtggtcccatgctctgtgtgtcacccacactgctatgctccagcgggcggcagcaggttcaatctccccacccaggcagagaggtctcagagaagccttgtgttccactacacacaagccagtgcagcctgtgtgtagtggaactcacacccaggtcctgctggtcctggaacccccaagaaggcgagagggggactttggggaaaaggagaatccgagagaaaggtcccagaggctccgctctgcacctgcgagaacagatgtggctgcctcatcctcccatagcagaccacatgctggctcccagaggggagaggtggggacccccgggtgggttagcacagctggtaaaagcattcctgctcccacttctgatggcctccaaagtgcctccaccaagccctgaggcatctgaagcctgctcctgagactggaaacaaagacaccagggggtctggggctggagggtccacccgggagctcttagcaggacaccaggggaagccttatgaaccgcatgagagtgagagctcgcccagctgtcaggacccaggcccccagcctgcgcccacccattttttcctcccacccccagctccttccctcgaggacaggggcaaccatgtgtcaaaggtctgcccaggccccatttcctgctgacagcaccccttccccactctttggcctggggatatgcacactgaaggcttggtccacccttgggaagacaaacacagggagaggccccagaggtccagggtggtctggggtcggggaggctgggggagtcctggcacctggagataatctagaagaaagaacacgttcccagactcacagactcctcaccccaaagaggacagccagagaggggcctctgccagccccttgcccccagccctgccacacacccttcttacctcctgatgctccaagccatgcacccacctgctcccttccaggcaaccaccttcctgtctcaggacctctgccactgctgctctcattacccaaaacacccctgccatgttggaggcccccaccagacctctgctatccaagaggccttcccagatccctggataaacagacgcctccttctctggtccccataatcctctctgagggcccgactcagctgagacccctgggcgcatcagggtcccctatgctgtgagctccctgagggacagccccaccctgttcctcctccttgcccctcactcccagctcagggcctcgtctccacagacaactgccatgagttgattaaaatgaattcatcgcaagccctttgctttgttacttttttaatcttccagattataggaaaaataaataaatacaggtgagtactcagggaaaaataaaaccacctataatgcccctctcggaaatgccatgggtatttgagggcagtcggccctaccggacactttctgtgcatttacactttctctccttcaacacaaatgggacctggggcatgtctgagtggtcttgaggccctcggggtgtgcagggcagcgctgagagtccggccacaagaagttcacgggcccacgaggatgtggctaaggaggggcatcagggtaatggggggtcttgaaaccacatcttgggaggggaagtgaaggaactgatgctgttcagcccagaggggcaggctcagggggccctcagagctgtcttcaggcatctgaagggctgtcacagagaagacagactgcgctggctgtgtggcctcaaggggtcaaaccgggaccaaccagtggaaggcactacagaaagatttcaagaagaaacagatgggacgatttcaagaagaaacagatgggacgctatcagcagaggcaatgaggggaggtctgcttgggggtagtgaggctcccggcatgggaggggaccaagcagcggtagagagacccccaagaaagtcaaggctcagctaggagaggagttagagttggccttgatgggatctcaaatgatcgcaggggaaataggtaggtaccagaaataaacactgggggtggaggagacaatggcaccactctacccccaacccagcccacgctgccacccagagtgtgcttagcagggtcccattttctggtttctccagggaggccagagatctgaatatttataggaaccattccaattttaagacaggctgaccaaacttctagcagtccaaatacagtccttgcactgcaggctgccgaccccctggtcagacaaggagctcacagggcaaacgaggctactgaaagaaaagggagccatttccgggcccagaagagcagccatccccgcaggactggaatgggttaaagtctgagttggctctctgctgctccaggactacagctggcctcctacccccacccccgcccccagaggccctgtcagctgcccaggccccgcctgaccgcccgcctcagccacccagcctggaaccccagatctgggaacagggcagctgccctgaggctggccagccaccgccagccagaaagagattccgttccccatgccctgctgagagccatttgctcatctgggatggatgccacaggggcagagaagcaggctctgtcccgctctcctctccccttcctcctgcccctaggcctgtgacagggagcagacctctggtgccaccacaatcaaaactccgctgagcaccggtgactaggcggggtgctccacacacagagcacttgtgtcaccttcctagggatcctgcagggagtcctcaaccatcctcattgcacaggcaagaaaacctatactcagagaggttaagacacttgctcacggtcacacagccagcaagtggcagagctgggattcaaatccagacctatgcaatttaaaatcccacaccaagccactgggctagagggtcctggctctcccacatccacattccccatctacctggttgttttctagaagctacaggcacctgctgcctggctggctatgagaggggagagagggcatagtcaacgctactgataaaggctgggataagggggctgggcatggtggctcacgcctgtaatcccagcactctaggaggccaaagtgggtggatctttggaggcccaggagttcaagaccagcccaggcaacatgatgagcacatctctacaaaaaatacaaaaattagccaggtgtggtggcatgcgctactcaggaggctaaggtgggaggatctcctgagcctgtgagttctaggttgtagtgagctgtgattgtgccactgcactccagcctgggcaacagcgtgagatcccatctcagaaaacctaaataaatgaataaataaagtcctgaagcagtactgaagtagctgatttggaatcatttctcacagtctggaaagtgagaaagggtgaggggctgtatggtgtacttccatttgtgttggggaggggagataaatacacgaattttcatgtgtctgaacacacgtaaattgccctggaaccagacacaagaaactaggaccagcagtggcctccagggaggacagtgggtggctgggggagtttctaattttgctccttgtgcattcattagcaattcgtgtgtttaaaagtgtgtgtgtgttctacttaaaccccctgccacaccaccaggggcacccacacttgccttggggtgctgcatttttgccttcccaccttggtccactcccctagttgtagccctactaggcggtggggctttggggaagttcttgctgctctctctcaactcccatttccctgtgcgtatgaatgacattagactggacttcccccaaatccccacccaccctggtgccctacaggtctaccttggtgactccaaccccacagcccagagctggcctaacaggcaacggcgcacttcacccccagcccaccctgtgccccgactccaggcagccagagccttctgaggtggcaggacaggccaccaggagagcagtgacagccaagcagacatgttcatcctccaggtatccactgccccagcctcggataacagcagcaccccaatcgtgccctgaggaaccgcccctaaccctaacctcaatgtgccaccagtcaaaatgccctgccctcccctgggccatggcccaggctcatgcttgatctgcccagggattgatcctcaagcagagccacgcaggagacacgggaggtgacaaactcccgccccatggcagttcccggaagagaacatccattccctctcgctcccgcatctccagagctgccccaaggcctccatctctctgtgcattcacactgttggctcccccttggcctcctgttaaagtctcttttggcttaagttgtccagagttggcttctgtcacctgcaccactgaaccctgctggacaggaaaccagcacagtggccgagacagcagctgagaccatggagatggtcctgccattgcagctgactcagaagccacccaggaaaggccaaaagctctttggacaggggccaggggtccacatccgccccccaactcctataaatgccttggagaaccgggaggccccaggtgggctcctgcagaagaagctggaaaaagaaaacaagcagctccttcctcaaggacgttagcaggatttgccgaactcccactttttactcctggaaagcccagaggacgcaggaagtgacagttccagggaaggcgtgaggtcgaaggctgtgggctgccagggtccaagagccaggccctgaggagccggggcttcggagacagaaggccctgggtcaaggccacaagcccagccctcagcagcagtgggactccagacggggcctgtaatactgaaccttttcaggcatcacctgtaaaatggacatgattcatctgccttcccgtgggctctggggggtggggggatgacatccccgacatgtcctgtgcccaggatagactgcacctaccctttccaacaatggggcaggatcggagggcaagcaggacaggggtgggctgtgccaggatagactgcacctgccctttccaacaatgggacaggatcggagggcaagcgggacaggggtgggctgtgccaggataaactgcacctgccttttccaacaatgggacaggatcggagggcaagcaggacaggcatgggctgtgctttctcaggtgggcaactgaggctcagacaggaaacacgcttgttcctgagaagtacaaaattactccaatcctccaaggtcctcctgaacaacctaatcaattggcttgctataagatttgttccagaaaagttttgcaagccactattgtaaaaaaaaaaaaaattaatccgcaatgagtttacagctcgacaggcctagcaccccatttatctacctcattcaaacccaggagcatgacccaaaacagggctctgataggggtgagcctggcatgtgagcagggagccaggaggaggtggcatcccccaccccaggagtgtggatggccagcaagacggaggcgacaggaggcggtcaggtctcttctgaagcagccccagagcactggccatctcaactctgcagcgggcatctctcctgacctcctctttcccacacgtgtgtcctagaatgccacctcccaagccacgtcggggagggcagcctgctggttagggcctcagggtctgggatgaaaccaaccaggctcacagcggggctcggccgctcatcagctgtgtgaacttcggcaagttactcagactctcagaacttgagtttcttatcagtaaaatgggtcaaagagggcctaccttagtgggagaataggctgctcagtaaatttggccattcttattaataacactattattttccctttcctgccctgatacccccagctgctccaccaaaacgaaccaaaaaaagcagccccctaagcagcagctgcacaaagatctcgatacggggtcaggacaggaagttatctgggagttccctaactttccatgagaaatctaaggcacagacctcattcacaagggaagtagggggcctggcacctgcttctgcttcatcaggcacagtgggaaactgccaactcagtctagtgccccactggacagatgggaaagctgaggcacagggaagtggtatgacgggtgccaagtcacacagcaaacaggaggcagggctggtccaggagctccaggcagactctggcagggcagcactgcccagctctttcaatcctcggagtactggcaaccttgaggccttcagggccagccaggtaacattaaagggtaaggaaggcttgatgcacacaacagggagtcataggtacgaggaacagagcacgcaggcttgggtataagcaggcagcaccagcccatcctcactgtacaggaacttgatctcctgattgctttgaagaacagctagaaatctggatttttgtgcatactttcctgaattttaagtgttacattctaattccaaacaaacaaaaaaaaaaaatatatatatatatatatatatatatatatatattttttttttttttttttttttgagacaaagtctcactctgttgcccaggctggagtgcagtggtacaatctcagctcaccgcaaacttcacctcccaggctcaggcgattctcctgcctcagcctcctgggtagctggaattacaagcgcccgccactacgccgggctaatttttgtatttttagtggaggcaggatttcaccatgttggccaggctggtcttgaactcctgggctcccacgatccacctgctttggcttcccaaagtgctgggattgcaggcgtgagccactgtgcctagccaaaaacaaattttaatcctgagcagccaagaaaacaaaatgatcctgacactggatgcgctcctcgggttcccagactgcaaccttcccccaggatttcaaagcaggtcctgagtatttttgtttgtttgttttgtcattgagctaaaatgacatgagaggtgcttggaaagtacttttccctataaagcaatgtcttgcccaggtgactaaaattccaccattagctactaattccttttagtcaaacagtgctctccctggatattcttttaaaaagaagattcaggcaggatgcagtggttcatgcctgtaatcccaacattttggaagactgaggaaggaggattgcctgagcccaggagttgccagcctaagcaacatagtgaggccccatctctactaaaaatttaaaaattagccaggcatggtggcacgcacctgtagtcccagctactggggaggctgaggtgggaggattgcttgagcctgggaggttgaggctgcagtgagctataatcatgccactgcactccagcctgggtgacagagcgagaccctgtctcaaaaaaaaggaagattccaaagcgtttattgtaaatgtcttagtctagaggagaggcctaagcaatgcttcagtcctggaaaaacaaagtaataataataacaataacggtagcaataactaacctatactgagcaatcagtatgctcaaggcaccatcccaagtactgaggacacagttgactgcaaaggcttttgagagggtgaagaaaagcatgtgtctattttagataagaagctgctaatatctccccaaaataccactcccaaggctgagatcagacacttggtgtctttccagcagagaagcatcgccacatttgccatctcgaaataagtctggcatcttccatggacaaaacttttggctgccaagtagctggggcacgcctgaggctctggccacctgacgtcctagagggagggccttgcacggagtcctagcagcggagaggggagagcagggggaggcaggggaaagtttacctcgacacttttccctaaaatgctgatcttaggtctagacaacagaaaagatgctgctaaaattactatgaagtctttccccaaaaggcatttggttacatctgattttaacgtgcacttgcagaagtccactctctgggcccatcctgggcttccagatgagggtctggaaagggcccctgagattataaacccaataaaagagacgcagaggcctggggaggactttccaggaaggaaatgcagagcagcaacaggaacacaggtcccatcagaccagggtgcgggtccagagccacacagaacgcctgataccgccttagcctgattgaggacagctggggagagtggtgctgggcaggaggtgctcaggcagagctgagaccctgaaggtaggagaaatggggacagtgcagttagagaacaaagaaaactcagtaagaaacaagaccaccatgtcacttatcccagggtttctgttgtgcacatgcatgctttgtccatgcagtttgagtctatccatcttttgaccctactagatgagtgtgtcgcaaggtgtggttagctccattttatcaatgaagagaatacgaggcccagagaggttaagacaccatttcaggatcacacagctgcagtaccaggcctccaacccgccagttcacaaatgctccatctcttcgctccaacattctgaccttttttgagttcgtcaactgtgccaagccctccccactgctgggcatggtgagctgtattccatcaccaccaaaggcccatccagtgccaggcctgccatggtcacctcgctactcatgtctcagtcacagctcatcagtcctttttctcagaaggcttctgtgcagttgaaatctaattcccctactccttgatgcaccgccccccagaatggatcgcatgatagcatcacacccacacctacctttcctagagcaaagccatataaaaatacctggagggattgctgaaactcagatgcccgggcgcccacagagattctgactcagcagaacctggatagggcccggggatctgcattgctaccaagttcccaggtgaggctgaccccatgctgtccaatacagtcgctactaccctcatgtgagtatttaaataaaaattaaccaaaagtaaatcaaactgggcatggtggtgcatgcatatagtcccagctactcgggaggctgaggcagcaggatcactggagcccaggagttcaagtctatagtgcgctgtgactgcacctgtgtatagacactgcactccagcctgggcaacacagagataccccatgtctaaaaataaataaaaaagaactgggtgcagtggctctcacctgtaatcccagctactctggaggctgatgtgggaggatcccttgaggctaagagttcaagacctacctgggcaaaatagagagatctcatctcttaaaatataaaaataaattagctgagtgtgatggtgaacgcctgtagtcccagctactccagaggctgagatgagaggatcacttgagcccaggagttcaaaactacaatgagctgtaaccatgccagtgtactccagcttgggcaacagggcaagaccctgtctctaaaaaaataataataataaatacatattgttaaaataaatatttttaatttttttaactaaatcaaatttaaaatggcagctctggccgggtgcagtggctcatgcctgtaatcccagctctttgggaggctgaggccggtggattacgaggtcaagagatagagaccatcctggccaaatggtgaaaccccgtctctactaaaaatacaaaaaaattagccgggcgtggtagtgggtgcctgtagtcctagctactcgggaggctgaggcagaatggcgtgaacccgggaggcggagcttgcagtgagcagagatcgtgccactgcactccagcctgggtgacagagtgagattccgtctcaaaaaaaaaaaaaaaaaaaatggcagttcctcagtcccactagccaggtttcaaatgctcaaaacccatatgtggctagtggctaccatattggacagtacagatatagaatatttccatcttcaccaaaaggtctattggacagcactggtctagactctagagcacatgttactgttagtaatcataggctcatccacgagtatctttttttttgagacagaatctcactctgtcacccaggctggagtgcagtgatgtgatctcagctcactgcaacctccgcctcctaggttcaagcgattctccctgcctcagcctcccaagtagctgggattacaggcacccaccactttgcctggctaatttttgtatttttagtagagacagtgtttcaccatgttggccgggctggtctcaaactcctgacctcaggtgatccacccgccttggcctcccaaagtgctagattacaggaatgagcccatccatgagtatctgattacagatggtccctgacttaaagtgtttagacgtgcaatggttcaacctcacaatggtatgaaagcaacacacatttagtagaaactgtacttcagtacagtactcaataaattacatgagatattcttccctttattataaaataggctttgtgttagattagtttgcccaactgtaggctaatgtaggtgttccaagtatgttaagataagctcgctaagccctgatgtttgtaggttaggagtattattaaaggtatatttgttgaataggtggatggatggatggatggatggatggatggatggatggatggatgcatggatggatgggtggatggatgaatggatggacagatggatggacagacggacggacggacagacagatgaatggaaggatggacagtgagctgaatggcaagaactccgaaaggggcagagactcccagtggcctaactcctcttgaaggcagaccccctacctcccttgattgacctgctagagcatgaaccctctgcttaatcccatagcccctgccccaagatatgagcagcagaggaatatccgctaggccttggataaccatgtcctgcttaaccaagaggaagctctgttggaaaagaaagtcaatgctaaaatgcctttactattttcagttcttggatacctagcaaacaagagctgacaatctgactttaatagctccagttctgagtgtcttaaagacatttctttccaactaagtaacccaaataaatttagctacatttttttaataaggagaaataattaaagaacagatggtgttgcttactttgaaatttttgctctaaaatagattttgtgtgcaccttggttggagttcaactctccccctcccccttgcattcgtgtgtcaggaaaggagatcagttcactaattacctggctgtcttttccctacaagatcccaatttaagaatctcgtttcattctaagaaaattaattcaaaatgccaaataatttaaaaatgtattaagattccccttagactagaaagcaaaaaggagctttcatttgtctgttaaaaatcaccttgggtagtagattgaagtttagctcttaagacttgatccccacaattgggcttttggcaaaagctatgggttccatatgtccacaaaatgtttcatttaaaatatatgtgcttttaaattggtctctgaccatttctatgccacagtctctaactgctccacgcattttcccaacccttggagccttgttcgcctcggaagctagactcttttatttgcattggaggtaacctatttccagcatgccaaaacctgttcactttcaaagccacttttggagattttatagcctgaaatggaataaaatttaaatttaataaaatttgagacctgaacaagaaaaaaaagaaaaactgaacgggtttaaaagccagctacccagacgcggaggaaaatattctaagaaaaccccacagggtggtggggcgggggcaggggcggggggcgatggggagccagaccatggatagcctgccaaatgtcatctggggctggctttagaagagaaccagagctggggaggcaatgcaattatttaaatccagaaagaaaaatgtttgctcccaaatttggcagcagatgattgcctctgattcttcccatttccaactgattccatgcaagcttaagtggaggaagcttcaggcccagaagaacgcacaggatgagggtcccacacctgggctcgaggcgtggtctgcaaagtgaaaagtcctgctctgtgaccagatgaacggagggtctcactctaaggccttcaggggtggcaaagcacatttttctttaaaccacaggttgtaacaagaagagatttctctcttcctttgtttctccctgtctctgcctttgtccctgcctggcagccccctcctctgcccctgctgctctctttttccctcccccggtgtgtgcgaaggccgagcctggctgtcactcaggcccttctgtgggcccagggaaggaggccacacggggctccccaggcctcagggtatttattaccacccccgacagcccagaccctctgcagcctccaaggctgtgctcaaaggcggtgaggtctgctgtgcacaaccatgaaagggcctctgggggatgcattcaatgcctccagttgggtcttcctctctctcccggagaaggttcaatcacttccacatccctatcctgctagaggaaagagctgggaaagccgaagatgagtaagaagaaacactccagcagtccctggttggctggtgaattccaacagcacgtgggcaggatctcctgatacaggagactgtgggagtatttgggctgaaatgacaacccgtttgcctaagtcacccccgcaggaattttttttttttttttctgaaatggagtctctctctgttgcccaggctggagtgcagtggcgtgatttcagcttgctgtgacctccgcctcccaggttcaagtgattctcacgcctcagcctcccaagtagctgggattacaggtgcccaccaccacgcctggctaatttttgtgtttttagtagagacagggagtcatcatgttggccaagttggtctcgaactcctgacctcaggcgatccacctgcctcaacctcccaaaatgttgggattacaggcatgagccaccacatccggccccctgcaggaatttttaaatccaagttagatggggtcaagatgatgttgctccttcatcctccccaggcaaggcccctagctgagtcagaagggatgagacccacattgtccaagagaactaagctctagttcgagctccttctgtctgcctacttcccttgccccacccctcagcccaaggcctcccctgctcacccctcttcttatgcatccatgtctttcttcttttacagggtaaaatccatccttctccaggaagttttcctgggggaataaatacaaaatttcttattgcaggctagtaagcatgtgcaatctcctggtgaaataacacttgtatacccatttgacagatgagcaaactgaggctcagactacttaacgacttgcccaggtagtcatctacgcagccaggatttaactgcttttccagatacacaagtgaattttcaaagcctctggatggctgatcccctgtcttgagcaaggtccttccctggggtatggcccagaggtcaggataggaggccctaaggcatcctcaccttctcttcagaccaccctggtgactaatgactctgggcaaagcagagaggcccgagtcggggacaaggcctgtgatcgaccttgaacttaagaagctccaagctctcaccagcgatgctaatgggccaggagtaacctgagccagcccttggatggaaactcaagccattatgcctggctggcctgctggtcggctggcatcactacctggacagaagcctcacttctccatttcacggggcttctgttcagagcaaccttttctcttgcaacaacaaaacagctcccatttatcaatcactgactaagtgccagacactctgctaagcactttacacacattatcttgtttaatcttcacagctgtgcagaaaaaaacgagtgttaatgctgcatcacaggcaaggaaactgaggctcagagaggataaggaagttgctcgagggtgcacagctagctggtaagctcaaagctggtgtctgaacaggcctgtgttcctaaccagagtcctatgctgcccttggaaggagattcttgcttgagattatggataatttgttttaatattttttcaaaatgctctgcaacattccgaaagggaaagaaaaaagttataacttgttgggggaaaaaaaaaggagaagaaggaggcagaggagacagtaagaggaaggttgggtaatctgcgaagttaccgtgatatgtggagggaaaatacacacacacacatacacacttgcacatgtacacacaccaacaggcttcatctgtcatgtatctgggattttgtgttaaaggggccgggcacagtgactgacacctgtaatcccatgggaagacagaggtaggaggatcacttgagctcaggagtccgagaccagcctgggcaatatagtgagacctctctacaaaaaaaaataaaaatttggtacacacctgtagtcccaagctgctcaggaggctgtgggaagatcgcttgagcccagaaagtggagattacagtgagccatataatgccacggcactccagcctcgatgacagagtgataacatctcaaaaaaaatttttttttaatccaaaagggtagtttttctcatctagggtttagattattagtgtcaaaactgggggggaatgtcccaaaataaattattccctatcatgcttctaagctacccaagagacttctaagcccacagccaggcattgcgtctccagccagacactgcacacgcttcctcagagtcctcccagcagtcccaaaggtagagattagagcccccctgtcacaggtagggaccctgagcctcacagagagtaaggtacaggcccatggttcctcaggtgacaagagacagagccaggttttgaacccaggtcagcctgcttccaaagcacttccaccctgcttgcaacttccaatcatgccaataccaagttgggggtgggggaggtgtgctgttgctaagtggtctcaggccaggagagagagctacagagatgctacacagagcctgagtggcaggagagtggcactcaaatcctcagctctggccagatttcaggaaggcaggagcactgggtggggagccaggagacctgggcaccaccagagctccaagataaacttgggcgagtcacttcccatctccaagcctttctaagcctcaaatgccattttcctgcagaacaggagcttttctgggtctcactccagaaggaaacctgaccccttgctttcccttcctggaccccgcctctccaccaaatgccacgctgcccagaaaaggacgagattccagggtgccccgtaagcagaggccctgagaatccaatgggcgggcacctccacccaccagcagctgccctcctctctgatgcaaaagaaactcgtgggctggtttttaagactcgaaataaagtttaaatattacgtggaaattactaaacaaatcaaatcactgttaagtagatgtcacaggcttcctctagacaatacatttaatgaagattattgtcctcctggttatagttttagatttgcattttattatcagagaaccacttatgcattactccaggattttcattaggtaaataaatttttatgtggatttcattatattcccttggctgaaatcctgatcacttaacagcaagaatgctgctccgacatcctgtgtgtcaatcaggatgtaactgtttcctttggttgttgaaaattactttttaaaaaatctggtgttgatggcaaaaggaagagagatagggtcagaactctgggtaggttttgtgtccagttctttcactgaaacatacacacaccctaaaaagaaattttctatttaaaaataacacatgtaattttacatacatgggatatataagctcccattctctctttctctccatacatatatataatatatacttttttttttcctggtgtcactttggcctctcagatgtaaactgacacaatggcaccgggtctaacaggactgaggtgcaggtcagtaccagagaaataaagttgaaagaaacaagcttggaagaagcaggaaggaaggcagtgggggagacattcctggaaaggcagccatcagcaagaaaaaaaaaatcttttctaagaagtctaatatgaagcaattaagctaattggaatctagattgtagtgggtgcctccggaaacttgagaccaggggactctcttgctggaaaaatcacacctcaatatcaatgagcgagggcgtgaatgaacgaagtggtcagaaacagaccataacatccagacctaatccatccagccccctaagacacaggcggttccaggccctttccgagggaccaacaaggtttcagaagaatgtactaataataaaatctcttgcttattgaaaagggctggccaggtgtggtggctcacgcctataatcccattactttcggaggccaagacaggtggatctcttgaccccaggagttcgagaccagcctaggcaacatagtgaaacctccatctgtacaaaaaatacaaaaattagccaggtgtggtggcatgcacctgtagtcccagctcctcaagaggctgaggccagaggactgcttgagcccgggaggtcgaggcttcagtgagcggagattgtaccactgcactccagcctgagtgaaagagcaagaccctgtctcaaaaaataaaaaagaaagggctgtcacatgccagggatgggctttgatgtgcattattacatctgtctctggtcaatccagcccagaggactcaaagagaaccttccaagatgcctttcttaagagcaaatgagagaggcaaagctctcaacatggccagggcacgcagcagcaggggctacccaaaatgcagttaaggggaaggggaacaagtcaggctggattgattcatggcatcttcaaccttaactcctgcccagagccaggactctgatgttgaggtcccagtccctaaccacctgtgtgattggggaaggtcattaccctccctaaccctgttccttgcctgtgataataagaataacagcaccaacctcatagagttgctgtgagaatcgaaagaactgaatagggactgcttatgtctagtgcctgggacgcaggaaggaatcaatacatgttcaccattacagggaatgttttctacacagaactatcagcctgaaagtgagtcactttccgacagttctttccagctgttgatgacttaccaaaactacctggactccaattccaagttctttaaggacgcaacaaaacctccttaatcttcgatcccaaaattagtcacctgtgatactcaagtaggggtttgactaagcatttctctctgacctttgaaaaggccactggggaagaaagcaaagggacatgataaaatgaggatgcctgaaaggagggtccccgctgcaacagtggtcctcttcagggggacattccggagggtttgattttc

SEQ ID NO: 1542 - DNA, 31916 bp, Homo sapiens
ctccttgcacatttactattatttgcaggagcttgacaacaccaatatcaagtaaccaaagatggccactatacattgcttaaacactctcaaaagtgtctccccatatgtgtaactacacatcagctatatgatccagatgttcataattctaactagatagaagaaagttggccttggtcaccttctgagtccccacaccataattgtggcatggagcactctacttccccattgtcagatttctgaggcatactgagttgtggcttccagtttaaggctttccccaagtcactgcacttatagggtttctgtttagtatgaattttctggtgtttaataagatttgatctgatggtgaaggcctttccacactcagcacatatatatggtttctctcctgtgtgaattcgatgatgctcatggagttgtgatttcttaatgaaagacttgccacagtcactgcattcatagggtttctctccagtatgaattctcctgtgtctatttaagtgtgacttctggatgaaggatttcccacattcattacaaatatagggtttctctcctgtatgaattctctgatgcataattagtgttgattttcttgcaaaggctttcccacattcactgcactcataatgcctttctccagtatgggattgctgatgtatatggagacctgacttcctagtgaaggctttcccacagtcactacatttataaggtttctctccagtgtgaattttctggtgtgtaaagagatttgatctgtcagtaaaagcctttccacattcagcacacctatagggtttctctcctgtgtgaatctgctgatgtacgtggagctgtgatttcttagtgaaggatttcccacaaatactgcattcatagggtttctctccagtatgaattctctcatgtgtaataaaatgggatttgtggaagaaggccttaccacattcagtgcaaacatatggtttttcccctctatgaattctctggtgcatacttaatgttgacttctgaatgaatgctttcccacattcactgcattcataatgtctctctccagtatgacacttctgatgtatcctgagccgagacttccaggtgaatgattttccacagtcgctgcatttataaggtttctctccagtatgaattttttggtgcttaatgagatttgacctgtcagtaaaggccttaccacacacagtacatatatagggtctttctcctgtatgaattttctggtgtataatgagatttgtcttgtgagtgaagaccttcccacattctgaacatataaagggattctctcctgtgtgaattcgctgatgcacatggagttgtgattttttaataaaggatttcccacagtcactgcattcatagggtttttctccagtatgaattctttcatgtgtgataaaatgtgacttccggataaaggccttcccacattcagtacatacataaggtttttctcctgtatggattttctgatgcatacttagtgttgatttccttgtgaaagcttttccacattcagtacattcaaagtgtttccctccagtatgaatttttttatgtatattaaggtttgaattctgagggaggtttttctcacattcactgtactcataaggtttttctccagaatgaattctctggcatctgaacagatctgacttctggataaaggctcttccatagtcactgcatttatagtaattcccctcataaggagttttctgacggtttgacttgagggaaaaatccttctcatattcagtgcatattcctgcataaaccctctgactgccatcaagctgggacttctgagtgaagactgcctcacattcatggcattcatgctgcttttcttcagcacaaatactctcatgtgcaaaggcatgtgacttcggggagaaaacatttacgtagtcagaaaacaaatagaggctctctctagtatgaattttctgttgttgaatgagagcttgcttatgatgcagaggtttcccacattggttacattcacaagcagtcacttctgtatgagaattcaaatgagtgaaaatatcaccatctccaatagtcttatcagaattttctgttgcattgtttctattatataaggttatgataggctccaaattctttccacacgagttacagttatggggtctttttcttgaggaaaccaggtgtgtgtttacatgaactatttccccaatgtccttatattcaaagatgctgtcattagctagtgttttcttgttaatgaagacaacacgacttaaaggtttgttctggttttctccacattttcttgtgtgttcatcgtctttccacaattcttctaaaatggaatatgggtcatctcttgtgaagagattaatattaatctcagactggaaagaaacttcttcagacatcctctgttgtaaaggtccaaaaccaatgtccccatctaaaaaagaaagaaaagataagactgacaaaaagaacaattaacagaaaataaggccaggtgcggtggctcatgcctgtaatcctagcactttgggaggctgaggtgggcagatcacttgaggccaggagtttgagaccagcctggccagcatagcaaaactctgtctctgctaaaaaacactcaaaatattgtctctactaaaaattagccaggcgtggtggtacatgcctgtaattccagctactcaagtggctgaggcaagagaatggcttgatggcttgaaggcagaggttgcagtgagctgaaattgcgccattgcactctagtctgggtgacagagcaagactctgtctccaaaataaataaataaataaataaataaataaataaataaataaataaaaatacaatagacctttgattcaggccgggtgtggtggctcacgcctgtaagcccagcactttgggaggctgaggcaggcggatcacctgaggtcaggagttgaagaccagcctggccaacatggagaaacctcatctctactaaaaatacaaaattagccggacatggtggtgcatgcctgtaatcctagctactcaggaggctgaggcaggagaatcacttgaacccaggaggcagaggttgcggtgagccgagatcttgccattgcactccagcctgggcaacaagagcgaaactctatctccaaaaaaaaaagagttgattcaaggcagacacagagatatgagagagactatataaatataacaaatgtacataagtattttaaatatacataaatatataggtataataactcatttatatataatatgtaatacaatgatgtagagtaataatattaatactaacatttataacatgataaacaatatcatttagatgtgctgttctaagttctatattaattcacttaaactttatcacggcccggtgtggtggttcatgcctgtaatcccagcactgtgggaggctgagatgagaggattgcttgagcccaggagtttgagaccagcctgggaaacatagtgagacccccatctctacagaaaaatgaaaaaacaattagctgggcctagtggcacatgcctatagtcccagctacttaggaggctgaagcaggaggatcacttgagcccaggtgtttgaagctgcagtgagctctgatcgcaccattacactccagcctgggtgacagagtgagactctgtctctctctctctcttttttttttttcttttttaagacagggtctcactctgttgctcaggctagagtgtaatggcatgatcagagctcactgcaacctccacctcctgagttcaagggattcttgtgcctcagcctcatgagtggctggaactacaggcatatgccaccacaactggctaatttttgtatttttagtagagacggggattcaccatgttggccaggctggtctcaaactcctgacttcaagtatctgtccgcctcggcctcccaaaatgttgggattacaggcgtaagccagcaagcccagccaagaccctgtctcttaaaaacaaaaacaaaaagcactttattgtaaccctttgctgttggtattattattgtttctagtttacagatgaggaaactgagccacagaagagtttagttaaatttgcccaaatcaaatgtttagtaattggggaagaagagattgcaattcagtgcaaatgtagtagaactacatggtgagtgaggtgtcagaagaacaaagtgataaactctgtgaaaagaagtatttctgagtctagattcttttccttaatctgtaaatcctcacaatcttcctgttttctcttctccctatgatccactgtgccctaaataccaatgtatttatgtttacagtaaaattacgatatcttagtcatcctaacttggccaaacagaaaaatttatatacatttgttatatttatatagcctctctcatttatctgtgttttccttgaatcaactctatgtaacaattggtctattttcttttgagatggagcctcactctatcacccaggctggagtggctggagtgcaatggcgcgatctcggctcactgcaacctccgcctcccgggttcaagcaattctcctgccttagccacatgagcaggtgggactacagacatgtgccgccatacatgtatttgtaaaaatacaaatttttgtatttttagtagagatggggtttcaccatgttggccaggctggtctcaaactcctgacctcaagtgatctgcctgcctcagcctcccaaagtgctgggattacaggtgtgagccaccgtgtctggcctatggttcaattcttcatccctggtttggggtactgatgtgataaatgcatctggtagaagacataacaggaaagaactagacatcagaagagaagactgaaagttgttcatcaaacctgtgcccttccttcacaatattaagcttgtagccaagcacatggctgcttcacaacactaggtttgttcagcttcatttgtcactaggtggcactgagtaactctttttcactcatcagtggaagtgataaggccaatgtcttaagaaagtgggtttgtctcctacaaacctcttcttttcccaccagtatattccaacttggcagcacccagttctatgaagctggcaatgccctagggcaggggtcagaaaactgaagcccttgggccaaatccaggcctctatccaaaagctaacaatgtattttacatttttaaatggtcaaaaaattaaaagaagaatactacttcacgacatatgaaaattatatgaaattcaaatttcagtgtccataaagtttttattggaacacagccacacccatacattgatgtattgtctatagctgctttggggctacaactgcagaaataagcagttgtgacagtagccatatggtccacaaagcctatttacttttgtgcctttacaaaaaatttgtcagcccttgccctaggggatggtggtacaatgactttctagaaactttgtccctgaacggccatggaaacagagttgcccggtgttatggccatcgaaaagggactaacacacatctttccattagtcactgcagtctattttatcaatgaacccaaacatacagtcttttcattttctccatttaagcttcctttttctgatcttttgtttctatcaaaaattcattgttcttcattaatcatttggggttctctgctttaaaagctaatttcaaatttcaccacaactctagagaggctctcttttaacttaaaaacaaacaacaaaaaggtactctgaaccactcatatttatatttgaattggcatagatgtgcacgttaacaaaagtgtaatgcacaaagactgaaattttcaagatttcatgcagttatcctctttccaattagtttttctagccctttgaattgctcctaaaagaaaaattttaaaatctttctgaaatagagcaaaacgacctcctctgcttataacacaaattcaggaatttaatttcactattttctacagaaactttgcattttaatgtacaagagtaaaagcctcagttatcatgtaatttaatgtaggtttctctgaatttctggaggttgtatgctgcaataggtcaaattcaaggagtaagtgaaagctgagcacaaaatatgtgtattatttggttttttgtttgtttttgtttttgtttttgttttctgagatagagtctcactttgttgcccaggctggagtgcagtggcacgatctcggctcactgcaagctccgcctcctgggttcacaccattctcctgcctcagcctcccaagtagctgggactacaggcgcctgccactatgcctggctaattgaccttgtgatccacctgcctcagcctaaagtgctgggattacaggcgtgagccaccacgcccagccttttttttttttttttttttttttgagacggagtgtcgttcttgtcacccaggctggagtacagtggcgcggtctcagctcactgcaacctccacctcctgggatcaagtgattctcctgcctcagcctcctgagtagctgggattacaggcccctgccacctcgcctggctaattttcatacttttagtagagatggggtttcgccatgttggccaggctagtctcaaactcctgacctcaggtaatccacccacctcagcctcccaaagtggtgggattacaggcgtgagccactgtgcccagccaaaatatgtgtattatttgaatacgcagatagataacataataatcaaagggctcgatgaaaagggagaattaaagaaaatcttaaaataggatagaaatggttatagaaaacagggacaaatgtgaattgcaaatatgaggccatattctttctctagcttacaaacctactgagaggagaatctgtcacatgttagatattaagtagtaactttagttttcttccatgtagctatgacaggataaacacagcacacaatgttttaagtagtgaaatctatcagcagcatctgagatgaaatagtgaaaaagaaagaatgggattatcacatacaaataggattagaataatctaggcatgagaaaacacagacatggttgtaggtgatatgactgggaggtaagaaagaggcttttgtaaatgagaaaaataagtagaaaagcagaatgaattatctgagaagatggattagagggaaaagtaaaaaaactccaagagaagatgacaacattttgaaaggcaagccacctgcttttacatgctacattgtatcttgtcttccttcacacaaacagccagacccttaaatgcaaacagtattggtctttcccctgagtgctgtatacaatagggccaatgcctgactgagacacacaaataacagtcacagagtaaaagttgttcccatgagccaattatcactcagagcttatgctgcagctgagacacataatctaagacacagattatgctgggctgagacacatggacctgggcaactttaaggagggcccaaagcccttacacctgcctctaaatgtccatgataacttctaatgtaggttagttatgtataggacagaggcaaagtgcatacttgccagcaggcagtataaccagttgggaagaggagaaagacccctgtgggggtggtcattgccttgacatcctgcttattgccccagctgtaaatgacctgcaaggagaaatggaccccaccccaaacttggttcagatgtcaagagtgacgatgagacacacacaataagagggtgtaaaaagatttgttactcacataatgaggctttctggggacagctccaagcaggtccagatggggctagagtgagcaaggaaaggactgtcttgggagtttatggcaggggcgggtggggctgggctaactattcccttatgtagttggaatttcccagcaacaatggagggaactcatgggcttttttctcagtttgtccaggaaaaaaagagagagagatgaggcttagaaaacatcagcagttgaacatcaaaaatgaaggatacagaatgagatgttcaaagtattttattagggaaatacaaattaaataataattagaaattaaaacccatcagattagccaaaatattaaaaatttggataatactaggtatgggtagggatgtggggaactaatacccttgtacaaagttccagggaccgtagagtgacacagccaatctggaaaataatgtgcttatacctcatcatattcaatattagtatgcccaatgataaagcaatcccactcctcttccttaagaaattctcatttccggctgggcgtggtggctcccgcctataatctcagcactttgggagtccaaggcgggtggatcacgaggtcaggagatcgagaccatcctggctaacatggtgaaaccccgtctctactaaacatacaaaaaattagctgggtgcagtggcgggcgcctgtagtcccagctaccggggaggctgaggcaggagaatggcgtgaacctgggaggtggagcttgcagtgagctgagatcatgccactgcactccagcctgggggacagagcgaaactccatctcagaaaaaaataaataaataaattatcatttccagtaagaataattcatgaagaaatgtattgcagtactgtttgtagtagctgaaaaactggacaagtaaaatggggtatatatgtgcactacagaatgatatgtagaaattagaataatgcactgcaacatggaccaatttgagaaaaaaaaacttgagtaggatatataatacagtaccatttctacaaattaacaatgccaacaactcagattttataaatatcccagaaattcaaggataaatggcataacatgtcaaatatattagaacagttgcctcttggaaggataaaaatgagtatggagactgaggattaaaaagaataaataagaggggagccttaaacacattgatgatgatattgactaaaaactaaggctataattattaactcaatcttctgtacaggatatacctgtacactagataaaaaactttgtgtaagatatgaaaataaataaattagaaagatcaagtcagtgttgcgttgcactagccaagtaggaagaaaatgtcaatggtactctcaaagtcaacaatcagagaagaggcatggggggacttcagacaagcccatctctagatgacaattgtgaggcactaaggggaaagagacaaaatgagaagaaacagcaggagctgaagttgtaatgcatagtaatgttttcagaaggtagatctatgagtatttgaatgcataaggaaatgatctaagaccttgatggaggtagaaagaataaaacttttctagggaaagagagaaaaaagcaagaaaacaggaccctagaaagtagagtgtgacatgatccaaagaaccagtaattgtagcatattccctcctaaaaagccaagcaaagaagaaggcattgatatgagaagggatcttaagtggggttagcatttagctatccaagggtccttgtctaataactgctcttccaagcagttctaaaagtcattattaatgacacatcaaagttgggcaaagttgggcacagcttctcccagtacaaatgcagctgagtcatactgtctaccatgctcttggttcccttctcacctggacggctctgactggggatctcaccatccaacatacatggctcttcttgttccaagctgaagatgacttctggtttgggaacttgacatcctgttaacaggggatgatagaggacttgatttcagaggccatacaatgaagcattccatttttttcccaaaaaagttcactgggaacagaggaatattcacactacccgaaagagattattaagaacatgggacaaaataaggacaaaaccattacacactttagatgtcctgcagtctttagaagtcccacatacctcagaaaacacagacttcagcaattctactgagaagaaaaatatactcaattaggtgcagcctactctatacccagcagagccgtgcttacccactgagatcaagttgaaatagttttccagcatcacttctctgtacaggcttttctgagcaaggtctaattgttgccactcatccctactgaagtctacagttacgtccttgaatgacactgattcctgttaaaaaaaaaaaacaaactttaaaataattttttaaagaatatatttgaattcaaaaaaaaaaacctttcaatgtgaaggatcgagattacagaatggaaacaagataggaccttatttttaatgtgatacaatatactataaagaacttctacaattcaacgacaacgaacaaaataattttaaaaatgggtaaaaagcttaaatagacatttctgcaaggaagatatacaaatatttaacaagcacatgtaaagatgctcaacgtcattaatcactagggaaatgcaaattaaaactacaagatattacctcacacccatctggatgataaagaaaatgtctaaaattgattataatgatggctgtacaactgagtgaatacactaaaaatcaatacatggtacactttttttttgagacagagtctcgctcagtcgcccaggctggagtgcagtggctcgatctccactcaccgcaagctctgcctcctgggttcacgccattctcctgcctcagcctcctgagtagctgggactacaggcgcccgccaccacgcccagctaatttttaaaaatttttttagtagagacggggtttcaccgtgttagccaggatggtctcgatctcctgacctcgtgatccgcccgcctcagcctcccaaagtgctgggattacaggcatgagccacgacacccagcctaatatggtacactttaaatggtaaactgtgtggtgtatgaaggagagggctctttttcagcactgccatttccagatgagatgcagtagcttggcagtccagtgcttccttcaacaatgaactgtaaatgccagacgcaatacttgaaatcatctgtttcaaagcactggaaagctgctgaggtagcaagaaatataggggctaagactggagaggagagaatattaaagattgaagctgacttattcagtcactctgacagtgggagcatttaccaattctggctgtggacaaaagctgagaatccagcttttgtcctggattctcattttgtcctgtctactggagaatgcagtagaaggctgcagctgggtgacagagaaaccaacataactcaaacacatggccattttcccctcaggatatttgctgaattctagggtatatagggcagtagactaaaaatgtaagcaaacagcctttgaagaacagagcaaaagtctagtatctgttaagaaaatagttgggcatctatcaggaagagggtctttagaggacaaaagggctctcagctgaaaattctcaggagccagggtgatccagaggtaaagtgagtcttagcagagcttcaacccggccttatttcaacatcaacagtgcctgactggatgtacgtgttctcccttccctccatttgctaacataaggaaagatgaatcctctgtggagaaagattttttttttcttttcttctgagacagggtcttgctctgtcatccaggctggagtgcagtggcacaaacacgactcactgcagcctcgacctgggctcaagcaatcctcctgtctcagccccacaagtagctgggactacaggcacatgctaccatgcccagctaatttgtctatcttttgtagagatgggttttgccatgttgcccaggctggtctgggactcctgagctcaagtgatctgtccccctcagcctcccaggtatgagccctgcctacaacttattatacacagtgtttaaaacaaacaaaaaaatcctacacatccaaaaagataggaccacatatccaaaatcagagaaggaaaaaattcaatagaaacagtcacacagagaattggagttagatgaaaagaggactatctttagagagttggttcttataataaagaatcaaatgaaagttcaaaaattgaaaaatctaaaatctaaaattaagaagtccttatgcaggtttaacagcaaaatacagaatttctgaaatggaagacaagtaaatagaaaatatccaaactgaagcagagattttttttttaaagaaaaaaacataggagcattaggaatatgtgtgacatagtaaaaaaggtataacctatcagagtctgagaagttaaagaggagagtgcagggaaaaagcaatatttgaagaagtaatggctatgaatgtcatcaacccttaggattcaagaagctcttcaaatacctctttacaaaactgcaagtattgactatgcaaaacagtaacagtactattctgggaggtttaaaatgtatgcaaaatttaaaataatggaaataataatgcaaaaatgggaggcagtaaatagaattaaagtgttttataaagtatcctagcattattaaggagataaaatagtaagttcaagatgaatgttttaatatctggggtaacaaacagtaaaagaattataacaagtaaacaaaggaaaaaattaaagagtaaaaaaattatgtaatataaaaagtcaagaaaggaatgaaaaaataggtagttcaaataaaaactaggccgggcgtggtggctcacacctgtaatcccagcactttgggaggctgaggcaggcggatcatgaggtcaggagatcgagaccatcctggctaacacggtgaaacccggtctctactaaaaatataaaaaaattagctgggtgtggtggtgggcacctgtagtcccagctactcaggaggctgaggcaggagaatggtgtgaacccaggaggtggaggttgcagtgagccaagactgcaccactgcacaccagcctgggcaacagagcaagactccatctcaaaaataaaataaaataaaataaaaactaatagtaaggtggtatatataaattcaagtatatcagtaattacattaagtgtaaatgcattaaacatccaagttaaaagcaaggattgagacttctggttctaaaaaacaaaacaaaaaaaagagtgcattccacccaattcctcctgctaattacctaaaaatctagaaaaatacataaagcatctgtcagaagactcactggtggagaaaagaaagtagaacctaaggacttaaaaaacaacacagtagtgagttagttccctagagggaacttagagggagagagggagctcctacatattgcaaaatgagtactagaggagcttgcaacctggaagaaccaatgagcacagacaaaaaaggcctccccaaagcatacattttccagccaaataatttgaaatagggcagcaatgcaggatgggaccttttgactacacatacctacaaagttcagaagtacccaagaacaccctcacttctgacacctactgcaagcagagggatttcccaggatcacctgtacttctgacaccaattccaagtcaggggtccccaggaccaccctcaggttccacaattcacagaagaactcacagaaattagaaaagccataatactcatggctatggtgttatatagtggctttacaatgaaaggatacagatcaaaatcagccaagggaagatgtgcttagtgcagtgtcaatgagagttccaggtgtgagcttccagtggttttctcccagtggagtcatatggacagcacttacttctcccagcaatgatgtgtgatgataatacgcatggagtattgccaactggggaagttcacttgagccttgatgtccagagtttttactgagacttgatcatgtggacatgaatgactcccactgtggctgatcttagtctccagcccctccagagctgatattgcatggccaaaggtaccccactataaaccacatgttggcatagaatattcagtgtggcccaaagctcccaccataaatcacactgtcattatatactatcttgcatggcctaagcaaggcctgcaggacattccaaagatttagaggttacctcccaggagctgagtgcaaaggccaaacctctctttgggcaaagttaatcctttactgcacaacaatatacttgaggccaggcgcggtggctcacgcctgtaatcccagcactttgggaggccgaggcaggtggatcacgaggtcaggagatcgagaccatcctggctaacatggtgaaaccccatctctactaaaaaaatacaaaaaattagccgggcatggtggcgggcgcctgtagtcccagctacttgagaggctgaggcaggagaatggcgtgaacccgggaggcggagcttgcagtgagctgagatcacaccagtgcactccagcctgggcgacagagcgagactccatctcaaaaaaaaaaaaaaaacaacaaaacaaaacaaacaaaaaaaaaccagtatacttgaggtgaaaactacaaaagatgcatcctttgccttcttcacaaacaatgtgactccaaagatggtggggtggagctctctcaatcatcccaactgcattagctcaaagagaggtagcacccctcttgcctctccagcaggcattatatagactgtattggctaaccctaccccaaattaagtgaatgacagcaaagaagaagtagctaccttcttccaatagagagtggaggatggattatggagaaagttataaaaaggggttctttaaatacatgtatgatgacctgggcacacctacgagcagcccagatataaaatgaatcagaatcaacatagaaaaagctttcagggctgaactagggtgtgggatactgtccaggtttcaaattagcttctgggtagcacaaaaatgagggagaccaaaatagaactgcaaagactttcaaaactaagttgaatttgaaatacagcccataaaaatagaccaagacatgcactctaaacctaaatgtgttgacaactgctaaaatagaggatttgaagagaaaacagaatctcataacatgatattcagaatgtcctgaataaagccaaaattattcatcatcttaagaaccaagaaaatctgaaatcaaatgagaaaagagcatcaacagatagcaacactcagatgaatcagatgttggaattatttgacaaggatttaaagtagctaactaaaagtgttgcaacaagcagctgtaaatagtgttgaatcaagtggaaatatataaattctcagcaaagaaatagaaggtatgaggaggaacaaaatgaaaattttagaaccaaaaaatacagtaagtgaaattaaaaacctcactggatgatctcaacagcagaatggagatccaaaggaaagaatcagttacctcagttacctgtaagatagataaacagaaattatccagtctgaacaatagaaaaaataattgatgaaatgattgtttcatcaattccctcaggctgtattcagcctaagggacccagcgggacaataacagaacagccaacaatcatttcagcagtcctagaaggaatgaaaaagtaggacgggagactggaaaaagatatgaagaaataatagctgaaaacctcccaaatctggtaaaaggcataaatgtacagattcaagtcgctgaccaaatctccaaaaggaaaacctcaaataaatccatgtctagatacattgtaagatttataaaatccaaatttaagaatagaacctgaaaacagtcagagagaaatgacacattacatgtagggaaagggcaatttgaacaagaatgactttctcattaaaaaccacagatgtcaaaaggaagtgggaccatatttttcaagtgctgaagagaaagagctgtcaatattgaattcaatatccagtgaaaataaaataggctctgtttaaattctcttaaacttaattctgaggaattacctgccattggtagttgagaaagaagtctgaaaaaaaaaataaaaaaagaattaactgccatacatttattaagcataattacttaggtaattcttaggaattacctgccatatatttactaagcaagatgttgagaactttatgttgtgaacatcttcacaactttacacaatatgcttcaagacatcaaagaacttacaacaactttctaagatattataaagggcataagagatgtgcaaagcatagcatgaccccaaatagagagaagaaaattctacatggagtgtaagactaagttctgtagagttgatgaaacttaagcttagtcttgggagatgccatgtttaatgcaagcagagtagggcaaagtgatttttagaagggagcagcatgagcaaaggtataaagacaggaaaatacatgataaattcagggaaccacaaattagtctgcataatgagaagtctgtatgcagtgaaggaaaggtgtttatgaggaaatttcagtagaggtatgctggcatgagatcatgcaactatttttcctccaatacataatggactgccattaaagtaatttatatatagagaaaagattattagatttatgtttacaactgccaagaagatgctggccaggttgtggagaaataggaacgcttttacactgttagtgggaatgtaaatttgttcaaccattgtggaagacagtgtggtgattcctcaaagatttagaagtggaaataccatttgacccagcaatcccattactggttatatacccaaaggaatataaatcattctgttataaagatacacgcatgcatatgttcattgtggcactattcacaatagcaaagacatggaatcaacccaaatgcccatcagtgatagactggctaaagaaaatgtggcacatatacatcatggaatactatgcagccataaaaaggaatgagatcatatcctttgcagggacatgcagggagctggaagccattatcctcagcaaactaatgcaggaacagaaaaccaaacgctacatgttcttacttataagtgggagctgaacaatgtgaacacatggacacagggaagggaacaacactcactggggcctgttggggaagggtggggggtgggagagcattagggaaaaaagctaatgcatgctgggcttaatacctaggtgatggcttgataggtgcagcaaaccatcatgacacacatttacctatgcaacaaacctgcacatcctgcacatgtaccctagaacttaaaataaaaaataaaaaaagactatcaagaaacagcagggagaatacatttgaatgagcaagagtggaagtctaggcaatatttcatgtgaaagaattaaaacaccttagttagggagaaaatattatttaacaggaatatagaaaaagaaattggtgtagatagtaggtaattagaattgatagatggagtaagaaaaaggaggaactaaagtgaaattctcaattattcgttttgtatactctgagattatagtgtcatatactgaagtagagattgatgaatggaaaaggttggagaaagggaaccagatgaaatcacttatgttttgcacatattgagattacagggattaaacatgtaggcaggcatattataggacgttaggcagaggcctagagtggagataaagatttgggagtcaccagtagataattaataactaaaatcatctgagtaaatgagactgcttgagaggacacctgataaaggagaatgtaaaggaaagaatctgaaaaagttaccagcattgaagaagaggtgtcagcaataaaaactgagaaatcggacagagccaggagagagtaacgtcttagaatgtatgtggggattagttgatggggttgaatgccaagatggatgaaaaaagcaaaagacagataaattctggcttttgtatttaggagatgtgacagtgatagctagttgtcttccaacattcactcatcctttcttccctaataacagaacatgaattcttagctggctactctgagtaagactttcttttcccagcccaccttaaatgtaaccaggaaactatactttggccacagagatacaggcgatacttctgagatgtcagtttttaaaggagaaggtgtgagtgcccctttcctccccaacctcaccatgctgctggcctggaacgctgactcagttaatgcaaccccagcaaatctcgggaactatcaagtgacgtgaggttgaaaatcacaaaatgagaatgacatagagaacaacaacaaaaaaaaaaggtgtataaatttgtgaagacatcaggccctgaatgaatactttcagacttcttttgcttcttttgtgtttaagcccgtaattcttagatttctgttatactaaaatgcattttgccagacaattctaataaaatagatagaaactgggttgcaattacagactcttaagcttttaagcaaaaaattcagtaccacgtaatagcaaaaagatcagtacttcaggaaaatataattcatattttgaatgacaatctaaaatacataaaacaaaagttgacaaaattacatggagaaattgataaacctacacacgcatgggagacttcccaactccccctccctactctgagagattttaaccagattacattcattaatcactagatatagcaacaaaaatttggcacatataggaaaatttctgcaagaaaattgacaagccagttacaaaggagatgagatctcacacataaaacaaatatgcaatagtcaaaaaataaggattatacagaagatctgaacaacacaaataagctgtttgtgatgtagacagaaatcacacacacacacacagagagagagagaaagagagagagagagaacgagagagaaagagtatattcatcattatattaggggaccatacatgaatgacagtgtgatagtacacaaaatgtaaaaagaacataaatgtaacaacaggctgggtgcagtggcacatgcctgtaatcccagtactttgggaggccaaggcaggaggattgcttgagtccacgagtttgagaccagcctgggcaacatagtgagaacttgtctctataaaaaatcaaaacaaaaacaacaacaacaaaaagcaatacaaactacagacaactcagtttaaaaaaaagggggaggaatgaatcaagcaattctcaaaagaagtgtacatgacaatgaaattctgaaaaactgttcaatcacattagtaaccagggaaatgctaattaaatccaaaatgagatacctctgcaaactcccaagatggctaaaattgtaaagattgaaaacaccaagtactggtaaagatacaaagtagtaaacatatctgcacactactggtaggaatacaaattggcgtaacaaactttgcaaagctgtatgacatcatatactaaagttggagaggggccaggtgcagtggctcaggcctgtaatcctagcactttaggaggccgaggcaggaggattgcttgagagcaggagttcaagactagcctgcgcaacatagcaagacgccgtctctacaaaaagaaaaaaaaaattagccaggcatggtggcatgcgtctatagtcccagctacttgggaggcaggggaagcaggatcacttgagccctgaaagttgaggctgtagtgagctgggatcacagcattgcactccactcagcttgggtgacagagcaagaccttgcctttggatagaaataacttctgaaagaaatgttcacaagagcatatttcgtaatgcattttatatttctccatagtaaaggcttaaaaataaatgaaaataaaatcataatggtacagaaatgcatatggtataccatcttctgtggaaagaacataatacttttcctatttgtttttgtctatataatgacactttgaacacacactaaaaaaaattagttatccagattgaggacatgggctgataggaaaagaaagagggagatttttcactatgtacttattttcttacttttaaatcatatgcatgtattacctattcaaaatactcatctgacaaaggtctaatatccagattctacagggaacttaaaaacacatttacaagaaaaaaacaaccccatcaaaaagtgggtgaaggatatgaacagacacttctcaaaagaagacatttatgtggccaacaatcatacgaaaaaaagctcaacatcactgatcattagagaaatacaaatcaaaaccacaatgagataccatctcatgccagtcagaatggctattattaaaaagtcaagaaacaatagatgctggcgaggctgtggagaaataggaacacctttacactgttggtgggaatgtaaattagttcaaccattgtggaagacagtgtggcaattcctcaaggatctagaaccagaaataccagttgacccagccatcccattactgggtatatacccaaaggaatataaatcattctactataaagacacatgcacacgtatgtttactgcagcactatttacaatagcaaagacacagaaccaacccaaatgcccagcaatgatagactagataaagaaaatgtggtacatgtacaacatggaatagtatgcagccataaaaaggaatcagatcacatcctttgcagggacatggatgaagctggaaaccatcattctcagcaaactaacacaggaacagaaatccgaacactgcatgttctcactcataagtgggagttgaacaatgagaacacacagacacagggcagggaacaagccacaccagggcctatcaaggggtggggggataaggggagagagagcattaggacaaatagcaaatgcatgcaggcttaaaacctagatgatgggggccgggcatggtggctcacacctgtaatcccagcactttgggaggccaaggtgggtggatcacctgaggtcgggagttcgagaccagcctgactggagaaaccctgtctctactagaaatacaaaattagccgggcacagtggctcaagcctgtaatctcatcactttgggaggctgaggcgggtggatcacgaggtcaggagatcgagaacctcctggctaacacagtgaaaccccgtctctactaaaaaaatttaaagaaaattagccaggcctggtggcaggcgcctgtagtcccagctacttgggaggctgaggcagaagaatcccttgaacccgggaggcggaggttgtggtgagctgagattgcgccattgcactccagcctgggcaacaagagcgaaactccatctcaaaaaacaaagcaaaacaaaacaacaacaacaaaaaaacaaacctagatgacaggttgatagatgcagcaaaccaccatggcacgcatatacctatgtaacaaacctgcacattctgcacatgtatcctggaacttaaagtaaaattttaaaaaaagaaaatattgcacccatgaatattagaaagatcattcagaagtgaagaaaagagtccttaaaattaaaaatacaatattaatgagaaactcagtaacctgaaactttccatgatactgcactgagcacatcttctctggctgattttaatccacgtcctctttctgtaatgaactataagcatgagtataatggctttcctgagttgtgtaagtccttctcgtgaattattgaaactgagggtggtcttggagactcctgagcttgcagtttctgtcataagtgagggtagtcttagagacgcctaaataattttacttgggcttgtatctgagtgtcaatagggctgtattccttctggaggttctaaaggaatatcaatttccttgatttttctagcttctagaggccacctgtattctttggccttaaaacaacacaaacttgtcactattctggaggtcatatgtccaaaataggtcctgctgggctgcactccttctggagactctacaggacaatccatttctatgtcttacccagcttcttgagactcaagagatctaacatttgagaaacatgaggacaattcctagtatcatgtggaagggacagcccatgccagtagctgagtatcggatagagagtaactatgagcaggtcgacaactccaagaggagtttctttaaagagctgaaatgaatagcatgtaatctagagccaacggcctgggtcttattttcctggcttcatcattcaggagctgtatgatcttgggcaaattccttctctgtgtaacagttttcctcctctgtaaaatgagaataatgattatagatagctgtctttgtttactgttactataaaagaacacctgagcctgggtaatttataaagaaaagacatttatttggcccatggttctgcaggctgtacaagaagcatggcatcagcatctgcatctggggagggccttcaagctgcttccattcatggcagaaggggaagagaagccggtgtgtgcagagatcatatggcaaaagaggaagaaagagagagcgaatgggaggtagcaagctcttctcaacaaccaactctcacggaactcataagattgagaactcaccacctccccagagagggcattaatctattcatgagggatctgtccccatgacccaaacacttcccattatgccctaccacctcctacactgggatcaaacttctcttttatttttaaaatttctttttatttatttatttttgtaagaaacagggtctcgccatattacctaggctgatctcaaattcctggcctcaagtgatcctcctaccttggcttcctgaatagctgggattacacacaagccaccgcgcctgggttgggggatcaaatttcagcatgagatttggagaggataaatatccaaaccatagcaataactcgtaggggttgtgactgaattagttaatagagaatgcttatagtgcctggtatatagtaagcactatattaatgtttatattatattactgttattatttagtatattttaatatattgagaaggtatttatatacctgggaagactagcgatgaattactgatatgtataatatatattgtacatgtatgtatggaaaacaaaacaaatgattaagccagacacttataatttcaggtaaaacaaaaagcactgcataaaaagtaaatggctcacttgtgaatattgttaaaataatcatcataataaaatgcagcctattgatttaccccaaattatgatatacccatattaggctgggcgcagtggctcacgcctataattccagcactttgggaggctaaggtgggcagatcgcttgagcccaggagttcaaagatcagcctgggcaacatggtgaaaccccatctctactaaataaataaataaataaacaaaatacccatattagatggagggtacatgagaaatgtgtacgtgagtgtcaagggcctgagtgtctgaaagagagctaattccttctttccattgtgttgtctgtagataactgcttaaaactgaaagcctagaaataccaatacaaacatgttatttagacatatgaaagtaaacagcaaaagataactaaactgagttcaaagtgattacctttgagaagctgaaatttgaagaggaatagagcagatgacaactgttttattctaagaaaccacaaagaacaatttgactaagtaaatataggtaaaactttcatgacattcaaaatgaaatacttatttttaaaagttcaaatgcaaaggacaaagaggcagttataactgaccaaaacgtataagactatgcttaatatatgaagtcctctgttcaaactcaataaactggattccactcctggaaagatacagtagatgcacttgtctctattcatcctgttaagttcatctacaaaccatagacattatccatcaaaccaacatacagactctgaaaggtaaagaaaaataggcaccctggctaggggcctcaggaaccagggaagtaaacagtaataagctctctgtgtctttcggcctcatatagatagctctgaccaggtgttcgaaaaacctacaatccagaaacatcaacaagtgcatacaaaaaggcctggaaaaaagtgttttctctagctaaaagaccaggaaaggggcaacagagaaaaataaaaaacttttagacaaaacctactccaaccaaataccacagattataaaacaacaaaaaactgtgggcttgattcatctctcatcagcaaagactcagtgggtagcctagactcctgtatttgcctggctgcctggggatgcccctccactgcaatagggtagtatgagaaaagccaactggggagctgggactttcatctctgcacagtggtaatgggtagctttcttgccatgccagtgggagccacctcagggctggacttccattcctacctagcagtaatgcgacactcttcccatcacgacaggtgtggtgtgagaggatgtcaaatgaaaacccaagaccttcatcactctgagaggtaatgaggccctatccaacctaacaatatcagagaagacagcatgaagagcagaaacaaggtaccctctcctttcagacaaggtgatgtcaccagaggtctactggggagcctgaactgccaaccccaactagcagtaatgaggtgtctctctccccacagactgtcaacagagttcaagtagggaacctgcaaattcacatccacctggcagtagtacagcaaggccccccaattcccacactggcccagaggacgcctgctaaaaaagaggactcaaataagatctagagtctcataatgcccaaggtttccacaatacattacaaaatcatttgtaaaaccaagaaccaggaaaatctcaacttgaataaggaaacaaccaatcaaccgatactaaaactgaagtgatgtatgttatcagaattatttcataaggattttaaagtagtcctcataaaaatgttttaacaagcatatgaacacacttgaaacaaaaaaacttcaacaaagaaatagagaagagatgaaaaaaccaaatgaaaattttagaattaaaaaataaccaatattaaaaactcaatagatgggctcaaaagaatggaggcaacagaagaaatattctgagtacctgaaaataaagtagaaatgatctaatctaaagaatggagagaaaacagactgagaaaaaaaggaacagaacctcagagacatgtgggacaataacaaaaaatctaacatttgtgtcattggagttccagaaagagaaaaagaagagaaagggatgggggctgaacaagtatttgaagaaataatgaatgaaaatttctgaaacttcccgaaagatatacacttacagatagaagctgggcaaatctcaaaaaggataaaaccaaagaaattcacactaaggaagaattatagtgaaacttgtgaaaaatacagacaaagaaagaatgctgaaagcattcagagagaaactacacattacccacaggagaaaaacaatttgaatgacaatgtgagatactaagaaccatggctccccaaagatgttcacatcctaattcccagaaattgtgaatatgttaggttgcatggcaaaagggaattcaggtttcagatcaaatctaggtggctaaatcggctgtccttaaaataggaagattaattatcttagattatctgggtgggctgaatataatcacaaatttgcttaaaagttaaagcaggagggccaggcgcggtggctcatgcctgtaatcccaatactttgggagggccaatgcgggcggatcgcctgaggttgggagtttgagaccagcctgaccaacatggagaaaccccgtctctactaaaacatacaaaattagcagggcgtggtggcacatgcctgtaataccagctactcggaaaggtgaggcaggagaatcgctggaacccggaaggcggaggttgcagtgagccaagatcgcgccattgcactacagcctgggcaacaagagcaaatctctgcctcaaaaaaaaaaaaaaaaaaaaaaaaaagttaaagcagaggcaataaaagagagtcagagaaagatgcgactacaaaagagtggtcagagagatacaatgttgatggctttgaagttggaggaaagggccacaaactgaaatgtgagcacccactagaagctagaaaagtcagaaaatagaaacagattctttcaggttgcggtgagccgagatcgcgccattgcactccagcctgggcaacaagagcaaatctctgcctcaaaaaaaaaaaaaaaaaaaaaagttaaaggagaggcaataaaagagagtcagagaaagatgagactacaaaagagtggtcagagagatacaatgttgatggctttgaagttggaggaaagggctacaaattgtgaaatgtgggcacccactagaagctagaaaagtcatagaaaatagaaacagattctttcttacagcctgtagaaaggaatactgccctcttgacaccttggttttagttcagtgagacccatgttggccttctaaaatatagaactgtaaaaaaaaaaaagttatttttaagcaactaaatttttgaatttatttcagcagcaatagaaaattaacatgcagttttaactaatatctcatcagaaactttggaggccagaaggaagtagcacatttttcaagtgctaaaaaaaaaaacaaaagaactatcaacttagaattttggatcaggcaaaaatatccttcaggagaatgtggaaatcaagacattctcagtcctccaaaaattcgtatgtttaggctgtaacccctaatgtaactgtatttggagatagggcttttaagaggtaattacggttaaacaaggtaggggtcctaatctgataagacaggtggccttacagagagagattctctctccataggcaggcaggcaggcaggcaggcggtcactagggaatggcctgtgagcacatagtgagaatctggttttcgtctacaagccaagaagagaaccctcatcagaacctgaccatacttgcaccctgatctctcagttccagcctcccagaactgtgagaaaataaatttttgttgtttattccacccagtctatggtactttgttatggcagcctgagctgactaagacaactactaacagctctgcacacataaatttgacaacttagatgaaagggaccagttcctgaaaaacacacaaactaccacaaccctctcaatattaaatagacaatgtgaatagccctgtaacacttaaagaaactgagtttgtaatcttaaaacttccaaaaaagaaatctctaggcccagacagtttctctggagaattctaccaaatatttgaagaattaacataattaacataaattctacacagttttttccagaaaacagaagagaagggcatacttcccagtttattgtgtgaggctatgatttccctgacacaaaaactggacaaagtatagaaaaagaaaacacaaactatacacaatctctggcagaataatcaatacaaaggaacacattccaacttattttatgaggtcagggttatcgtgatacctaaaccagaaatagtaccaaaagaaaaaacagaaagagagacagaaagaaaaaaaaaagcgatatccttcataaatatgatacaaaaacccttaacaaaatattagcaaatacaaataatttaaaaagtatataccacaaccaagtggagtttattccatggatgcaacgctggttcaatattaaaaaatcaatcaatgtaatctaccataccaacagactcaagaagtaaaatcacatgatcatgtcaattggtacagaaatagcatttaacaaaattcaactcccattcacgataaaacctcaaggttgtttcagaaggtggtccttggacaaggagcattgatgttctgtggaaatttgtgagaaataaaaattctcatatcccatcccatagctactaaatcagaatctgaattcaaatgcaagtaaagtgtcagaagcactgttctataagacagcaacagaaaaactgttagtgcacgttctttctttctttcttttttttttttttttttgagacagagtttcgctcttgttgcccaggctggagtgcaaaggcgcaatctcggcttactgcaacctctgcctcctgggttaaagcaattctcctgcctcagcctcctgggtagctgggattacaggcgcccgccaccacacctggctaatttttgtatttttagtgcagacggggtttcaccttgttggccaggttggtctggaactcctgatctcatgtgatccacctgcctcgacctcccaaagtgctgggactacaggtgtgagccaccgcgcctggcctgttagtgcactttcagtagggttgttgttgaagactgctctgtcattaaccatctgaagatctatcaaaaaattcctcaaacatcaagaaccatgacatctttactacagatgaaataaattacttgttaattttattaatataaaccatgtatccaatttccattattgctatgtctttcaggaagatcagagacaatttaacagttcaaagttcatgactgtgtaagaccatatattctaaacttgacttggggctgacagtctcttcttcattttatctgatcttagtttttatttatttagtcttgtcatcttactatagggattgttagatgtctcctaaaatccactaaaagtaaaagaaagcaacaaataaacagatgaacaaataagaactcaccagggacttggtcatttttggctcttcggacaaaggggcagaaatctgagaaaacagatgggtagaggtacccatgagagaaggaactgtgccaatgtcacacatggacacatacatcatttagtgcccttgcaccttactcaaaaatttatttctggaactaccacattaaaatatcatcccatcccatattgtacaaagatttaagtgcaaaagttttaccataacatggttaataaaaaagaaagattagaaatgtttagatattcaataattgtggattgcttaaatactttataaaatatccaaaggatatactgttctattacgttattatactatctgatttcacaggcccttcaagttatcatcaaccctggtacctaactcctcactaccactcttcaatctgctctaagtgtcaattggtgcccagagactactcccagaagccattactgaaacctcagattcactgatttccatgccttgctgcccctgagccaggcctgcatcactcatcctacaatacctgatcacagagtcttcaattcctctaccctaatggtcctggctctctaccaatcaatcccacatccccatgactggcctctatgcctgtatgactaccgatcatgcatctccatcagccatcccaagagtcccaatcctaggcacacctgtttctgcactggggccttagcacacatacacatctcccaccactgacacaactaggctataagctcctccacatacacaaacaggaactcaatcaatgaacaaatcaggggaaattcttgcatgtatagaataaatttataaatagaaaacacttctaaatctaattgtgaaaaaccagactatttacagaggaaaaatgaaggaaataagaaaactcttcatctgcagtactgaaagctaaatgatgtcggaaatagcatctaaaagaccacttctctgtcagggccagagagacattttcagaaataaaagcacttgcagagtatctctatctttgagagaaacactggaagaagtccaaataaatgtaaaatgaaccacacaataaatcttgaataggaaaatattgtttagcaataattcttgcaaaagatatataattataaaaaaggacaatgtgacaatgtgataaagaggccactaaagagaaaattaataataccctatgataaaacattcctaataatctcaggaaaaaaacagaaaaaatggggtgcagaatggaaacaatgagcagaaatttcatcaatccaatgaaaatattatgtaaagaaaaggcagaaaataaaaagagctaaatagtaaacatcaaatggaaggcataaaatcagataaatcattatcacactaaactgagatgtaaaattctatcaacagagactataaattggatttgaaaaaagcaaaagtatctattgtaaacaaataggtaatctgacacagagacaaataggatacaaaataaagctctgggcaaagacatcatccaaatgcaatgaaagtaaaaacaagggtggcaatgtgagtatcaacgtggaattcgatgttaaaaagtgtttttcttggaattcgatgttaaaaagtgtttttcttttttctttttggttgaaaaaagggatcctataataataccacttaatacatgaaaaaggataaaaaatgcactaaccattaagtgtatgtatgcccatccctcagatgcacaaataaaattagcaaaaaagcacatataactgcaaaatgaactattaaaagtgatttttattgtatctcctccagaatatgaaacaagtagatcaaaattaggaaagataaagatttgaaaaataccaacaagcaagacttaattaaagagaattttggtccatacaacaaaatataatttttcttttatatctgttgaacaaagttcattgagtaacttggcttcaaggaaaatcttgataaattgttaaaagttgagacttgatagtctgcattttctgacaatacaataaaataaaaaacagctaaaacatactttaataatttgggaatgaataaactctcctaaataactaagattcaaagggaaacatcaaaatgaacttatgcatttcataaagatgtacttaaagaaactttacaaccctaaatgtatcccgcataaaacttaagaaaataagggaaagaacaacaaattacatcaaaaagtgggaaaaagagaaagtacctaaaaagaaaaagagaaaaaaattaatattaaaagagtagggagtattttattggacatttcaaaatgtccaatgaaacagataaacctttcagacgcttgattctttttaaatagagaaagaatgaatgatatataaatataataaccgtaatgataaaggagctactagtctggatatgaaagagaacaaaatggaaatggaaacatgcaattctatgtaatatattctttaaatctttagcaaaatatatcattataatgaaacagaaacgaaaatataaacagatcggtacgtataaaagagaggaaactaattaagatgtgcatcattcacactcctcagatccctccttagttcccatagtcatcctcccccacaaccccacagtccgccctcactccgccctcagatccaccaccagacagagacccccagtccgtcctcactccgcctgcagatccaccaccagagacccctcagtgccccctcactcctccctcagatccaccatcagagatcgctccgacttccactattccatccactgaccgaccccatcactgaccggaaggctcaggacagacatcagagattcttcttgctcagtccacagatgctgccatccctctactcacctgcccctcacccacgtcctctcaggacagtggtcatttgcctcgggaggtgactatagtcgcaagaaccagaacaggacccacttcctttttctcaat

SEQ ID NO: 1543 - DNA, 31940 bp, Homo sapiens
tcatctccttgcacatttactattatttgcaggagcttgacaacaccaatatcaagtaaccaaagatggccactatacattgcttaaacactctcaaaagtgtctccccatatgtgtaactacacatcagctatatgatccagatgttcataattctaactagatagaagaaagttggccttggtcaccttctgagtccccacaccataattgtggcatggagcactctacttccccattgtcagatttctgaggcatactgagttgtggcttccagtttaaggctttccccaagtcactgcacttatagggtttctgtttagtatgaattttctggtgtttaataagatttgatctgatggtgaaggcctttccacactcagcacatatatatggtttctctcctgtgtgaattcgatgatgctcatggagttgtgatttcttaatgaaagacttgccacagtcactgcattcatagggtttctctccagtatgaattctcctgtgtctatttaagtgtgacttctggatgaaggatttcccacattcattacaaatatagggtttctctcctgtatgaattctctgatgcataattagtgttgattttcttgcaaaggctttcccacattcactgcactcataatgcctttctccagtatgggattgctgatgtatatggagacctgacttcctagtgaaggctttcccacagtcactacatttataaggtttctctccagtgtgaattttctggtgtgtaaagagatttgatctgtcagtaaaagcctttccacattcagcacacctatagggtttctctcctgtgtgaatctgctgatgtacgtggagctgtgatttcttagtgaaggatttcccacaaatactgcattcatagggtttctctccagtatgaattctctcatgtgtaataaaatgggatttgtggaagaaggccttaccacattcagtgcaaacatatggtttttcccctctatgaattctctggtgcatacttaatgttgacttctgaatgaatgctttcccacattcactgcattcataatgtctctctccagtatgacacttctgatgtatcctgagccgagacttccaggtgaatgattttccacagtcgctgcatttataaggtttctctccagtatgaattttttggtgcttaatgagatttgacctgtcagtaaaggccttaccacacacagtacatatatagggtctttctcctgtatgaattttctggtgtataatgagatttgtcttgtgagtgaagaccttcccacattctgaacatataaagggattctctcctgtgtgaattcgctgatgcacatggagttgtgattttttaataaaggatttcccacagtcactgcattcatagggtttttctccagtatgaattctttcatgtgtgataaaatgtgacttccggataaaggccttcccacattcagtacatacataaggtttttctcctgtatggattttctgatgcatacttagtgttgatttccttgtgaaagcttttccacattcagtacattcaaagtgtttccctccagtatgaatttttttatgtatattaaggtttgaattctgagggaggtttttctcacattcactgtactcataaggtttttctccagaatgaattctctggcatctgaacagatctgacttctggataaaggctcttccatagtcactgcatttatagtaattcccctcataaggagttttctgacggtttgacttgagggaaaaatccttctcatattcagtgcatattcctgcataaaccctctgactgccatcaagctgggacttctgagtgaagactgcctcacattcatggcattcatgctgcttttcttcagcacaaatactctcatgtgcaaaggcatgtgacttcggggagaaaacatttacgtagtcagaaaacaaatagaggctctctctagtatgaattttctgttgttgaatgagagcttgcttatgatgcagaggtttcccacattggttacattcacaagcagtcacttctgtatgagaattcaaatgagtgaaaatatcaccatctccaatagtcttatcagaattttctgttgcattgtttctattatataaggttatgataggctccaaattctttccacacgagttacagttatggggtctttttcttgaggaaaccaggtgtgtgtttacatgaactatttccccaatgtccttatattcaaagatgctgtcattagctagtgttttcttgttaatgaagacaacacgacttaaaggtttgttctggttttctccacattttcttgtgtgttcatcgtctttccacaattcttctaaaatggaatatgggtcatctcttgtgaagagattaatattaatctcagactggaaagaaacttcttcagacatcctctgttgtaaaggtccaaaaccaatgtccccatctaaaaaagaaagaaaagataagactgacaaaaagaacaattaacagaaaataaggccaggtgcggtggctcatgcctgtaatcctagcactttgggaggctgaggtgggcagatcacttgaggccaggagtttgagaccagcctggccagcatagcaaaactctgtctctgctaaaaaacactcaaaatattgtctctactaaaaattagccaggcgtggtggtacatgcctgtaattccagctactcaagtggctgaggcaagagaatggcttgatggcttgaaggcagaggttgcagtgagctgaaattgcgccattgcactctagtctgggtgacagagcaagactctgtctccaaaataaataaataaataaataaataaataaataaataaataaataaaaatacaatagacctttgattcaggccgggtgtggtggctcacgcctgtaagcccagcactttgggaggctgaggcaggcggatcacctgaggtcaggagttgaagaccagcctggccaacatggagaaacctcatctctactaaaaatacaaaattagccggacatggtggtgcatgcctgtaatcctagctactcaggaggctgaggcaggagaatcacttgaacccaggaggcagaggttgcggtgagccgagatcttgccattgcactccagcctgggcaacaagagcgaaactctatctccaaaaaaaaaagagttgattcaaggcagacacagagatatgagagagactatataaatataacaaatgtacataagtattttaaatatacataaatatataggtataataactcatttatatataatatgtaatacaatgatgtagagtaataatattaatactaacatttataacatgataaacaatatcatttagatgtgctgttctaagttctatattaattcacttaaactttatcacggcccggtgtggtggttcatgcctgtaatcccagcactgtgggaggctgagatgagaggattgcttgagcccaggagtttgagaccagcctgggaaacatagtgagacccccatctctacagaaaaatgaaaaaacaattagctgggcctagtggcacatgcctatagtcccagctacttaggaggctgaagcaggaggatcacttgagcccaggtgtttgaagctgcagtgagctctgatcgcaccattacactccagcctgggtgacagagtgagactctgtctctctctctctcttttttttttttcttttttaagacagggtctcactctgttgctcaggctagagtgtaatggcatgatcagagctcactgcaacctccacctcctgagttcaagggattcttgtgcctcagcctcatgagtggctggaactacaggcatatgccaccacaactggctaatttttgtatttttagtagagacggggattcaccatgttggccaggctggtctcaaactcctgacttcaagtatctgtccgcctcggcctcccaaaatgttgggattacaggcgtaagccagcaagcccagccaagaccctgtctcttaaaaacaaaaacaaaaagcactttattgtaaccctttgctgttggtattattattgtttctagtttacagatgaggaaactgagccacagaagagtttagttaaatttgcccaaatcaaatgtttagtaattggggaagaagagattgcaattcagtgcaaatgtagtagaactacatggtgagtgaggtgtcagaagaacaaagtgataaactctgtgaaaagaagtatttctgagtctagattcttttccttaatctgtaaatcctcacaatcttcctgttttctcttctccctatgatccactgtgccctaaataccaatgtatttatgtttacagtaaaattacgatatcttagtcatcctaacttggccaaacagaaaaatttatatacatttgttatatttatatagcctctctcatttatctgtgttttccttgaatcaactctatgtaacaattggtctattttcttttgagatggagcctcactctatcacccaggctggagtggctggagtgcaatggcgcgatctcggctcactgcaacctccgcctcccgggttcaagcaattctcctgccttagccacatgagcaggtgggactacagacatgtgccgccatacatgtatttgtaaaaatacaaatttttgtatttttagtagagatggggtttcaccatgttggccaggctggtctcaaactcctgacctcaagtgatctgcctgcctcagcctcccaaagtgctgggattacaggtgtgagccaccgtgtctggcctatggttcaattcttcatccctggtttggggtactgatgtgataaatgcatctggtagaagacataacaggaaagaactagacatcagaagagaagactgaaagttgttcatcaaacctgtgcccttccttcacaatattaagcttgtagccaagcacatggctgcttcacaacactaggtttgttcagcttcatttgtcactaggtggcactgagtaactctttttcactcatcagtggaagtgataaggccaatgtcttaagaaagtgggtttgtctcctacaaacctcttcttttcccaccagtatattccaacttggcagcacccagttctatgaagctggcaatgccctagggcaggggtcagaaaactgaagcccttgggccaaatccaggcctctatccaaaagctaacaatgtattttacatttttaaatggtcaaaaaattaaaagaagaatactacttcacgacatatgaaaattatatgaaattcaaatttcagtgtccataaagtttttattggaacacagccacacccatacattgatgtattgtctatagctgctttggggctacaactgcagaaataagcagttgtgacagtagccatatggtccacaaagcctatttacttttgtgcctttacaaaaaatttgtcagcccttgccctaggggatggtggtacaatgactttctagaaactttgtccctgaacggccatggaaacagagttgcccggtgttatggccatcgaaaagggactaacacacatctttccattagtcactgcagtctattttatcaatgaacccaaacatacagtcttttcattttctccatttaagcttcctttttctgatcttttgtttctatcaaaaattcattgttcttcattaatcatttggggttctctgctttaaaagctaatttcaaatttcaccacaactctagagaggctctcttttaacttaaaaacaaacaacaaaaaggtactctgaaccactcatatttatatttgaattggcatagatgtgcacgttaacaaaagtgtaatgcacaaagactgaaattttcaagatttcatgcagttatcctctttccaattagtttttctagccctttgaattgctcctaaaagaaaaattttaaaatctttctgaaatagagcaaaacgacctcctctgcttataacacaaattcaggaatttaatttcactattttctacagaaactttgcattttaatgtacaagagtaaaagcctcagttatcatgtaatttaatgtaggtttctctgaatttctggaggttgtatgctgcaataggtcaaattcaaggagtaagtgaaagctgagcacaaaatatgtgtattatttggttttttgtttgtttttgtttttgtttttgttttctgagatagagtctcactttgttgcccaggctggagtgcagtggcacgatctcggctcactgcaagctccgcctcctgggttcacaccattctcctgcctcagcctcccaagtagctgggactacaggcgcctgccactatgcctggctaattgaccttgtgatccacctgcctcagcctaaagtgctgggattacaggcgtgagccaccacgcccagccttttttttttttttttttttttttgagacggagtgtcgttcttgtcacccaggctggagtacagtggcgcggtctcagctcactgcaacctccacctcctgggatcaagtgattctcctgcctcagcctcctgagtagctgggattacaggcccctgccacctcgcctggctaattttcatacttttagtagagatggggtttcgccatgttggccaggctagtctcaaactcctgacctcaggtaatccacccacctcagcctcccaaagtggtgggattacaggcgtgagccactgtgcccagccaaaatatgtgtattatttgaatacgcagatagataacataataatcaaagggctcgatgaaaagggagaattaaagaaaatcttaaaataggatagaaatggttatagaaaacagggacaaatgtgaattgcaaatatgaggccatattctttctctagcttacaaacctactgagaggagaatctgtcacatgttagatattaagtagtaactttagttttcttccatgtagctatgacaggataaacacagcacacaatgttttaagtagtgaaatctatcagcagcatctgagatgaaatagtgaaaaagaaagaatgggattatcacatacaaataggattagaataatctaggcatgagaaaacacagacatggttgtaggtgatatgactgggaggtaagaaagaggcttttgtaaatgagaaaaataagtagaaaagcagaatgaattatctgagaagatggattagagggaaaagtaaaaaaactccaagagaagatgacaacattttgaaaggcaagccacctgcttttacatgctacattgtatcttgtcttccttcacacaaacagccagacccttaaatgcaaacagtattggtctttcccctgagtgctgtatacaatagggccaatgcctgactgagacacacaaataacagtcacagagtaaaagttgttcccatgagccaattatcactcagagcttatgctgcagctgagacacataatctaagacacagattatgctgggctgagacacatggacctgggcaactttaaggagggcccaaagcccttacacctgcctctaaatgtccatgataacttctaatgtaggttagttatgtataggacagaggcaaagtgcatacttgccagcaggcagtataaccagttgggaagaggagaaagacccctgtgggggtggtcattgccttgacatcctgcttattgccccagctgtaaatgacctgcaaggagaaatggaccccaccccaaacttggttcagatgtcaagagtgacgatgagacacacacaataagagggtgtaaaaagatttgttactcacataatgaggctttctggggacagctccaagcaggtccagatggggctagagtgagcaaggaaaggactgtcttgggagtttatggcaggggcgggtggggctgggctaactattcccttatgtagttggaatttcccagcaacaatggagggaactcatgggcttttttctcagtttgtccaggaaaaaaagagagagagatgaggcttagaaaacatcagcagttgaacatcaaaaatgaaggatacagaatgagatgttcaaagtattttattagggaaatacaaattaaataataattagaaattaaaacccatcagattagccaaaatattaaaaatttggataatactaggtatgggtagggatgtggggaactaatacccttgtacaaagttccagggaccgtagagtgacacagccaatctggaaaataatgtgcttatacctcatcatattcaatattagtatgcccaatgataaagcaatcccactcctcttccttaagaaattctcatttccggctgggcgtggtggctcccgcctataatctcagcactttgggagtccaaggcgggtggatcacgaggtcaggagatcgagaccatcctggctaacatggtgaaaccccgtctctactaaacatacaaaaaattagctgggtgcagtggcgggcgcctgtagtcccagctaccggggaggctgaggcaggagaatggcgtgaacctgggaggtggagcttgcagtgagctgagatcatgccactgcactccagcctgggggacagagcgaaactccatctcagaaaaaaataaataaataaattatcatttccagtaagaataattcatgaagaaatgtattgcagtactgtttgtagtagctgaaaaactggacaagtaaaatggggtatatatgtgcactacagaatgatatgtagaaattagaataatgcactgcaacatggaccaatttgagaaaaaaaaacttgagtaggatatataatacagtaccatttctacaaattaacaatgccaacaactcagattttataaatatcccagaaattcaaggataaatggcataacatgtcaaatatattagaacagttgcctcttggaaggataaaaatgagtatggagactgaggattaaaaagaataaataagaggggagccttaaacacattgatgatgatattgactaaaaactaaggctataattattaactcaatcttctgtacaggatatacctgtacactagataaaaaactttgtgtaagatatgaaaataaataaattagaaagatcaagtcagtgttgcgttgcactagccaagtaggaagaaaatgtcaatggtactctcaaagtcaacaatcagagaagaggcatggggggacttcagacaagcccatctctagatgacaattgtgaggcactaaggggaaagagacaaaatgagaagaaacagcaggagctgaagttgtaatgcatagtaatgttttcagaaggtagatctatgagtatttgaatgcataaggaaatgatctaagaccttgatggaggtagaaagaataaaacttttctagggaaagagagaaaaaagcaagaaaacaggaccctagaaagtagagtgtgacatgatccaaagaaccagtaattgtagcatattccctcctaaaaagccaagcaaagaagaaggcattgatatgagaagggatcttaagtggggttagcatttagctatccaagggtccttgtctaataactgctcttccaagcagttctaaaagtcattattaatgacacatcaaagttgggcaaagttgggcacagcttctcccagtacaaatgcagctgagtcatactgtctaccatgctcttggttcccttctcacctggacggctctgactggggatctcaccatccaacatacatggctcttcttgttccaagctgaagatgacttctggtttgggaacttgacatcctgttaacaggggatgatagaggacttgatttcagaggccatacaatgaagcattccatttttttcccaaaaaagttcactgggaacagaggaatattcacactacccgaaagagattattaagaacatgggacaaaataaggacaaaaccattacacactttagatgtcctgcagtctttagaagtcccacatacctcagaaaacacagacttcagcaattctactgagaagaaaaatatactcaattaggtgcagcctactctatacccagcagagccgtgcttacccactgagatcaagttgaaatagttttccagcatcacttctctgtacaggcttttctgagcaaggtctaattgttgccactcatccctactgaagtctacagttacgtccttgaatgacactgattcctgttaaaaaaaaaaaacaaactttaaaataattttttaaagaatatatttgaattcaaaaaaaaaaacctttcaatgtgaaggatcgagattacagaatggaaacaagataggaccttatttttaatgtgatacaatatactataaagaacttctacaattcaacgacaacgaacaaaataattttaaaaatgggtaaaaagcttaaatagacatttctgcaaggaagatatacaaatatttaacaagcacatgtaaagatgctcaacgtcattaatcactagggaaatgcaaattaaaactacaagatattacctcacacccatctggatgataaagaaaatgtctaaaattgattataatgatggctgtacaactgagtgaatacactaaaaatcaatacatggtacactttttttttgagacagagtctcgctcagtcgcccaggctggagtgcagtggctcgatctccactcaccgcaagctctgcctcctgggttcacgccattctcctgcctcagcctcctgagtagctgggactacaggcgcccgccaccacgcccagctaatttttaaaaatttttttagtagagacggggtttcaccgtgttagccaggatggtctcgatctcctgacctcgtgatccgcccgcctcagcctcccaaagtgctgggattacaggcatgagccacgacacccagcctaatatggtacactttaaatggtaaactgtgtggtgtatgaaggagagggctctttttcagcactgccatttccagatgagatgcagtagcttggcagtccagtgcttccttcaacaatgaactgtaaatgccagacgcaatacttgaaatcatctgtttcaaagcactggaaagctgctgaggtagcaagaaatataggggctaagactggagaggagagaatattaaagattgaagctgacttattcagtcactctgacagtgggagcatttaccaattctggctgtggacaaaagctgagaatccagcttttgtcctggattctcattttgtcctgtctactggagaatgcagtagaaggctgcagctgggtgacagagaaaccaacataactcaaacacatggccattttcccctcaggatatttgctgaattctagggtatatagggcagtagactaaaaatgtaagcaaacagcctttgaagaacagagcaaaagtctagtatctgttaagaaaatagttgggcatctatcaggaagagggtctttagaggacaaaagggctctcagctgaaaattctcaggagccagggtgatccagaggtaaagtgagtcttagcagagcttcaacccggccttatttcaacatcaacagtgcctgactggatgtacgtgttctcccttccctccatttgctaacataaggaaagatgaatcctctgtggagaaagattttttttttcttttcttctgagacagggtcttgctctgtcatccaggctggagtgcagtggcacaaacacgactcactgcagcctcgacctgggctcaagcaatcctcctgtctcagccccacaagtagctgggactacaggcacatgctaccatgcccagctaatttgtctatcttttgtagagatgggttttgccatgttgcccaggctggtctgggactcctgagctcaagtgatctgtccccctcagcctcccaggtatgagccctgcctacaacttattatacacagtgtttaaaacaaacaaaaaaatcctacacatccaaaaagataggaccacatatccaaaatcagagaaggaaaaaattcaatagaaacagtcacacagagaattggagttagatgaaaagaggactatctttagagagttggttcttataataaagaatcaaatgaaagttcaaaaattgaaaaatctaaaatctaaaattaagaagtccttatgcaggtttaacagcaaaatacagaatttctgaaatggaagacaagtaaatagaaaatatccaaactgaagcagagattttttttttaaagaaaaaaacataggagcattaggaatatgtgtgacatagtaaaaaaggtataacctatcagagtctgagaagttaaagaggagagtgcagggaaaaagcaatatttgaagaagtaatggctatgaatgtcatcaacccttaggattcaagaagctcttcaaatacctctttacaaaactgcaagtattgactatgcaaaacagtaacagtactattctgggaggtttaaaatgtatgcaaaatttaaaataatggaaataataatgcaaaaatgggaggcagtaaatagaattaaagtgttttataaagtatcctagcattattaaggagataaaatagtaagttcaagatgaatgttttaatatctggggtaacaaacagtaaaagaattataacaagtaaacaaaggaaaaaattaaagagtaaaaaaattatgtaatataaaaagtcaagaaaggaatgaaaaaataggtagttcaaataaaaactaggccgggcgtggtggctcacacctgtaatcccagcactttgggaggctgaggcaggcggatcatgaggtcaggagatcgagaccatcctggctaacacggtgaaacccggtctctactaaaaatataaaaaaattagctgggtgtggtggtgggcacctgtagtcccagctactcaggaggctgaggcaggagaatggtgtgaacccaggaggtggaggttgcagtgagccaagactgcaccactgcacaccagcctgggcaacagagcaagactccatctcaaaaataaaataaaataaaataaaaactaatagtaaggtggtatatataaattcaagtatatcagtaattacattaagtgtaaatgcattaaacatccaagttaaaagcaaggattgagacttctggttctaaaaaacaaaacaaaaaaaagagtgcattccacccaattcctcctgctaattacctaaaaatctagaaaaatacataaagcatctgtcagaagactcactggtggagaaaagaaagtagaacctaaggacttaaaaaacaacacagtagtgagttagttccctagagggaacttagagggagagagggagctcctacatattgcaaaatgagtactagaggagcttgcaacctggaagaaccaatgagcacagacaaaaaaggcctccccaaagcatacattttccagccaaataatttgaaatagggcagcaatgcaggatgggaccttttgactacacatacctacaaagttcagaagtacccaagaacaccctcacttctgacacctactgcaagcagagggatttcccaggatcacctgtacttctgacaccaattccaagtcaggggtccccaggaccaccctcaggttccacaattcacagaagaactcacagaaattagaaaagccataatactcatggctatggtgttatatagtggctttacaatgaaaggatacagatcaaaatcagccaagggaagatgtgcttagtgcagtgtcaatgagagttccaggtgtgagcttccagtggttttctcccagtggagtcatatggacagcacttacttctcccagcaatgatgtgtgatgataatacgcatggagtattgccaactggggaagttcacttgagccttgatgtccagagtttttactgagacttgatcatgtggacatgaatgactcccactgtggctgatcttagtctccagcccctccagagctgatattgcatggccaaaggtaccccactataaaccacatgttggcatagaatattcagtgtggcccaaagctcccaccataaatcacactgtcattatatactatcttgcatggcctaagcaaggcctgcaggacattccaaagatttagaggttacctcccaggagctgagtgcaaaggccaaacctctctttgggcaaagttaatcctttactgcacaacaatatacttgaggccaggcgcggtggctcacgcctgtaatcccagcactttgggaggccgaggcaggtggatcacgaggtcaggagatcgagaccatcctggctaacatggtgaaaccccatctctactaaaaaaatacaaaaaattagccgggcatggtggcgggcgcctgtagtcccagctacttgagaggctgaggcaggagaatggcgtgaacccgggaggcggagcttgcagtgagctgagatcacaccagtgcactccagcctgggcgacagagcgagactccatctcaaaaaaaaaaaaaaaacaacaaaacaaaacaaacaaaaaaaaaccagtatacttgaggtgaaaactacaaaagatgcatcctttgccttcttcacaaacaatgtgactccaaagatggtggggtggagctctctcaatcatcccaactgcattagctcaaagagaggtagcacccctcttgcctctccagcaggcattatatagactgtattggctaaccctaccccaaattaagtgaatgacagcaaagaagaagtagctaccttcttccaatagagagtggaggatggattatggagaaagttataaaaaggggttctttaaatacatgtatgatgacctgggcacacctacgagcagcccagatataaaatgaatcagaatcaacatagaaaaagctttcagggctgaactagggtgtgggatactgtccaggtttcaaattagcttctgggtagcacaaaaatgagggagaccaaaatagaactgcaaagactttcaaaactaagttgaatttgaaatacagcccataaaaatagaccaagacatgcactctaaacctaaatgtgttgacaactgctaaaatagaggatttgaagagaaaacagaatctcataacatgatattcagaatgtcctgaataaagccaaaattattcatcatcttaagaaccaagaaaatctgaaatcaaatgagaaaagagcatcaacagatagcaacactcagatgaatcagatgttggaattatttgacaaggatttaaagtagctaactaaaagtgttgcaacaagcagctgtaaatagtgttgaatcaagtggaaatatataaattctcagcaaagaaatagaaggtatgaggaggaacaaaatgaaaattttagaaccaaaaaatacagtaagtgaaattaaaaacctcactggatgatctcaacagcagaatggagatccaaaggaaagaatcagttacctcagttacctgtaagatagataaacagaaattatccagtctgaacaatagaaaaaataattgatgaaatgattgtttcatcaattccctcaggctgtattcagcctaagggacccagcgggacaataacagaacagccaacaatcatttcagcagtcctagaaggaatgaaaaagtaggacgggagactggaaaaagatatgaagaaataatagctgaaaacctcccaaatctggtaaaaggcataaatgtacagattcaagtcgctgaccaaatctccaaaaggaaaacctcaaataaatccatgtctagatacattgtaagatttataaaatccaaatttaagaatagaacctgaaaacagtcagagagaaatgacacattacatgtagggaaagggcaatttgaacaagaatgactttctcattaaaaaccacagatgtcaaaaggaagtgggaccatatttttcaagtgctgaagagaaagagctgtcaatattgaattcaatatccagtgaaaataaaataggctctgtttaaattctcttaaacttaattctgaggaattacctgccattggtagttgagaaagaagtctgaaaaaaaaaataaaaaaagaattaactgccatacatttattaagcataattacttaggtaattcttaggaattacctgccatatatttactaagcaagatgttgagaactttatgttgtgaacatcttcacaactttacacaatatgcttcaagacatcaaagaacttacaacaactttctaagatattataaagggcataagagatgtgcaaagcatagcatgaccccaaatagagagaagaaaattctacatggagtgtaagactaagttctgtagagttgatgaaacttaagcttagtcttgggagatgccatgtttaatgcaagcagagtagggcaaagtgatttttagaagggagcagcatgagcaaaggtataaagacaggaaaatacatgataaattcagggaaccacaaattagtctgcataatgagaagtctgtatgcagtgaaggaaaggtgtttatgaggaaatttcagtagaggtatgctggcatgagatcatgcaactatttttcctccaatacataatggactgccattaaagtaatttatatatagagaaaagattattagatttatgtttacaactgccaagaagatgctggccaggttgtggagaaataggaacgcttttacactgttagtgggaatgtaaatttgttcaaccattgtggaagacagtgtggtgattcctcaaagatttagaagtggaaataccatttgacccagcaatcccattactggttatatacccaaaggaatataaatcattctgttataaagatacacgcatgcatatgttcattgtggcactattcacaatagcaaagacatggaatcaacccaaatgcccatcagtgatagactggctaaagaaaatgtggcacatatacatcatggaatactatgcagccataaaaaggaatgagatcatatcctttgcagggacatgcagggagctggaagccattatcctcagcaaactaatgcaggaacagaaaaccaaacgctacatgttcttacttataagtgggagctgaacaatgtgaacacatggacacagggaagggaacaacactcactggggcctgttggggaagggtggggggtgggagagcattagggaaaaaagctaatgcatgctgggcttaatacctaggtgatggcttgataggtgcagcaaaccatcatgacacacatttacctatgcaacaaacctgcacatcctgcacatgtaccctagaacttaaaataaaaaataaaaaaagactatcaagaaacagcagggagaatacatttgaatgagcaagagtggaagtctaggcaatatttcatgtgaaagaattaaaacaccttagttagggagaaaatattatttaacaggaatatagaaaaagaaattggtgtagatagtaggtaattagaattgatagatggagtaagaaaaaggaggaactaaagtgaaattctcaattattcgttttgtatactctgagattatagtgtcatatactgaagtagagattgatgaatggaaaaggttggagaaagggaaccagatgaaatcacttatgttttgcacatattgagattacagggattaaacatgtaggcaggcatattataggacgttaggcagaggcctagagtggagataaagatttgggagtcaccagtagataattaataactaaaatcatctgagtaaatgagactgcttgagaggacacctgataaaggagaatgtaaaggaaagaatctgaaaaagttaccagcattgaagaagaggtgtcagcaataaaaactgagaaatcggacagagccaggagagagtaacgtcttagaatgtatgtggggattagttgatggggttgaatgccaagatggatgaaaaaagcaaaagacagataaattctggcttttgtatttaggagatgtgacagtgatagctagttgtcttccaacattcactcatcctttcttccctaataacagaacatgaattcttagctggctactctgagtaagactttcttttcccagcccaccttaaatgtaaccaggaaactatactttggccacagagatacaggcgatacttctgagatgtcagtttttaaaggagaaggtgtgagtgcccctttcctccccaacctcaccatgctgctggcctggaacgctgactcagttaatgcaaccccagcaaatctcgggaactatcaagtgacgtgaggttgaaaatcacaaaatgagaatgacatagagaacaacaacaaaaaaaaaaggtgtataaatttgtgaagacatcaggccctgaatgaatactttcagacttcttttgcttcttttgtgtttaagcccgtaattcttagatttctgttatactaaaatgcattttgccagacaattctaataaaatagatagaaactgggttgcaattacagactcttaagcttttaagcaaaaaattcagtaccacgtaatagcaaaaagatcagtacttcaggaaaatataattcatattttgaatgacaatctaaaatacataaaacaaaagttgacaaaattacatggagaaattgataaacctacacacgcatgggagacttcccaactccccctccctactctgagagattttaaccagattacattcattaatcactagatatagcaacaaaaatttggcacatataggaaaatttctgcaagaaaattgacaagccagttacaaaggagatgagatctcacacataaaacaaatatgcaatagtcaaaaaataaggattatacagaagatctgaacaacacaaataagctgtttgtgatgtagacagaaatcacacacacacacacagagagagagagaaagagagagagagagaacgagagagaaagagtatattcatcattatattaggggaccatacatgaatgacagtgtgatagtacacaaaatgtaaaaagaacataaatgtaacaacaggctgggtgcagtggcacatgcctgtaatcccagtactttgggaggccaaggcaggaggattgcttgagtccacgagtttgagaccagcctgggcaacatagtgagaacttgtctctataaaaaatcaaaacaaaaacaacaacaacaaaaagcaatacaaactacagacaactcagtttaaaaaaaagggggaggaatgaatcaagcaattctcaaaagaagtgtacatgacaatgaaattctgaaaaactgttcaatcacattagtaaccagggaaatgctaattaaatccaaaatgagatacctctgcaaactcccaagatggctaaaattgtaaagattgaaaacaccaagtactggtaaagatacaaagtagtaaacatatctgcacactactggtaggaatacaaattggcgtaacaaactttgcaaagctgtatgacatcatatactaaagttggagaggggccaggtgcagtggctcaggcctgtaatcctagcactttaggaggccgaggcaggaggattgcttgagagcaggagttcaagactagcctgcgcaacatagcaagacgccgtctctacaaaaagaaaaaaaaaattagccaggcatggtggcatgcgtctatagtcccagctacttgggaggcaggggaagcaggatcacttgagccctgaaagttgaggctgtagtgagctgggatcacagcattgcactccactcagcttgggtgacagagcaagaccttgcctttggatagaaataacttctgaaagaaatgttcacaagagcatatttcgtaatgcattttatatttctccatagtaaaggcttaaaaataaatgaaaataaaatcataatggtacagaaatgcatatggtataccatcttctgtggaaagaacataatacttttcctatttgtttttgtctatataatgacactttgaacacacactaaaaaaaattagttatccagattgaggacatgggctgataggaaaagaaagagggagatttttcactatgtacttattttcttacttttaaatcatatgcatgtattacctattcaaaatactcatctgacaaaggtctaatatccagattctacagggaacttaaaaacacatttacaagaaaaaaacaaccccatcaaaaagtgggtgaaggatatgaacagacacttctcaaaagaagacatttatgtggccaacaatcatacgaaaaaaagctcaacatcactgatcattagagaaatacaaatcaaaaccacaatgagataccatctcatgccagtcagaatggctattattaaaaagtcaagaaacaatagatgctggcgaggctgtggagaaataggaacacctttacactgttggtgggaatgtaaattagttcaaccattgtggaagacagtgtggcaattcctcaaggatctagaaccagaaataccagttgacccagccatcccattactgggtatatacccaaaggaatataaatcattctactataaagacacatgcacacgtatgtttactgcagcactatttacaatagcaaagacacagaaccaacccaaatgcccagcaatgatagactagataaagaaaatgtggtacatgtacaacatggaatagtatgcagccataaaaaggaatcagatcacatcctttgcagggacatggatgaagctggaaaccatcattctcagcaaactaacacaggaacagaaatccgaacactgcatgttctcactcataagtgggagttgaacaatgagaacacacagacacagggcagggaacaagccacaccagggcctatcaaggggtggggggataaggggagagagagcattaggacaaatagcaaatgcatgcaggcttaaaacctagatgatgggggccgggcatggtggctcacacctgtaatcccagcactttgggaggccaaggtgggtggatcacctgaggtcgggagttcgagaccagcctgactggagaaaccctgtctctactagaaatacaaaattagccgggcacagtggctcaagcctgtaatctcatcactttgggaggctgaggcgggtggatcacgaggtcaggagatcgagaacctcctggctaacacagtgaaaccccgtctctactaaaaaaatttaaagaaaattagccaggcctggtggcaggcgcctgtagtcccagctacttgggaggctgaggcagaagaatcccttgaacccgggaggcggaggttgtggtgagctgagattgcgccattgcactccagcctgggcaacaagagcgaaactccatctcaaaaaacaaagcaaaacaaaacaacaacaacaaaaaaacaaacctagatgacaggttgatagatgcagcaaaccaccatggcacgcatatacctatgtaacaaacctgcacattctgcacatgtatcctggaacttaaagtaaaattttaaaaaaagaaaatattgcacccatgaatattagaaagatcattcagaagtgaagaaaagagtccttaaaattaaaaatacaatattaatgagaaactcagtaacctgaaactttccatgatactgcactgagcacatcttctctggctgattttaatccacgtcctctttctgtaatgaactataagcatgagtataatggctttcctgagttgtgtaagtccttctcgtgaattattgaaactgagggtggtcttggagactcctgagcttgcagtttctgtcataagtgagggtagtcttagagacgcctaaataattttacttgggcttgtatctgagtgtcaatagggctgtattccttctggaggttctaaaggaatatcaatttccttgatttttctagcttctagaggccacctgtattctttggccttaaaacaacacaaacttgtcactattctggaggtcatatgtccaaaataggtcctgctgggctgcactccttctggagactctacaggacaatccatttctatgtcttacccagcttcttgagactcaagagatctaacatttgagaaacatgaggacaattcctagtatcatgtggaagggacagcccatgccagtagctgagtatcggatagagagtaactatgagcaggtcgacaactccaagaggagtttctttaaagagctgaaatgaatagcatgtaatctagagccaacggcctgggtcttattttcctggcttcatcattcaggagctgtatgatcttgggcaaattccttctctgtgtaacagttttcctcctctgtaaaatgagaataatgattatagatagctgtctttgtttactgttactataaaagaacacctgagcctgggtaatttataaagaaaagacatttatttggcccatggttctgcaggctgtacaagaagcatggcatcagcatctgcatctggggagggccttcaagctgcttccattcatggcagaaggggaagagaagccggtgtgtgcagagatcatatggcaaaagaggaagaaagagagagcgaatgggaggtagcaagctcttctcaacaaccaactctcacggaactcataagattgagaactcaccacctccccagagagggcattaatctattcatgagggatctgtccccatgacccaaacacttcccattatgccctaccacctcctacactgggatcaaacttctcttttatttttaaaatttctttttatttatttatttttgtaagaaacagggtctcgccatattacctaggctgatctcaaattcctggcctcaagtgatcctcctaccttggcttcctgaatagctgggattacacacaagccaccgcgcctgggttgggggatcaaatttcagcatgagatttggagaggataaatatccaaaccatagcaataactcgtaggggttgtgactgaattagttaatagagaatgcttatagtgcctggtatatagtaagcactatattaatgtttatattatattactgttattatttagtatattttaatatattgagaaggtatttatatacctgggaagactagcgatgaattactgatatgtataatatatattgtacatgtatgtatggaaaacaaaacaaatgattaagccagacacttataatttcaggtaaaacaaaaagcactgcataaaaagtaaatggctcacttgtgaatattgttaaaataatcatcataataaaatgcagcctattgatttaccccaaattatgatatacccatattaggctgggcgcagtggctcacgcctataattccagcactttgggaggctaaggtgggcagatcgcttgagcccaggagttcaaagatcagcctgggcaacatggtgaaaccccatctctactaaataaataaataaataaacaaaatacccatattagatggagggtacatgagaaatgtgtacgtgagtgtcaagggcctgagtgtctgaaagagagctaattccttctttccattgtgttgtctgtagataactgcttaaaactgaaagcctagaaataccaatacaaacatgttatttagacatatgaaagtaaacagcaaaagataactaaactgagttcaaagtgattacctttgagaagctgaaatttgaagaggaatagagcagatgacaactgttttattctaagaaaccacaaagaacaatttgactaagtaaatataggtaaaactttcatgacattcaaaatgaaatacttatttttaaaagttcaaatgcaaaggacaaagaggcagttataactgaccaaaacgtataagactatgcttaatatatgaagtcctctgttcaaactcaataaactggattccactcctggaaagatacagtagatgcacttgtctctattcatcctgttaagttcatctacaaaccatagacattatccatcaaaccaacatacagactctgaaaggtaaagaaaaataggcaccctggctaggggcctcaggaaccagggaagtaaacagtaataagctctctgtgtctttcggcctcatatagatagctctgaccaggtgttcgaaaaacctacaatccagaaacatcaacaagtgcatacaaaaaggcctggaaaaaagtgttttctctagctaaaagaccaggaaaggggcaacagagaaaaataaaaaacttttagacaaaacctactccaaccaaataccacagattataaaacaacaaaaaactgtgggcttgattcatctctcatcagcaaagactcagtgggtagcctagactcctgtatttgcctggctgcctggggatgcccctccactgcaatagggtagtatgagaaaagccaactggggagctgggactttcatctctgcacagtggtaatgggtagctttcttgccatgccagtgggagccacctcagggctggacttccattcctacctagcagtaatgcgacactcttcccatcacgacaggtgtggtgtgagaggatgtcaaatgaaaacccaagaccttcatcactctgagaggtaatgaggccctatccaacctaacaatatcagagaagacagcatgaagagcagaaacaaggtaccctctcctttcagacaaggtgatgtcaccagaggtctactggggagcctgaactgccaaccccaactagcagtaatgaggtgtctctctccccacagactgtcaacagagttcaagtagggaacctgcaaattcacatccacctggcagtagtacagcaaggccccccaattcccacactggcccagaggacgcctgctaaaaaagaggactcaaataagatctagagtctcataatgcccaaggtttccacaatacattacaaaatcatttgtaaaaccaagaaccaggaaaatctcaacttgaataaggaaacaaccaatcaaccgatactaaaactgaagtgatgtatgttatcagaattatttcataaggattttaaagtagtcctcataaaaatgttttaacaagcatatgaacacacttgaaacaaaaaaacttcaacaaagaaatagagaagagatgaaaaaaccaaatgaaaattttagaattaaaaaataaccaatattaaaaactcaatagatgggctcaaaagaatggaggcaacagaagaaatattctgagtacctgaaaataaagtagaaatgatctaatctaaagaatggagagaaaacagactgagaaaaaaaggaacagaacctcagagacatgtgggacaataacaaaaaatctaacatttgtgtcattggagttccagaaagagaaaaagaagagaaagggatgggggctgaacaagtatttgaagaaataatgaatgaaaatttctgaaacttcccgaaagatatacacttacagatagaagctgggcaaatctcaaaaaggataaaaccaaagaaattcacactaaggaagaattatagtgaaacttgtgaaaaatacagacaaagaaagaatgctgaaagcattcagagagaaactacacattacccacaggagaaaaacaatttgaatgacaatgtgagatactaagaaccatggctccccaaagatgttcacatcctaattcccagaaattgtgaatatgttaggttgcatggcaaaagggaattcaggtttcagatcaaatctaggtggctaaatcggctgtccttaaaataggaagattaattatcttagattatctgggtgggctgaatataatcacaaatttgcttaaaagttaaagcaggagggccaggcgcggtggctcatgcctgtaatcccaatactttgggagggccaatgcgggcggatcgcctgaggttgggagtttgagaccagcctgaccaacatggagaaaccccgtctctactaaaacatacaaaattagcagggcgtggtggcacatgcctgtaataccagctactcggaaaggtgaggcaggagaatcgctggaacccggaaggcggaggttgcagtgagccaagatcgcgccattgcactacagcctgggcaacaagagcaaatctctgcctcaaaaaaaaaaaaaaaaaaaaaaaaaagttaaagcagaggcaataaaagagagtcagagaaagatgcgactacaaaagagtggtcagagagatacaatgttgatggctttgaagttggaggaaagggccacaaactgaaatgtgagcacccactagaagctagaaaagtcagaaaatagaaacagattctttcaggttgcggtgagccgagatcgcgccattgcactccagcctgggcaacaagagcaaatctctgcctcaaaaaaaaaaaaaaaaaaaaaagttaaaggagaggcaataaaagagagtcagagaaagatgagactacaaaagagtggtcagagagatacaatgttgatggctttgaagttggaggaaagggctacaaattgtgaaatgtgggcacccactagaagctagaaaagtcatagaaaatagaaacagattctttcttacagcctgtagaaaggaatactgccctcttgacaccttggttttagttcagtgagacccatgttggccttctaaaatatagaactgtaaaaaaaaaaaagttatttttaagcaactaaatttttgaatttatttcagcagcaatagaaaattaacatgcagttttaactaatatctcatcagaaactttggaggccagaaggaagtagcacatttttcaagtgctaaaaaaaaaaacaaaagaactatcaacttagaattttggatcaggcaaaaatatccttcaggagaatgtggaaatcaagacattctcagtcctccaaaaattcgtatgtttaggctgtaacccctaatgtaactgtatttggagatagggcttttaagaggtaattacggttaaacaaggtaggggtcctaatctgataagacaggtggccttacagagagagattctctctccataggcaggcaggcaggcaggcaggcggtcactagggaatggcctgtgagcacatagtgagaatctggttttcgtctacaagccaagaagagaaccctcatcagaacctgaccatacttgcaccctgatctctcagttccagcctcccagaactgtgagaaaataaatttttgttgtttattccacccagtctatggtactttgttatggcagcctgagctgactaagacaactactaacagctctgcacacataaatttgacaacttagatgaaagggaccagttcctgaaaaacacacaaactaccacaaccctctcaatattaaatagacaatgtgaatagccctgtaacacttaaagaaactgagtttgtaatcttaaaacttccaaaaaagaaatctctaggcccagacagtttctctggagaattctaccaaatatttgaagaattaacataattaacataaattctacacagttttttccagaaaacagaagagaagggcatacttcccagtttattgtgtgaggctatgatttccctgacacaaaaactggacaaagtatagaaaaagaaaacacaaactatacacaatctctggcagaataatcaatacaaaggaacacattccaacttattttatgaggtcagggttatcgtgatacctaaaccagaaatagtaccaaaagaaaaaacagaaagagagacagaaagaaaaaaaaaagcgatatccttcataaatatgatacaaaaacccttaacaaaatattagcaaatacaaataatttaaaaagtatataccacaaccaagtggagtttattccatggatgcaacgctggttcaatattaaaaaatcaatcaatgtaatctaccataccaacagactcaagaagtaaaatcacatgatcatgtcaattggtacagaaatagcatttaacaaaattcaactcccattcacgataaaacctcaaggttgtttcagaaggtggtccttggacaaggagcattgatgttctgtggaaatttgtgagaaataaaaattctcatatcccatcccatagctactaaatcagaatctgaattcaaatgcaagtaaagtgtcagaagcactgttctataagacagcaacagaaaaactgttagtgcacgttctttctttctttcttttttttttttttttttgagacagagtttcgctcttgttgcccaggctggagtgcaaaggcgcaatctcggcttactgcaacctctgcctcctgggttaaagcaattctcctgcctcagcctcctgggtagctgggattacaggcgcccgccaccacacctggctaatttttgtatttttagtgcagacggggtttcaccttgttggccaggttggtctggaactcctgatctcatgtgatccacctgcctcgacctcccaaagtgctgggactacaggtgtgagccaccgcgcctggcctgttagtgcactttcagtagggttgttgttgaagactgctctgtcattaaccatctgaagatctatcaaaaaattcctcaaacatcaagaaccatgacatctttactacagatgaaataaattacttgttaattttattaatataaaccatgtatccaatttccattattgctatgtctttcaggaagatcagagacaatttaacagttcaaagttcatgactgtgtaagaccatatattctaaacttgacttggggctgacagtctcttcttcattttatctgatcttagtttttatttatttagtcttgtcatcttactatagggattgttagatgtctcctaaaatccactaaaagtaaaagaaagcaacaaataaacagatgaacaaataagaactcaccagggacttggtcatttttggctcttcggacaaaggggcagaaatctgagaaaacagatgggtagaggtacccatgagagaaggaactgtgccaatgtcacacatggacacatacatcatttagtgcccttgcaccttactcaaaaatttatttctggaactaccacattaaaatatcatcccatcccatattgtacaaagatttaagtgcaaaagttttaccataacatggttaataaaaaagaaagattagaaatgtttagatattcaataattgtggattgcttaaatactttataaaatatccaaaggatatactgttctattacgttattatactatctgatttcacaggcccttcaagttatcatcaaccctggtacctaactcctcactaccactcttcaatctgctctaagtgtcaattggtgcccagagactactcccagaagccattactgaaacctcagattcactgatttccatgccttgctgcccctgagccaggcctgcatcactcatcctacaatacctgatcacagagtcttcaattcctctaccctaatggtcctggctctctaccaatcaatcccacatccccatgactggcctctatgcctgtatgactaccgatcatgcatctccatcagccatcccaagagtcccaatcctaggcacacctgtttctgcactggggccttagcacacatacacatctcccaccactgacacaactaggctataagctcctccacatacacaaacaggaactcaatcaatgaacaaatcaggggaaattcttgcatgtatagaataaatttataaatagaaaacacttctaaatctaattgtgaaaaaccagactatttacagaggaaaaatgaaggaaataagaaaactcttcatctgcagtactgaaagctaaatgatgtcggaaatagcatctaaaagaccacttctctgtcagggccagagagacattttcagaaataaaagcacttgcagagtatctctatctttgagagaaacactggaagaagtccaaataaatgtaaaatgaaccacacaataaatcttgaataggaaaatattgtttagcaataattcttgcaaaagatatataattataaaaaaggacaatgtgacaatgtgataaagaggccactaaagagaaaattaataataccctatgataaaacattcctaataatctcaggaaaaaaacagaaaaaatggggtgcagaatggaaacaatgagcagaaatttcatcaatccaatgaaaatattatgtaaagaaaaggcagaaaataaaaagagctaaatagtaaacatcaaatggaaggcataaaatcagataaatcattatcacactaaactgagatgtaaaattctatcaacagagactataaattggatttgaaaaaagcaaaagtatctattgtaaacaaataggtaatctgacacagagacaaataggatacaaaataaagctctgggcaaagacatcatccaaatgcaatgaaagtaaaaacaagggtggcaatgtgagtatcaacgtggaattcgatgttaaaaagtgtttttcttggaattcgatgttaaaaagtgtttttcttttttctttttggttgaaaaaagggatcctataataataccacttaatacatgaaaaaggataaaaaatgcactaaccattaagtgtatgtatgcccatccctcagatgcacaaataaaattagcaaaaaagcacatataactgcaaaatgaactattaaaagtgatttttattgtatctcctccagaatatgaaacaagtagatcaaaattaggaaagataaagatttgaaaaataccaacaagcaagacttaattaaagagaattttggtccatacaacaaaatataatttttcttttatatctgttgaacaaagttcattgagtaacttggcttcaaggaaaatcttgataaattgttaaaagttgagacttgatagtctgcattttctgacaatacaataaaataaaaaacagctaaaacatactttaataatttgggaatgaataaactctcctaaataactaagattcaaagggaaacatcaaaatgaacttatgcatttcataaagatgtacttaaagaaactttacaaccctaaatgtatcccgcataaaacttaagaaaataagggaaagaacaacaaattacatcaaaaagtgggaaaaagagaaagtacctaaaaagaaaaagagaaaaaaattaatattaaaagagtagggagtattttattggacatttcaaaatgtccaatgaaacagataaacctttcagacgcttgattctttttaaatagagaaagaatgaatgatatataaatataataaccgtaatgataaaggagctactagtctggatatgaaagagaacaaaatggaaatggaaacatgcaattctatgtaatatattctttaaatctttagcaaaatatatcattataatgaaacagaaacgaaaatataaacagatcggtacgtataaaagagaggaaactaattaagatgtgcatcattcacactcctcagatccctccttagttcccatagtcatcctcccccacaaccccacagtccgccctcactccgccctcagatccaccaccagacagagacccccagtccgtcctcactccgcctgcagatccaccaccagagacccctcagtgccccctcactcctccctcagatccaccatcagagatcgctccgacttccactattccatccactgaccgaccccatcactgaccggaaggctcaggacagacatcagagattcttcttgctcagtccacagatgctgccatccctctactcacctgcccctcacccacgtcctctcaggacagtggtcatttgcctcgggaggtgactatagtcgcaagaaccagaacaggacccacttcctttttctcaatgcctcccaggcctagaggta

SEQ ID NO: 1544 - DNA, 297570 bp, Homo sapiens
ttagtttgtaaaagtcttttattgtatccgtgccacacatagtgaaaaataacactcctaaaaaaagaatgctaccttttccacaacattttattttaaataaaacttcaagtactcttacgtaggtacaaaaaaaatctgatctatttgcctccaacaggccaccacaacacacagtagataaaacacagtggttacaaacgtcttttaaatttatttctgaggcaaggcaaatgggagggaaatgtttctatgaaaaaatactgtgtgcgtaggaaattgtcacaattttattccacatggatacaaatgattatactttaatttaggccctggtggcttaaaattatataacaaaatagaaaaatggaaaactaatatcccctacaccctgtttcaaaggcaggcactaccaagattaaggagacgccacagtgttggtagaggataattactgtacagactgtatagctatcattaccttcagacgaaaataaaatgctacaatcctctaaggcatgaacaataatgtctgcaaacaatatatacacataatacatatttaaaacaagacttaatataaacaagaatgaacagtatatacatgtcaattttttcactgttttgaaatacaatttaactacacaagtgatgcagcaacatatatatataaatgtacttgtaactctacagtaaagtttctttttggtgcttttatagcacatcagtgtaaacagtttaacttggctttgttttatattttaaaacattccttgtattttcaagatttaaagcaattttctagttcttccttttcacagaaaacgaagattctggatgtggtttaatcataaataattcataaaattaaatacattcactaaaaaataaactacaaagtaaaaaaatgaaaaatagatatttattgagagggaaaggagaaccatttcccacattagagctctggtgttgagtattcagtgcgatttgatatattttaattgctattgcactataacaccctttcctttgaaaattctttgggtgtgcttccctgttctacctaaattagctgataaatcacacaaaccaataaccgagggccttggttgttgtaggaatgaagcctttaaaaatggtatcattcttctgatactttttttttatacttaaggaaaaagaaagtcattatgtatgtgccttgcacgtttatgtaaatacagttcacattgctggtctcatttgtccttgtttagaaggaaaaaaataaagagattattataacttcagctcactttgaaagtatctgtccactttttttcaaaatacttcctcatattgtggccagctctgcctatatcagaatcatcttcattaaatgtttcacagttgtcaaaaacaagcctgacatctagagcaaaggtttcaaggtttggatacctgaaagaaaacaaataattagagattgcgttcatagagtggatttgttttgtaaacaaatgaagagttaataaagggtaaaaatgaaagaaaaatgattaggataactgcatttaaattgatataaaatacatgatatcctcttacaaatggaacatttaaacatttttgtatgttctggaacatactggatttaaagaacaggttaaatgaaaaaataggtttctccaaagatcaaaacatatttcaactggcattttccccataacccaactcctgtttgacctgtatcacacaattctgtcacaggacctatcccacttgactagtttattaagttctctgaccaaatgtatcacttgcagaatcctattatccatattaaaaaatgctcagctgcagtagaaattatgtcaatgctccccatgcaatgataaaaattacacttgtcctgtagcttctatatacaccccaagatatggtgctctgcgttgtcttccccatttcccatttctcttctcttcatatgtgctcttctgcccaagcaatagagtatgatgaacccaaacaagcaaaacaagcatatgctatctttctactagaggtaacattatgagggtctgtctttcaacaagaagcactgtggcttctgtgcttttctggcgggataagcccaattctctttctctgtagaaaaacagaaaagagaaaagaaaggtgaatgaatctgcataagcttattagtaagaagggaatggtcatttcaaaccaactcaagccagttcaatacattttaaaagatagcttttagaaatgcaaattttaagttaattctaacctatgacaatctgtatactaaaataatgtaaccattaaaaatatctcatgagtgtaaattagtacaaccactatggagaacagtttgtaggttcctcaaaaaaactaaaaacagagctaccatgtgatccagcaatcccacagctgagtatatacccaaaagaaaggacatcagtttatgaaagagatatttgcactcctatgtttggtgcagcactgttcacaatagccaaggtttggaagcaatctaagtgtccatcaacagacgaatggataaagaaaacatggtacttaaacacaatggcgcaccattcagccataaaaaaagaatgagattttgtcatttgaaacaacgtggatcaaactggaggtcattatattaagtgaaataagccaggcacagaaacacaaacatcacgtgttctcacttatttgtgggatctaaaaatcaaaacaattgagctcatggaaacagagtagaaggatggttaccagaggctgggaactgcagtggggaggtggggatagttaatgggtacaaaaaaatagaaggaatgaataagacctagtatgtgacagcacaacaaggagactatagtcaatcatagtttaattgtacactttaaaataagtaaaagagtagaagtggattatctgtaacacaaaggataaatgcttgaggtgatgaatacccaattttccatgatgtgattattatgcattgcatgcctgtatctcatgtagtccataaatatatacacctactgtgtacctgcaaaaattaaaataaaaattaaaaaaagagaaataccctatgaggcactgacgctgtgagatcttgtcaaagtggaattctatttctttggtgaaatatcttgtatgacctttcactcgcttcttctgtgcgataatgaaagaaatatttctctatgcgtaatgtgctcacagagttaagtcagcccttatgtaacctcatccattttcctaggaattacttgcttatttttactgaggttaagaaattcacataaaattaaccatattaaggtggacagttcagtggcatttaagtcacaacactgtattatcgtcacttctaaaacactgtcatcaccctgaaaggaaacatcatactcattaaacagttattccccattcctccctcttcccagtacctggcaaccaccaatcttctatctgtctctatggatttatctattccagatacttcatctaaatggaatcatacaatctgtgtgggaatgatttttacaaaatattttaaagttgatttgagaactacttctgcctttgttccttaccctaagaaaaggttaatgattaacattagggagagtggagtccaggagagaattctaggtgagattctaggtgaaaaaagtatacaactcatatgtgtgtccttcctttatgggatggggcagctaatggaactcagaaaaattcatgtaagtaggcccctccctctattctaaaaatttctagtttaaaaatttgaaatatggtttgtgagttttggttccaactcattaatttgggtttaatcaaacaactcaaagtggagagttcgaggagcttgaatccactgaaattttgcttcccacacacctggcatcacaaacaggaatacacagactgtttccttctctctttctcttcccctgtgacttcctccattcactgggactcatttttcaaaggagctctgattttgtagcttttttttttttttttgagacaatctcactctgttgcccaggctggagtgcagtggcgaggtaactcactgcaacctgcacctccagtttcaagtgattcttgtgcctcatccctgagtagctgggactacaggcatacaccaccatgcccagctaatttttgtacttttagtagagatgagatttcaccatattggccaggctggtcttgaactcctgactttaagtgatccatctgcctccacctcccaaagtgctgggattacaggcgtgagccaccttgcctggcccatatgattttgtagcatttttttgttataaatatttctaagcctatttgttttaggaattttgaggtttacgttaatcttttatccaggaattggaagatcatggaagttaaaatcaagagttaatttaaatactagtaaagtcttcatgtgtaattctttttcttggccatgttagttataaatttcattgtgccatctacctagacaactattttgatagaacaaacaaaagaggctgggtgaggtggttcacgcctgtaatcccagcactttaggaggtggaggtgggcggatcacctgaggtcaggagttcgagaccagcctggctaacatggtgaaaccctgtttatactaaaaatacaaaaaattagccaggcatggtggcgtgcacctgtaatcccagctacttgggaggctgaggcaggagaatcacttgaacccgggaggcagagattgcagtgagccgagatgcaccactgcactccagcttgggcaacaaaagtgaaactctctcaaaaaaaaaaaaaaagaacaaacaaaagaactagtccatatctaggtaacagtgtttgcatattggaaccaatcagtaccaatcaatcatttaaacgcttccttaacttaggcaggtcccttctgtaattaaaaaataataaaacaaaacagacataaacctttggacggctgttatttcatcctccaaagaaataaatttgtcatttggtcaatctagtaaatcagttgatatatgtgagggatgctgatcattataagttctatttaactcttctaaattgaatataaatcatagagaacagttattttcaccaaaagaatgtataggaagaactaaataatatactggataataacaatgtaattaaaatatatattgtatgagtatcaggaaagcctcccaaagtaagtaactttattcttggaataggattgcaaagagaatatggtagagaaaagcaaataagctttctctcccgcatttaataaatggaattttggtattctccaataactcacattaaagctcttaatatgtaaagcttccaaagatcttctatttctacattgtgataatctaacaatatttgagtcaatttttgttaaatccatatgacgtgtggttgatactccatggatgcaaaatacaaattccggcttatatgttacttactttgggaggctctcctgatacttttccttaccttcagcttgggtttgtggtgctctttcaatgtcaaaagcaggtttattacacgggtttttaatttcttaaataattttagttggtttctcttctatactattctactctaaccaaatacacacacacacacacacacacacacacacacacacacacacacacacacacacacacacacacctgcctcaaaggcagggcctatatcttgctgttaattaaaatatctttggctcactaaaaatatgcctagcatatatcaggtattcaataaatatttagtgaactgaaatgatttacttactgtccactacttagtttctctctaattgtggaaaaatccataggcttcttaataactttcttataaccaggaacaagtttcaagtttacaggaagtagaaaaggccatgcatcctcatgagtttccatttcagtcagaatcatactaaagaaaataatgtttgaaatcagtatccatactttacaactgtcttattttttaattaaaaaagctttcagttattatatatatattatatatatatatatattatatatatatatatattatatatatatatattatatatatatatatatatatattttatatatatatatatatatatatatatatatgagatagggtcttgctctatcgcccagactggagcacagtggcaccatctcggctcactacaacccctgcctcccgggttcaagtgattctcctgcctcagcccctcgagtagctgggattatgggtgcacgccactatacccagctaatttttgtatttttagtagagacagggtttcaccatgttggccaggctggtcttgaactcctgacctcaggtgacccacctgtcttgacctctcaaagtgctgggatttcaggtgtgagccgctgtgccaggcccaattataatctttcaaataaaaactcaatgcaaattaacattaaaagaagataaaggaatacatttactatacttttacttatatattttcttaacatttatgctttacatttttttatttacataaattatcagaaagaaagctttaatatggtaaaaggtttctaaacaaataaaatggggcattataaatatacagtgcatgaaaacggaaataatacctgcaaagagctaggtccttggagtcatctcttttaggtttcttaactgaagtaaaactttcttgttttgacaagttaatagaagtgttttcctccatttttcttttcttgaggtctttgtttcctctttttagtgaactacttgtagatgcagagtcttcatcttcagtatctcctgttaaagttaccttcttgcctttctttgactcattagtcttttttcctttgacatgaagttttttgatttttagagtttgaccacttgcctttaatttaaaaaaaaagtaaatgaggtgtaagaaagtgactgtctacagacctattattttaaattatgaaagtctgacaggacaaataagtaaaaagaataactctgatctagaatgttgataactattattcttaagaaagatctgtgtattttttcctctcataatataaggataaaatctaataaaacatgaaaagtctattcatcttaagaattcttaaaacttgaagatgctaatctcatggtaattcatctacagaaggtgtctgtagtattctttcagtctaggtcactacttgaatgagtttaaagatacaaaagaattctcttttggagcacaacagaattaggaacaaagatgaatataaatgaaaatatagagattgttaataagaaagttgaagaggtaataaaaagccaggccaaaaaatgaaaaagagctaaggaagtgtcaaatagagaagtccaagtgatcaaatctactagaaattgatttgattttttttcctggataaaagataacaggtatttgcaataagaagagagttccacaaacttgtggttcccaggtgtgaacaaagcagtggtgaaagatggggcaaaaagatgtctgtttttgagaaaaacaacatagaaagaaatgacataaaggacattatacttggaatcgaaggatatgaattccagctatggctctgctactaactttaagcaaaaatatttgtgaggccctgttttctcacttaaaaaataaggatgacaagccacatacttgctaaagtcattctagctctagaattacatgcaaaaaagaactctcaacatggtcttatgcaatataactacaaattgcaggcagcacactgatgcaacaagaagggtgccccaccctgtattcatagagaaaaaaaatctgccttttgagagttaaatgttataataaatataatagatcatgaaagaaagatatgtaaacttctggcaacgtatggcttttatttttattttccaaatatgtggtacacaccaaacacttttagaaaactactattcccttaaccagattgttaagaaatcctagactgcaaagtcacataatcagtgtagcaataatttaaagttggctgcaatctttttttttttttttgaggcagtctcgctctgttgcccaggctgggagtgcagtggtacaatcatggcttactgcagcctcaacctcctgggctcaagacatcctcccatatcagccacccgagtagctggggctacgagtgtgagccaccatgcctggctaataaagttggttgtattcttaaaattggctgaaaaacagtcctttggagtatttcatagcattgtctttgaggatttcatgacccctgccagtaccttacttaaaaatgctcttaagcagttaaaattatttgtttctttattggcaggttaaagtatagttaaggagatattttaattgactaaataaggcaaaccataaatccaacactttcaccatatgatatcaaagaatcacaacccctgtcactaactgaaataattaatatgttttattcagtctcttctccatttagttatttatattcattaaaatctgattattttgggtttttatattacactgagcttttactctgaatctctaaaatcattaaaaaggagaacttaatataatgaagaaaaagtccatttaatgacaagttagattaaataactgtgttacttaaaacagagctggaattatgaatagtgggccaaaacatttagtttctatttgaactaaaatattacttgggataattttctaacaaattaatattcacaataagaaaatatgaaattgggccaggcgcggtaactcacgcctgtaatcccagcgctttgggaggcccaatgggggcggatcgcctgaggtcaggagtttgagaccagcttggccaacatggtgaaaccccgtctctaccaaaaatacaaaaattggctgggtgtggtggtgcacacctgtaatctcagctacttaggaggttgaggcacaagaatcacttgaacctaggaggtggaggttgcagtgagctgagatcacaccactgcactccagcttgggtgatggaatgagactcagcctcaaaacgaaaaaaaaaaaaaaaaaaaaagaaagtatgaaattgaaatcacagaatcaaaaaacttgtgattttttaaagacaaaaaatgatgtgtgtcagctgatgatctcattagatagtgcacctacacatactttaaaagcaaacttttatcaagttactctgttacctgattactttgctcttgggcagggcattcccccaacccccatcaccttttcttggctagagtacaaattcaaagaggaacttagtgggtcttaagcaaaacttatcagatttcatgaacaatggtacatatctttctagtttatatattgatagaagtcacaaactggtggctcaccggctccaaacaggccacagaatgtatttggttcatataatgcttgtaaaaattctgaatttgtttccaatatttaatatttgggaggacataaaaatccatagtcttgacttcccttgaaatattagtgggttctggaacatggggcccacattcctacatggcaacaattgggtggagttgagctttgactattaaatttaaatagggccatgactcccctgtttgccacagtgcccatgaggggtccaatgaactctttcatgtcatttacttggcttttgtaggcactgaagtttgaaatgtctaatatgtgagtttgtgtgtgtatgtgtgtgtgtatctaagagtgtatattcatataagtggccctccatatctgcaggttctacatctgtggattcaaccagctgcagatggaaaatataaaacaaaggccgggcacagtggctcatgcctgtaatcccagcactttgggaggccgaggcaggcagataacttgaggttaggagttcgagaccagcttggccaacatggcaaaaccccatctctactaaaaatataaaagttaaccaggcattgtggagcacacctgtaatctcagctattcaggaggctgaggcaggagaatcgcttgaacacgggaggtggaggttgcagcagtgagccaagatcgtgccactgcactccagcctgggcaacagagtgagactctgtcttaataggaaaaaaaaaaaaaaaaagaaaatataaagcaaaaaatccaaccccctcataacaaaacaacaattaaaaaataataaataaaaaacaatatagtctaacaactatttgcatagcatttattgggtatttattgcatagttttattgggtattataaataatctagagatgacttaaagtatacaggaggatgtgtgtaggttatatgcaaataatattccattttatataaggaacctgagcatctgtgactctggtatccatggtggatcctggagctaatcccttgcagatttgcagatactggggtatagctatgttgtatatatatgcacacacacacaaacacatacacatcttttcgattctgtgatcctgtgatcacatatatacatacatacacacacacatacacgcagagtaaaaacagttaatcaggataatgtatgcagaaaaagccacttgagagcaaggtgtatgtatagtataaatatttttaaataactatgaattaaattgaaagatactttaaaaaccttaacccttcattatatatcaaaatcaatgtttagagttttactgttgtaagaaatatctagttcactacatttaaaaaacaaaaaaagcagaagcttagaaagctgtactcacatagaagggcttgaatgagattacagatcttatgtctccaagtttactgcttgaatggtagatagctaggatactaatttaagaaaatttattgaaaacaaacgtccaatgacctaccaggtgatactcccaagaccaaaaacactaatctgttagtaattcatagagtattagagaaactttctataacttaagttatgaagttataagataattttatgtacatcagtgaagactgctgttaagttatatttaactatgtatgacaaaaatgatcaatgagaataatcaaaataatcaaaaaatgactattagtgaatatgatgccatgtaagaccacttgctatcttgtgaaatatagtctaaaatataaaatactaaaataaacatttcacagaactataaagttataaaaactttcacatttatgaccttatttgatcttcacaaattcccacaaagcagatactatcccattttacaaatgataacctcgaggcaaaaaaagcactcccatgtttacagatcaggaaggtggggagaaatcgatgaagatttgagaagaagcaaagactggaaagaaaaccaggagagtatggtatcttagaagtcaagtgaaaatcaatgtttcaaagaggagagagcgttcagttctatcaaatgtaataggtcagatgacataggcactgatcactggagtgagaaatctgaatgctgtttgtggtcacaataagagcacttttggagaagctgtggaggtgaaaatctatagtgagttcaagagtgaatcagggccaagtgtggtgtctcacacctgtaatcccagacttcggaggctgtagtgcgaggatcagctgagcccaggagtttgagaccagcctgggcacatagcgagaacccatctctacaaaattaaaaaaaaaaagccaggcatagtggcacaggcctgtagtccctgctgcttgggaggctgaggtgagaggataacttgaacctgggggactcaagactgcaataaactgtgatagtgtcactgcattccagccaaggcaacagatcaagattctgtcttaaaaaacaaagagtgaaccagaggagagatattagatagaaccagaacaaaaaattttccaagtgtttttctgtaaatggaaggaaaaaatggaggaactggatcaagggagaagtgaggacagaagagggtttttgtttagttttcttaagatgggagagatagcagcacatcagtaggctaaagagaggaacccagtggagaaggagaaattggtgatgcaggagaagggagaactgctggaataatattcccaaggaggtaagaatggatgggatctgaggcacaagtgggaaaatttgcttagttaggagttcatggcaacagcagagaaggtaaggtatgtgagcccggatgcagaaggacagcagatgtgctggcaagatgtgatattttcttccgatgacttccattttctcagttgaatgacaataagttgagaatgaagatggaggaggcagagctagagataaattattgacatcattaaaggcctctaacaccttatttatttatttattaatttagagatggagtctcactctgtcactcaggctggagtgcagtggcatgatctgggttcactgcaacctccacctctgaggttcaagcggttctcctgcctgagccccccaaatagttgggactacaggcatgtgccaccactaatttttgcctggctaaaattttgtatttttagtagagatggggttttgccatgttggccaggctggtcttgatctcctggcctcaagtgatctgctcgcctcggcctcccaaagtgcttgaattacaggtgtgagccaacatacccaggccttaaagccttgaatttaaaggctgagtattacacagctatattcagatacaaaggtataggtgctagagaaatcagagaattgtattaaccagaataacggttttaccaagggcaggggcaggcaaaggacctaatggtggaagcaatgattgggataatgggataatgacacataagacagaataggaggaaagagaggacatgaagtgggagagcaacagtgaaaagtcttaagacaaaccgaaagtcctggtgagatccaaggattgttggagttgaagtgctacagggagtgaactggaagggaagaaaggaggtggacagatggatgtttgaagtgagtttatggagaggcggtagttaaaagttaggttaagagattgttaacaattagcttactgttaataattaggttaagagattaaacatgggagaaagtaactgaggtagggaatacctagagtctgccttcaaaaataaacaccataaaattctgcattttgatctagtaattaaaaagttgtttggagccaggtgcagtggcttgcatttgtaattccagtgacttggcaggctgaggtaggaagattgcttgaggccagggatgagaccactgcaggcaacatagcaagaccctatctctctctcaaaaaaaaaaaaaattagctgggtgcagtgcacacctgtagtctcagctactcaagagattgaggccagaggatagcttgagcccaggagttttaggctgtagtgggctatgatcataccactgcactccagcctgggcaactgagaccatgtattaaaaaaataataaaaagataaaataaaatgaaaagtttagttttagattggtcttaccttagcaatgcaagctggacaaaaccagtctccatctgggattgttgtaatcttgggtctatggcagtaggtatgacagcctttgtcacagccatcacaaagaagaagcagttcttcattatctccctttcgacagatttggcagtactataatacatgaaaaatcatttaaaattaacgctctgccatgaataatagttattgggatgttaaacacaccataattcctaatttatattagtaatgaacattccgcttgcttacaaatatacagtagccatacacatctatgtatctttcgttacacagatatggaccacatgacgggtgagcagttctattggggtaaatgcacatttcaagtacactgcaaagaacaaagctagaggcagaatgccttgcacacacttcagaagcatgtacacattaacatatgaaataattaacatgacattagagcacataaagcaatgaatagctttaatacatgatgttttatttgtttaatgtgcttcatcttttgcttatcttagcatcctcatgatatcctgagaaagaaataagagttagagtattttttaaaatcaaaattagaaaacttgtattagtatcataattacgtataataaaaagataaccctagatttttgactaattcatctatatattgtgatagattggaaaatgtgttcaaaccaggaaacgttgaaaatcaacccaaatcaaacatgtgtcacaagtgcagaaaatggatcctacaaaatggtttctaaggaaaaaagatacaatacatgtaagaagttaagaggtcattatttatttttttagaattaaaaataaaactagttgttttctactgaaaattttctaatataattaaagactttaaatctgcaaaaagaagactttttccatgtacacatattctgtacggtaagttttacaaaggaaagaagaaaagttagacaagtaaaaacttccaagatggctttaaaagacagtaagcattaacactgttttttgacatctagttcatactccagtcacaaaaaaaaatgtcctgcagtccatatttttaaaaatgaaaacatgtaaccagaaatcatttaaactactttaaagttaggtatttatacgctcttaaaaacaaaatagcttaactgttccaacttactttaattttcaatgcaacattatatcttagtctgggaaagtctaaaatggtcttcttataacttagtatgtataccaatgacagttgtagaatcttatcaaaacagcagacacactattcaagttaacaaatgtttatcaaatgtatatactatatatttcatattaacattggcgcggttaccaagggcaaaagcagcagtttaacattccaataatcagtatctattttttgacctttcctaacatcaccatcactgaataccttaagatggtgttgtttctccatatttgagttacatcgttaaaacttctattgtaaaagtattcactgagaaataacaattgcaaggttatatgtatatccctgtaacaacacaatttaaaaatcagattcatgaacataagtaaatactcattgttttctctactaggcaactataaatgctacaagatctgtcttacatctcacacttaggatttaaaaataaaattatttcctgatacttttaaagaaagggtgacagatatcaaactcataacaattttgaaaaattatagtaatagctcacaatatgttacagtaaatatattattatttggttttaattcctctgctactacagtaaaaaatagtggatgctgcctactgtttaacaatataaagcatactgtgggtagagaattatctggaggcaaattatgacaactccctctttttcttgataaccttggtctttgtccaaaagggtatttctaaagatatcgagcactttaatattttgtcaggacttactatgaggattactataggcactgttatgtctctaaaggttataaggtgcttcttaatctttgaatatgaaacactgccttcttttcaaggtagtttcatagcaagaaatgtattattaagcattttaaaaaggaaatgaagattgtgagagatggagttatatgattaataagagtagatgaagaacaagagaaaggttaatgaatttgcaaaaatggaaataaagctatagattgcagaatttaaatatatcaatataaaggcaggttttgatacaagttttaggtttatgtgtgtaagtttataataaaactgaacacatcatgatgactgctttggtgtagatgagaaaaatataaatacaaatttcattttgatctaggacttaatctttttttttcagttttatttacagacaaggtctcattatgttgcccaggctatagtgcagtggctgttctcaagtgtaatcacagcacactacagcctcgaactcttgggctcaaatgatcctgccttggcctctggagtagctgggactatcagcatgcaccaccataactggcaagaaatcagtctcagtttctctctcttttttaaaaaaatcattattgcctagatctcaccaaatatatttgtctaaggtgacattcaagctggttttaataataatttttagaaggaaaaaatatttgtacctggtaaaaacactattaaatgaatcaaacagtgccttaaaatttatagtaaattctgggccaggtgcggtggctcatgcttgtaatcccagcactttgggaggccaaggcaggcggatcatttgagttcaggagttcgagaccagcctggccaacatggtgaaacactgtctttactgaaaatacaaaatttagctgggcatggtggtgcacgcctgtaatcccagctactcgggaggctgagggcaggagaactgcttgaacccaggagattgaggttgtagtgagctgagattctgctactgcactccagcctgggcaacagagactctgtctcaaaaaaaaaaaaaaaaaaaattatagtaaattccaatctgaattgagaaagaccctgtattccagcacattatgaaactgcagattcatagatgttttaggaagcagtgaaaaaccatagaagaaacgtaatttatttgtgtggaattaataaggccttgagtagtctaagcataaaggtaaagacgaaagaaagaactctaagttatttaagaatcaattcttttcttcagggaaacaaccattttaagtaaaggaatttcacctttaaccattcatgaaaagaatctcaaatgtttaaattttaaagctagtctgtaattcaaagtaaatggtagccaggcacagtggctcacgcctgtaatcctagcactttgggaggctgaggtgggcggatcacctgaggtcaagagtttgagactggctttgccaacatagtgaaaccccatctcttctaaaaatacaaaaattagccgggtatggtggtgggtgcctgtaatcccagttactcaggaggctgatgcaggagaatcccctgaacccaggaggcagaggttgcagtgagccaagattgtgccactgcactccagcctgggtgagcgagactctgtctcaaaaaacaaacaaaaaagcaaatgttaaagtaattcataaaagactacatataatagataattctatatatgataatataaaagaggcaagagggacacttgtacatgatttaaagtaaatatttctctggaaaacatgaattatagctctgtattttgaacacacaccattttggtgcctgatacaaaatagagatttttgtgataaactaaatgataaactaattggggttgtagaaagaaggtggaaaaccaattttaattagtagaagacagactaaaggatctactgttcatgtcaaccacatctgatgccaaatacatgatataagcacataaactaagagttctctgcttatcttgtatttacttatctaagtgcttcttagaattaaaaaatgaaaactgatagaaaaagacattttagctacgcagtaatatagcaggtaatgttagcaatggaactgtttactacagtgaaacagccttcaagatttagattaataactattgtgctgatggaatgtgggagacaacttcagttagaggtataaacgatattcaaaggaggcagaagcaagattttaaaaaataaaagataacacatttgaaaggttccttcagtaaggaggaaagtatcaaaaatcttttagaattagaaaaactctcaagtatagcatacattattatgacaataggtaatgtataattaagaaagatctggaggttggaagaaacaggacaaagtaaattagttataatatttcttaaataaaaacacttacaactttcataattgatttttcccatgctattgatttctgtaattgctgaatgcacagagctacctgtgcagcactgcgagcttctgataatgcccttctccataccctgagccctggagcaatatcctcttcaattctgcattgaaatatagaaaaattaagtaggtcatgtccacacttacgattacggaatgtgaaacaatcatcacactgaaagccaagcaatgacaaaaacatgtaacagccaataagtataaggtttaagcaactaaatttgatgtagtgcacagactgtggctacgtgcctcaaagcttagtcacaaccaggtagatgtaagatcactttgcaggattatcaacgcacataacaaaaaaaaagtttttacaaagcaccatgcaaatagcatgatccgtatggatcacagacatacaagaagatacatagataacaggcaatagaaaataggctccaattagcaaagaagcacaataatttttcaagttaatctcaataacctacccgtcaccatcaccactaacggatggtgcaggagcagggacagtaactgtgcccacattatccagtttgatctgaatggtggtacttaaggggctcttcagataccttctttcaatgttccgctccaaatcagccagcctggttacagctatatctagggggttgtcactcttccgttctagtgcatgtgcactgctttcgtcttcgccagtaaattctccatcatgctccttgcacaatttagtaaatgatttatgttcaaaatataccaagtcctccctttctgatgcaggctctggacacatccaaccctatatatcaagagaatagtgttattatggtttcctcttaaaatgctaggtgggtgaattacctttacttaaaatacagcattggatactggcagatctcaaggattgttactaaaagattttaccttgtgtttcctaaaactaggtggaaataagaagaaaaaaattaaaagaaatagttgtaagaaaagtttgaaaaataaaatttataaacttttgatattataaaaggtataagaacaatcagcaaaatattttgaaggattttagaccaaaatgcttatcagtttcatgggatcacttaaatggaaatctctgggtagcctctgagcctttgctcttcctttctgttttcattccttccattattcttctgtacaggtccttctgtgctcaccatttttcctttgactgcaggggcttcaaatatgctattacctttatctgtattgcttttcttttgctcctcttcacctagttaacgccactcatttcataggtctcatgttaagattcactttaacatgaaaggatcctgataggaatcctttcctgacctctttcaggagctaagtccctctctgacaggttctcataggaccatgctccttagccttgtcataaatgtaattttatagtagtgtaattattcgatgaatatttttctacttctaaattccatgagagcagggactatgtctgcttttactcatttatctccagtacagtgcaggcaaataatgggcactcaatacatgtatgttgactgaacaatcaatgatcctgtagctcaaaatccttcaaagatttcctattctttaggaaatgttcaccatggcattgaagtacctcaatctatcccttttcatgttcccattcacacatcttatgttgcagtcaaattctataatttgctcttccacaaacatgagataagctttccaatcctcgtgctctgctcatgctgttcccacttcctgggatgatattgcctggtctccaattgtccaaaccatactcattttcttaagttccatttcaacttctaaatgaaatcttccatatctctgccagaagtcagtattcttcttctaaattcatacattactctgttctcaacaatcagctactagattctgcatatatgtatatgtctgatctccctattatatgacaagctttcttatggtaggaacgacactttatccaattttttggtgtccactgcctgagatgcaataggtatttaataaatgcatattaaatgaaaaatggaataaacttaaacatctctttagatataattattttatcttatatactaggataaattcttcccctttaactcagtagaatatttatatttagaaaggaaggatggactctaaaatggtgtcacagatacaagctggcttcagttcctgcctccaatgccctccccgtccctgccgccaaccactcagaaaacccaaaataaatatacggcactgagacgatcaccagcaacatcccaaaattcaaacatgaggatgagatagttcctgtggcaagagagaagtgaaaaaactctgagcagatggtaagagaactggacttccatatccacgatgcttctctaccctcattctgccaggaaccaagcacacagaaaacttccccctaactcacagtttctacactgaaaaaagtgagatcaagatagacaaccaacttatccactatgaaaaacagtgtgaaagttcctcaaaaatctaaaaatagaactaccatacgatctagcaattccattagtgggtatacatagaaaagaaagaaaatcaatatatggaagagatatttgtactcctatatttactgcagcaatattcacaatagctaaaatatggaatcaacctaaatgcccatcaacagatgaatggataaagaaaatgcagtatatttataggatggaatattattcagtcataaagaagaatgaaatcctgttatttgcagcaaaatggatggactggaggacattatcctgggtgaaataagccagatacagaaagacaaattattatatattctcactcatatgtgagaactaaaaaagctactctactctagaatgtagagagtagattggtggttaccagaggctgagaagggtagggagagagtgagagtaagagaaattgactaatgggtacaaatatatggtttgacagaagaaataggagaatacataaagacaattagacaaaatctggaaaacaattcatgatttgaatgagaaaatcaacagagacagatataaaaaagaaccaaacagaagttctagagctaaataattcaatgaataaagtaaaaaatacaagactagatcaaaaagacagactagaccaaggggaagaaagaatttctgaagacaggtcgtttgaagtaacataggcagaccaaggggtggggggaaagaaagaaaggaaaacaaagaaaaaggaaaaaaagaaggaaaaagcctataggatttatgggacaccattaagcaaacaaatattcctgtgggtgttacagaaggtgaagagaagggaaaggtgaggaaaaaaaatttaatgaaataatagtagaaaactttccacatcctgggagaaagaggaaaattcaggtacaggaagtttgaagaatcccaagaaattcaacccaaacaggtcctctttgaggcatattatagtcaccctgtaagaagtcaaaagacaaagaattctgaaagcattaacagtgtcaagtcacatataaggaaatctccattagactaacattggatttctcagcagaaaccttgtaggccaggagagaatgggatgatatattcaaagtagtgagagaaaaaaaaaaccctaccagccaagaaagccttcagaaatgaaggagaaaaagaatcttttacagactgagggaaactgaaggaattcatcaccactaggctaaacatgcaagaaatgctcaaggactcctatatctgaaagtaaaaagatgataaccaccatcacgaaaatatgaaactataaaactcactgggaaagctaatacacaaaggagaaaggaaattattacacacataattttaaaaagcctgatgataaactgtatccttatggaaaaacacccagccacaaaaataaataataatcaaggaagtaaggaacaaaggattatacaaaacaagagaaaagcaatcaataaaatgacaggagtaagcactcacctataaatagtaatcttgaatgtaaatgaattaaatttcccatttaaaagacatagactggctggattaaaaaaacaaggcccaactatatgctgcctataagaaactcccctcacctgtaaagacatatgtagactgaaagtgaatggatggatagaaatagcccatgcaaatgaaaaccaaaagtgaagaggaatagttatacttatgtcagataaaaaaaacaaacaaacaaacttcaagttaaaagctgtaaaaagagacaaagaaggacaattatataaataaagggatcaattcaacaagagaatacaataattgtaaatatatatgcactcaataacagagcactcaatacataaagcaaatattattagatccaaatgtagaggtagatcctaatatgataatggctggggatttcaacatcccactgtcagcattggacagattttctagacagaaaatcaacaaagtaacatcaaatttaatctgcaccatagaccaaatggacacgtacagaacatttcatccaccagctgcagaatacacattattttcatcagcacatggaacatatgccaggactgaccatatgttaggactcaaatctcaaaaaattttaaaaatttgaaatcatatcaagtatcttctctgactacatggaaataaactataaatcagtaacaagaggaacatttaaaaccatacaaatacatgaaatgtaaacaacagggtcctgaacaaccactgggtaaaagaagaaattaagaatgaaatttaaaaattccttgaaataaatgaaaacagaaacacaacattccaaaatgtatgggacacagcaaaggcagtattaagaagcaagtttatagcaataaatgcctacatcaataaagtagaaatatttcaagtaaacaatctagcaatgcccttcaagtaactggaaatgcaagaacaaatcaaaccccaaattagtagaaggaaagaaacaataaagatcagagcagaaataaaccaaattgagacaaaaatacaaaagatcaacaaaacaaaaagttacttttcctaacaataaaatacctaggaatgcagccaaccagggaggtgaaagatctctacatggaaattgcatcacactgctcaaagaaatcaaagatgatacagatggaaaaaatcccatggtcatagataggaagactaaatatcattaaaatggccatactgcccaaagcaatttacagattcaatgctattcctataaaactaccaatgaaattcttctttgaactagaaaaaactattgaaaagttcatatagaaccaaaagagagcccaaatagccaaggcaacttcacttcttgggctcaagccattctcccacctcagcctcccaagtagctgggactataggcacgtgtcactacgcccacctaatttttgtattttttgtagagatggggttttgccatgttccccaggctggtctcaaactcctgagctcaagtgatcctctcaccttggcctcccaaagttctgggattacaggcatgagccactgtgtccggcctcagcagcattttgatacatgaacaatgaattcactaaaaaagaaatcaagaaggcaatcccatttacaatagctaccaaacaaacaagcaaaatcaaaaacaaaaatccaattctaggagtaaatttaaccaaagaagtgaaagacctctacaaggaaaactataaaacactgattaaaaaaaactgaagaggatgagaggatacaatcatgcttatggatcagaagaatcaatattgttaaaatgataatactacccaatgcgatctacagattcaacacaatccctatcaaaacactaatgatattcttcacagaaataaagaaaaaatattaaactttgtgtggaattacaaaagactgaatagctaaagcaatcctgagtaacaagaacaaagctggaggtatcagactactaagacttcaaaataaactacaaagctgtagtaatcagaacagcatggtacaggcataaaaactgacacataaaccaatgggatagaatagaaaacccagaaattaatccacacctctacaatcaactgctttttaacaaagctgccaagaatgctcattgtgaaaagaatagtctcttcaataaatggtgccaggaaaactggatatccatatgcagaggaattaaactagacccccacctcttatcctatacaaaaataactcaaaatagatgaaagacttaatgtaagaccccaaatgataaaactacagaagaaacaggacactggtctgggaaaatattttatatataaaacttcaaaagcacaggtaacagaagcaaaaataaacaaatgcaactacatcaaatgaaaaaacttctgtacagcaaaagaaaaagtcaacagagtgaaaagaaaatcctcaaaatgggctaaaatatttgcaaataatacatctgaaaggagattaataccaggatatacaaggaactcaaacatctcaacagcaaaaaaccaaacaatctgattaaaaatgggcaaataatctgaacagacatttctcaaaagaagacatatacatggccaacaaatatatgaaaaaatgctgaacatcaccactcatcagagaaatgcaaatcaaagccacaatgagatattatctcaccccagttagaatggctattatcaaaaagaaaaaaaacggccgggcgccgtggctcacatctgtaatcccagcactttgggaggctgaggcgggcagatcacaaggtcaggagatcaagaccatcctggctaacatgatgaaatcccatctctactaaaaatacaaaaaattagctgggtgtggtggtgggcgcctgtagtctcagctactcgggagactgaggcagcagaatggcgggaacccgggaggtggagcttgcagtgagccaagatcacgccactgcactgcagagcctgggcgacagaacaagactccatctcaaaaaaaaaaaaaaaaaagaaaaaaaaaaaaatgagatgctggtaagaatgcatagaaaagggaactcttacatactgttggtgggaatgtaaactagtacagccactatgaagaacagtatgtaggttcctcaagaaactacaaatagagctatcatatgatccagcaatcctactactgggaatttatccaaaggaaaagaaaattgtcgtattgaaaagacatctggccgggtgtggtggctcatgcctgtaatcccagcactttgggaggctgaggcgggtggatcacctgaggtcaggagttcaagaccagcctcaacatggagaaaccccgtctctactaaaaatacaaaattagccaggcgtggtggtgcatgcctgtaatcccagctactcaggaggctgaggcaggagagttgcttgaacctgggaggtggaggctgcggtgagctgagatggcgccattgaactccagcccgggcaacaagagtgaaactccgtctcaaaaaaaaaaaaagaaaagaaaagacatctgcatcccgatgtttactgcggcactatacacaatagccaaaatacagaatgaatccaggtattcaacaacagataaatggataaagaaaatgtggcatgtatacacaacagaatgctatacaaccataaaaagaacgaaatatcctgtcattagaggcaacatggatggaactggaggacattactttaagtgaagtaagccaggcacacaaagttaaacactgcatgttctcattcatgtggaagcttgaaaaaaaactgatctcatagaagtaaaaagtagaccagaggatatactataggctgggaaaagtgggggcagggagggataaagagagatttgttaaagaatacaaaattactggctgggcgcagtggctcacacctgtaatcccagcactttcggaggccgaggtgggcagatgatctgaggtcgggagtttgagaccagcctgaccaacatggagaaaccctgtctctactaaaaatacagaaattagctgggcttggtggggcatgcctgtaatcccagctactcaggaaggctgaggcaggagaatcgcttgaacctgggaggtggaggttgctgtgagctgagatcacgccactatactcaagcctgggcaacaaaagtgaaacttggtctcaaaaaaaaaaaaagaatacaaaattattggtaggtaggagaaataagttctcgtgctctataccactgtacgatgactatagttaataatatatattgtttcaagtagctaaaggaggatattattcttaacagaaaaaaaatggtaaatgtttgagataatgaatatgctaattactctgatctgatcactatacattaaatgtaccaaaacatcaccatgtactccatgatactgtacattatcatttatgattttaaaacaatttatgaagcaaattctacttatcttagctactgataacacagccaagaacatttaagcagtcagcaatgtgataaaggtcaaaggaccaaaatctgagtatgtcaccaggaaaatgtttcaggcccacactcggactttacacatattttttaaaagcctgatgatacactttcccaaccaacagtcaactagaattggcaaatgagttgggaaaaagctggaggaaaatagggcttatggaaccaatcaaatttaaaccagcaagcagtatcaactgacaaactgagaggacaaccacagactatagaaagtagatgtagcagttttaaaaccaaagcacactaggatcatttaggttaggtgcaaaacctcttctcatttcctgagggaattattgtctgataattgatcttcatactgatgattctgtgccaccatgataagttaaatcaggctttttattttcaatttaagaaggcaatgaaatgtgtaacataagcgatccaaaaacacattaaaaaattctagcactaaatggaataattttcatttctccagaaaataaaatagtgtgaaagggttcatctgttgaagatgccagaaagatgacaatacacgaggcacttttatactgtattatagaacctggaggaggagacatagtttactagcacaatagtttcaataataaatttttgcttcccaacgttggtaattacgtttgtcacaagaaagggatattttattagctctggaaaactacattttttgagatcctcaaaagtgtccaaatgcctatgttaaactaattatgaagcaaaatctcaattattaaataggatagcattatgccataaatttctcattctgaataaagcaaggcatttcaaatcaaattacatggagattaaggtttctaaacctttagtaccttagcagattctagccaggcacagtggctcatgcctgtaatcccagtattttgggaggccaaagtgggtggatcacttgaggtcaggagtttgagaccagcctggccaacgtggcaaaaccccatctctactaaaaatacaaaaattagtggggcatcacggcatgtactttggaagcctgaggcaggagaatcacttgaacctggaagtggaggttgcagtaagccaagatcacaccaccgtactccagcctgggtgacagcgtgagactccatctcaaaaacaaaaaacaaaaaaacaaaaaacccccaaaccaaaacagaaccttagcaggttctaaacctttcatgcttttaaggagacctttatacccctctttacaaaaccaaaaattcttgcacaagggtaaagctttccttttgtttgtccactggaaaccagttctgatcattacctgtaacatgataatacccaggagatagatgagggaatgaatgaataaatcagtaaataaaaactttatatatatatatgtagggtatgtgtgcatgtgtcagtatatcataatggtctataacatatatttggatatatctatattggtctccaaattaaactatatagtataaaagtctgacatataacaaggcttgtatgtaaggaagttcatggccctatatgaaacactacaataggagtttgataatatttgtactagatcatcacattcatctcagtgaaactggaattctgctggtagtaaagaactgcgcatcggaaataatacctctgaataccattaaggaggtagcaagattactaaaaagaacatgggctctggagtcagacttggtttaaatgcacatttaggcacttactatatgaccattggcacattacttactctgagcctggttccttaacagatggggcaaattaatccaggattgttttcagaattaaatgagacaaaataaaaacatttagcacattaactagcatatattaggcaagtaataaacattagttatcttccattatcctaaaaacatattttattccaagtcgattttaccttcacttgcaaacttgctgatgcaactctcctttctagatcttctacctgttgaaggacactcaaatccatttccattgcttgttcttctactgaccagttctccacaatatctcgagttacttggttttcttcattttcattcagttcaataatagcaactacatttaaaaagaaattaatttaaaaatccacttattaagcttttccccacagagacctcttccagaaagtgaataaaattctaggagacccatgtacatctaacttgacatacacaaatgcacttgtgtatgtacaggcagcttactcttaaaagtagaaacacgctaagaaacacaaaacaatatgctacgggtgtaaaaaattacaagacagtaacaccaacttaaaaaatataaatagtttgttgagtaaaacagaaaaaaatagtagtgcattaagatatcatttctctcttgatatctgtgggggattggttctaggaccccctctgcccccatgaataccaaaacctagagatgttcacatcccttatataaaatggtgttggccaggagtggtggctcatgcccataatcttagcactttgggaagctgaggtgagaggatcacttgaggccaggagttcgagaccagcctgggcaacatagtgaggccctgtctctacaaaaaataaaaaaaactagctgggtgtgggggcatgtgcctgtagtcccagctactcagaaggctgaggcaggaagattgcttgagcccaggactttgagaatgcagtcagctatgactgcaccaccattctccagcctaggtgacacagcaagactctctcacaaaaaaaaaaaaaaaaaaaaaaaaaaggtgtactatttgcatgtaatctatgtacatcctcccatatgcttcaagttatttctaggttacttatagtacctgagacaatgtagatgctatggaaatagttgttatactatatattatttagggaagaatgataagaaaaaaaagcctgtatatgttcagtacagatgcacccatctttctttgactgtttgatctgcgattggttgaatccatagatgtggaacccatgaatatgaaggaccaatagactgtactaaaatatggtttagaataattaattctcataactaagcaagaaagaaagctgaaatatcttttaggtacacaccatccttattcttgaggcaggcttgagtaatataatccaaatgtttctgaatttgtttttgtaatgccttttctcttattcctctgagatgcagcactttgagcaaagcttttaggtcctctgggtcaataattctccaccaaccaaactgcatttctaagtcaagataaataagtagaacttttacaaatattttgaataggaaatgacaccatggaaataaaaagatttattaactatatatagaaccatcaaatattcagttataatacaggaatccataatattgaaattgagtaagtggctgtaaaccatctcaatgtacctaccttctggaataggttttggactaggaaaatctactggttttgctacttcaacagctgcaggttgagctgaagtggccttttcattctgtggtactggagattcacttttacttgaagcaacattggaagtcaagaatgaattaccatttccttctgataaccctaaccccgatcctagactaggtacagatgatgtaaatggaatattagaagtaaccacaccagtgggccatccacaaaactgaagtcccatcatagatactccacctttcacctgcaaaaagaaaacatttattaatgaaaagtagattactctaagaagttaggaaaaatgtttggaatatgaaattatttttcaaattccaaaaaatattctttcatttattacaattacaggaaaacaaaatacattagcaacaaaaatgttaaattccatgttcttatttgtttcccaaagtaattttcctttcggatataccgttacagtaataagttaaaaagtaattaaagaagacttagacaaagtctagaaatcagtagttctaatgaaccttggtgacagaaattctgacttgttttagttttcaaactgtagcaggaatattttaactatctgagtgagcccccttgagcaaaaatctccatggggtcaaagattacataaagcaatataaaaatgagttacagttagcagtactaacctgaagaggtgataaagcaaatggatttaagccaacaggattctgagcagaagatccaagaggagctggggtaggtgaaggtgacttagatggtggctgagactgaggagtcaccaaagaagcagttgacatatcggcatgagtaagtgaagtgtcatcacagggtgttcgtggcaaaagactaaaccattgtctattcttttcagtcagcgtttttagtaactggtcattggggagaggactgtagaacttccctggaccacttgaaccagtattaaacagattattagagtctgccttttccacattgctttgcgttgctgttgactgaacgctgcccagtgaatgttttccactgttctgataagacaacgtgcacccatttgcaccagcatttggtttgggggtcataacctctgactcaggaggcatcttagctacttccaaaagcttgcttaatttggaaaaagagccaggtttctgaaggaatagatttgtgttatctttttctttaagatcttccttttgttcacagtgatctgtatttgaacaatttaaactgtccccagaagtctcaaacatttcttctttgatctggacactttctgcctttttcagtttttctctttcttttgcaatttcttctagtcctacaaaatgaaaaagcattatgaacatcagttactccagatcaaaccaatactgtaattaaatttcattactctttatcaaattatatgcataaatacttaaacttttctgtattacctaatactccctatattttccttttttatagattatagctttcactcactggaaaattaacatatatatatatatatattttgtttgttggtttgtttacattttattttgagatggacggagtctcactcttcttccaggctggagtgcaatggcgtgaattcagctcactgcaacctctgcctcctgggttcaagcgattctcctgcttcagcctcctgagtaaatgagattacaaaggtgcaccaccatgcctggctaatttttttgtatttttagtagaaacagggtttcaccatgttagccaggctggtctcgaatctctgaggtcaggcaatccacctgccttggcctcccaaagtgcagggataacaggcatgagccaccactcccagccggcattaacatatatttgttataaaaaattaaaatccggtggggggaggggggagggataacattgggagatctacctaatgctagatgacgagttagtgggtgcagcgcaccagcatggcacatgtatacatatgtaactaacctgcacattgtgcacatgtaccctaaaacttaaagtataataataataataaaaaattaaaatccaaaaatattaaaagtacaaaaaatattacaagctgtactacacagcaaaaattacccttaatatttttgtattaaacttctaggagttctgtatgtgatacatacacacttaaatccacataattaaggaaagaaattctactacatacataatattctaaactgctagagggttttattgaataataccctgtaaacaccttgacatgtcgataaacatataacttcatcataaattttaatggcaacagaatgaactatatcataacttaaataattttctactgatatataataataggtcccaattattcactattataaacaatgctgtaaataatgaccttttatctgtatttttagacttgttctcccaatttacttccttaaaataaattcctaaaaaaaaaactaagatgtgtacttttcagagtttttgaaatatactgtcaaactgtcctctaaaaagtctggatgaatatatactcatattaaagtaactgagagcatctgtgtgcctacaccctcaatgaaactggatgctgtcagtattttttgtctttgccaatatttgaggtgaaaatctagattgcattatttctggtcattagtaaggctgaatatcttttcataggtttattggtatttctcttttgtaaatttctggttcatatttttgctcattgttttaaaaataatttataagaactattttaaaaacataaatccactactttattcaatttgaaaagtaatatgctcacaagttaaaatattcagtcatgaagggtataaagtaaaggcctttctacctattccttcaatctctatttctacacttcaggggtagccatggttaattacatcaatacaccttcccagaaatagtatatacgttatctatgactaccattttgcattattacataaatggaatactactattcacttttctgcggcttagaataaaaaccaaactcctaaccaaggcctacaacattctataatctggttcctgaaaacttccaccacctctgcaccactcttgtccttgataactctgctcctcttctcactttctattttcagcttcttgaacatgctaagttcttgcccttctcagagcccttgatcttgttcttccctctgcatgggatactgttttgttgactggctccttatccttcatgtctcagataataaacgttatttccttacggagattttctctgatcaccttatctaaaattaggaccccccattcatcttagaatgtcattctatatatttcctttacagaatttaacattaatcatgatgtttgtttatttttgattaccttccctcccacgtactagaatttaaatcaacaagctctgtttaaaggcagagcaatgtctatatctttttttttttttttcttagatagggtctcactctgtcacccaggctggagtgcagtggtgtgattagggcttactgcaacctcgacctaccaagctcaagtgattctcccaactcagcctccaaattagctgggactacaggtgcacaccaccatgtccaagtaatttttgtattttttgtagagacgaggtttcactatgttgccaggctagtctcaaacttctgagctcaagccatccacctgcagattacaggcatgagctttgggattacaggcatgagccactgtgcccggtcaatgtctgtatcttgctattattggattccaaatgcttagcatggtggccactacaaaacagtggctcaataaaccaggcacagtggcatgcacctgtagtcccagctacttgggaggctgaggtggaaggatcgcttgagcccaggagtttgagtccagcatgggcaacatagtgagatcctgtctctaaagaaaataaaagaaggtgctcaataaatattccttgataacgaaataaaaggatgaatttaattctttcactaacagtattccttagagaactttccaaaacatgtaactgtagctcatctgtagttcatttttgtgatcagctgcacaattttgttatataggtatatcataatttatccaaccagtcctttattaatgtttgacatagccctcatatccttctcttcaaattagtttctagttgaaattaaatccctatacatcagatttatacttctgaccaatatagagtaacagggactagattaccttcttgtatgaaacaaccagaaacagataaaatacatgaaacaacagtttgcaggaaactgaacatcaaataacaaagttgaaaaacaaactcagtgagtcttgtgattgccccagcttactgccttgggacagcttctaggatacaacaataaggaggagtaatccaggtggagcctggcaaactccctaagatgagaagatgcaactgaaagctcagggagacaaaagtggctagagtgctcaggagaatattctggaagggagagagttgcacagagaactccagtgatctgcagaggaacccctcgagtatttagctaaatactgatcagcacatatgtgtgaggcttggtgaaaaaagtaccttaaaggattagaggggaaagtgccaggtgctcacacaggctgggaatagttcccgttcctacccaccagagtgggaaacctcaagattcataggcattgggtagagtactcagaaggatcttgctttaggagcaggggataatcagccctagaatgagcactgttctagttctgcctgacaaagtttaaatgcaagacttgaaaggatcgaacttttccaaggatgtaacttaactgtgccttggttaaacaaaggtcaagaatacaggaacttaaaaatatccagcacccaacaaggtaaaattcacaatatctggcatccaatcaaagttagcaggcatgcaaagaagaaaaaaaaacaagacatatacttttacctccagttagggacatgtgaaaatagtcacaaatattttcctcatatacctgtgtgttccaatccttttaactttagataatgtattagttagtagtggagtactaatatttgtattctgagaactaaaaaaatttcaaaaattgctgtcatatattctaaaacaaataagaaacacacctatttttactagtttgagactagaagatgacttatttgtatctaatattgagctgatggtaatttcaaaagtcatggctatctttgacttttacattcaaattgcttaatcctaacagttaaacctctaattaaaaaaaatatatatatattttttgagatggagtcttactctgtcacccaggtagagtgcagtggcataatctcggttcactgcaacctccacctcccaggttcaactgattctcctgcctcagtctcccaagtagctgagactagaggcacgtgccaccatgactggctaatttctgtattttcagtagagatgaggttttaccatggtggtcaggctggtctcgaactcatgacctcacgtgatccgcatgcctcagcctcccaaagtgctgggattacaggtgtgagccaccgcctctggctgtaaaattacttttaatcatttgaaaatatatatgggatatttagtgtaaagagattctttaattttaaattgttttctatcttttatctcatataatcctctggtctttctagtccttacttctttgacatgtgtcaatgactatagataaccatcttcaaagcagaagaaagaagaggaaggcaagtaagagagaaaattggaagtactcttcacttaattaactaccctggcagcaactgcagtacacaatgacaaaatatcatttcctaatttaaatgaatgctaaaagtagcaaagtttgctactggaaagaagctatgtcttcttgagttttaccagaatcactctgacccctgttagttcacttaattgttctcacgggattctgggggtcaatcattcttgcttccagtgaaccatctttcctttggctccccttagttggactgaagcaagctaaaactttcagagagtttttactaaactctaagtgaaaaagaaaaagcaagaaatgtaaatatagagtacaggttgaagagaggttcaatcacaaatggccccttcctagggttcaagcacccctacccactcagtatggctaaaccttaggagtactcgcagagctttcccatcttcagttgacagtgttaccacaaaccagctcctaggaagcatcttgaagatagtggaaggaagatgctaggaagcatcttgagattattgtggaagagactaaaggaagcagattcttattatgtctatttaggattgttcctttccaggctgatccagaaaattttaagatgataacataaaaccattacccttaatgaaagattctcacatttccatggtagcaattacattgtatacttgcacacttaatgctttaaccatatcctaatacaaaatggaagaacagtattcatatcacagtataattaacaataaacttgtttcagtttccttccaatactgaataaattatctataacctaacatatcccaaatggctttaaaaaaacagtgaacttcttccaggcaagatggctgaataggaacagttccggtctgcagctcccagcgagatcaacacagaaggtgggtgatttctgcatttccaactgaggtacttggctcatctcatcgggactggttagacagtgggtgcagcacacagaaggcggccgaagtagggtggggcattgcctcacccaggaagtgcaaggggtccgggaactccctctcctagccaagggaagccatgaggggctgtgctgtgaagaatggtgcaccctggcccagatactacgcttttcccacggtctttgtaacccacagaccaggagattgcctccggtgcctatgccaccagggtcctgggtttcaagcacaaaactgggtggccatttgggcagacactgagctagctgcaagagttttttttcataccccagtggtgcctggagtgccagcgagacagaaccattcactcccctggaaagggggctgaagccaggaagccaactggtctagctcggtggatcccaccctcacagagtctagcaagctaagatccactggcttgaaatcctcactgcaagcacagcagtctgaagtcgacgtgggatgcttgagcttgggtgtgggaaggggtgtccgccattacagaggcttgggtaggccgttttcccctcacagtgtaaataaagctgccaggaagttcaaactgggcggagccctctgcagctcagcaaagccgctgtagccagactgcctctctagatttctcctctctggacagggcatctcttaaagaaagacagcagccccagtcaggggcttatagatcaaactcccatctccctgggggaagatgcagctgtgggcacagcttcagcagacttaaacgttcctgcctggtggctctgaagagagcagcagatctcccagcacagtagtcaagctctgctaagggacagactgcctcctcagttgagtccctgacccccgtgcctcctgactgggagacacctcccagcaggggtcgacagacacctcatatggtagagctctggctggcatctggtgggtgcccctgtgggacgaaggttccagaggaaggaacaggcagcaatctttgctgttctgcagcctccgctggtgataacaggcaaacaagggtctggagtggacctccagcaaactccagcagacctgcagcagaggggcctgttagaaggaaaactaatgaacagaaaggaatagcatcaacatcaacataaaggacatccacacagaaactccatccgaagctgaccaacatcaaagaccaaaggtagataaatccatgaagatgaagaaaaacgaacgcaaaaaggctaaaaattcccaaaaccagaatgcctcttctcctccaaaggatcacaactccttgccagcaagggaacaaaactggacgcagaatgagtttgacgaattgacagaagtgggcttcagaaggtgggtaataacaaactcctctgagctaaaggagcatgttctaacccaatgcgatgaagctaagaaccttgaaaaaaggttagaggaatgctaactagaataaccagtttacagaaggacataaatgacctgatggagctgaaaaacacagcacgagaacttcagaaagcacacacaagtatcaacagccgaatcaagcagaagaaaggatatcaatgattgaatatcaacttaatgaaataaagcgtgaagacaagattagagaaaaaagaatgaaaagaaatgaacaaagcttccaagaaatatgggactatgtgaaaagaccaaacctatgtttgattagtgtacctgaaaatgatggggagaatggaactaagctggcaaatatacgtcaggatattatccaggagaacttctccaacctagcaagacaggccaacattaaaaaatacagagaacgccacaaagatactccttgagaagagcaaccccaagacacacaatcgtcagattcaccaaggttgaaatgaaggaaaaaatgttaaggacagccagagagaaaggtcgggttacctacaaagggaaacccatcagactaacagtagatctctctgcagaaaccttacaagccagaagagagttggggccaatattcaacattcttaaagaaaagaattttcaacccagaattttgtctccagccaaactcagcttcataagcgaaggagaaataaaatcccttacagacaggcaaatgctgagagattttgtcaccaccaggcctgccttacaagagctcctgaaggaagcactaaacatagaaaggaaataccggtaccagccactgcaaaaacatgccaaattgtagaccatcgacactatgaagaaactgcatcaactattgggcaaaataaccagctagcatcataatgacaggatcaaattcacacataacaacattaaccttaaatgtaaacaggctaaatgccccaattaaaagacacagactggcaaattggataaagagtcaagaccctttggtgtgctgtattcaggagatgcatctcacatgcaaagacacacataggctcaaaacaaagggatggaggaatatttaccaagaaaatggaaagcaaaaacagaaggggttgcaatcctagtctctgataaaacagactttaaaccaacaaagatcaaaagagacaaagaaaggcattacataatggtaaagggatcaacacaacaagaagagctaactatcctaaatatgtatgcacccaatacagcagaacccagattcataaagcaagtccttagatacctacaaagaaacttagactcccacacaataatagttggagactttaacaccccactgtcaatgtcagacaaatcaacgagacagaaaggtaacaagaacattcaggatttgaatcagctctggaccaagaggacctaatagacatctacagaactctccaccccaaatcaacagaatatacattcttctcagcaccacatcgcacttattccaaaattgaccacataattggaagtaaaacactcctcagcaaatgcaaaagaatggaaataataaccagcagtctctgagaccacagtgcaatcaaattagaactcagggttaagaaactcactcaaaaccacaaactacatggaaactgaacaacctgctcctgaatgactactgggtaaataacgaaatgaaggcagaaataaataagttctttgaaaccaatgagaacaaagacacaacgtaccagaatctctgggacacagccagagatttagagagaaatttatagcactaaatgcctgcaacagaaagcaggaaatatctaaaatcgacaccctaacatcacaattaaaagaactgagaggcaagagcaaacacattcaaaagctagcagaagacaagaaataactaagatcagagcagaactaaaggagacagagacacaaaaggcccttcaaaaaatcaatgaatccaggagctggttttttgaaaagatcaacaaaatagacagactggtagccacactaataaaggagaaaagagagaagaatcaaatagacacaataaaacatgataaagtggatatcaccactgatcccacagaaatacaaactaccatcagagaatactagaaacacctctacgcaaataaactaaaaatctggaagaaatggataaattccgggacacacacaccctcccaagactaaatcaggaagaagtccaatccctgaatagaccaataacaagttctgaaactgaggcaataattaatagcctaccagccaaaaaaagctcaggaccagacagattcacagccgaattctaccagaggtacaaaagcgagctgctaccattccttttgaaactattcccaacaatagaaaaggagggactccttcctaactcattttataaggccagcgtcaatacctgataccaaaacctggcagaaacacaaaaaaagaaaatttcaggccaatatccctgatgaacatcgatgcgaaaattctcaataaaatactggcaaactgaatccagcagcatatcaaaaagcttatctgccctgatcaagttggcttcatcactggggtgcaaggctgtttcaacacatggaaatcaataaatgtaatccatcacataaacaggaccaatgacaaaacccacatgattctctcaatatatgcagaaaaggcctttgacaaaattcaacagcccttcatgctaaaaactcccaataaactaggtattgatgggaggtatctcaaaataataagagctgtttatgacaaacccacggccaatatcatacagaatgggcaaaagctggaagcattccctttgaatactggcacaagacaaggatgccctttcttaccaatcctattcaacatagtattggaagttctggccggggcaatcaggtaaaagaatgaaataaaggtcattcaaataggaagagaggaagtcaaattgtctctgtttgcagatgacatgattgtatatttagaaaatcccatcgtctcagcccaaaatctccttaagctggtaagttatttcagcagtctcaggatacaaaatcaatgtgcaaaaatcacaagcattcctatccaccaataatagacaaacagagagccaaatcatgagtgaactcccattcacaattgctacaaagaaaataaaatacctaggaatccaacttacaagggatgtgaaggacctcttcaaggagaactataaaccactgctcaaggaaataagagaggacacaaacaaatgaaaaacattccatgctcatggatagaagaatcaatattgtgaaaatggccatattgcccaaagtaatttatagattcaatgctgtccccatcaagctaccactttcttcacagaattagaaaaaaactactttaaatttcatatggaaccaaaaaaaggtcccatatagccaagacaaccctaagcagaaagaacaaagctggaggcatcacactacctgacttcaaactatgctacaaggctacagtaactaaaacagtatggtactggtaccaaaacagatatatagaacagtggaacagaacagaggcctcagaaataatgccacacatctacaaccatgtgatctttgacaaacctgagaaaaacaagcaatggggaaaggattccctgtttaataaatggtgttgggaaaactggctagtcatatgcagaaaactgaaactggaccccttccttacaccttatacgaaaattaactcaagatggattgaagacttaaacgtcagacctaaaaccataaaaaccctagaacaaaacctaggcaataccattcaggacataggcatgggcaaggacttggtaactaaaacactaaaagcaatggcaacaaaagccaaaattgacaaatgggatctaattaaactaaagaacttctgcacagcaaaagaaactatcatcagagtgaacaggcagcttacagaatgggagaagatttttgcaatctagccatctgacaaagcgctagtatccagaatctacaaagaacttaaacaaatttacaagaaaatataaacaaccccatcaaaaagtgggtgaaggatatgaatagacacttctcaaaagaagacattgatgcagccaacaaacatatgaaaaaaagctcatcatcatgggtcattagagaaatgcaaatcaaaaccacaatgagataccatctcatgccagttagaatggcaatcattaaaaagtcaggaaacaacagatgctggcgaggctgtggagaaataggaacgcttttacactgttggtggtagtgtacattagttcaaccattgtggaagacagtgtggtgattcctcaaggatctacaaccagaaatacaatttgacccagcaatcaatcccattactgggtatatatccaaaggattatatatcattctactataaagacacatgcacatgtatgtttattgcagcactgttcacaatagcaaagacttggaaccaactcaaatgcccataaatgatagactagataaagaaaatgtggcacatatacaccatggaatactatgcagccataaaaaaggatgagttcatgtcctttgcagggacatggatgaagctggaaaccatcattcttagcaaactaacacaggaacagaaaaccaaacaccacaagttctcactcataagtgggcgttgaacgatgagaacacatggacatagggaggggaacaacacacactggggcctgtcgggggggtgagggtctgggggagggatagcattaggagaaatacctaatgtagatgacgggttgatgggtgcagcaaaccaccatggcaagtgaatacctatgtaacaaacctgtatgttctacacttgtatctcagaacttaaagtacaatgaaacaaaagaaaacaaaacaaaaaacaaacaaattaaaaaaaaacagtgaactggactggaaaaaaaaatccttggttttggctggaaggccataggggctttcttctttcccacttccctgagaggcagcagcaggtcagaaggccttcagctgaggtcaacactgttctcagcgtcctccctatgtagactttgacccttgatatgcatatgtcctagcactgtttctaaacccaaaggtcccttgataatgtttatcattactcagaaattaagtgctttctactctttctcacactaatgcatacagggcaaggtgtggggtacagtgtttcgtctcttggagtgctcttgctgcatgtccaagtcctgtggaatcattatggaggctgggaatcctgtgtacggttacttctttgcttgtaggttactctcactaacaaactttgctgctattagcaccatgtgtgttagtggtttgtgtaaccatcttgtactacagttggtgcccaacaaagtcccgatgtcatggctttctgaaagaggagaacccatgggtcaaagaatttctcctggggacagtggtaattcacttggcagttaggatggtctcagtagctacgcctgagaatggcagaagccctcaagtggtaaagagggtttccagtggcttgaaattaagttctatctcttctccttatcagcttagagattttcaggagtacaaattggtagggtgcactagaaagggtgtggtagtctctctagaagggaaggtggggcaaattcccactgtttatctgtaatatgaggcaactggtcctgctgtatgtgaagccagttactgtgaggcacggtgtacaggagcctgagtgagaacaccagcaggaggagatccagcattatacagagcaagagcaagactcttattagctccactactgtagggatagtagaggcttggcctgctaatttgcatggttaggagacaacagtgttgttaagggaagctgagtaaaaggaaacacatgacctggttaaacaatgagcagtctgggttgactaataacactggggctgatgttgtaaccctgcttctaaactggatgcttggtagcatgggtaatacgtattaccattggggtgattttcctgccacttgaatgtgaaatggactagatccacagatagtgtagttactctaacacactctgagacaactggctgtgttagcgtaattataagaaaatccagggtttgagtagagaatccctgacaacatgctcttggtgcagagaatgttggatgaccgaatcagagcaggtcctcctaagtggacaactgctttgacttattccttcatctgggaggcaatgttggacatgaaatagttctttttaggtcatacaagccccacagcagaggcggaaatggaaagagacagggtctcatgagatgcacaggtttctgcccaaaatataaagaaagaaggaacaaaagaaggagtagaccgataggctgaactcaggcaatctccctcacaccaataaatgtgatattgctcataaacagaaggaatgataagacagaaattgagagacggcctaattcttgagtgtgggaatgtagtcctattcaaaaagttaaaagacccactgagactgtggaaaagggacatgtgagatgaaacatgatactgaatagtttacagacttgaataattattgggagaggtggagtcaccagaagattaggtgaagaaggtccctggggaggacgagggctattgagcttcatccacacaaactgataagatctaaaggacatagagacagggagatactctgcattatcttgactctggaagtggcattgctggtgggaatgctcctagtcatcagctccactttgtgagtttgagtcaactctagaagccaagcttctttgttcctaatctgagccctttcaaactcaaggagaaatacaggtgggctcagtcccctttactctcttccaagggatccctaaccatgtaccccagatgattatgctggaaaagagaagagcctccaatatttacgggtttgctagaaatggaggaccaagtatcatagctccagactgcagaagagctctggtaaacaagttcctcaactggggtttggagtccatgttacctatggctgaaagattagaattacaatcactgcaacggcttttggaccttttgcgtgaattctagttgtttctttatcagggtggggtaattaagtccacatgtcagttggactttttttcttttcgagacagggtcttgctctgtccccaaggctgaagtgctgtgatgcgatcgtggctcactgcagcctcgaactcctgtgcttaattgattctgccaccttaaactcctaagtagctggaagtatacctggctaatttttctgtagagatggggttccaccatgttacccaggctggtcttgaactcctgggctcaactaatcctcccacctcagcttcccaaagtgctgggattacaggtataagccaccatgcctagcccttagttagacattttttgtgacttctgttagtagcttctataactgttggccaggtatgttgccaaaacccacctgtacttacaaggtcggcagatgttgtgtgacactatacttacaaggtcggcagacgttgtgtgacagtgttgcacacctagaggtgaaacaggttgcatttcttatacaagaacagactcaggcaggggtactgcacaacaccatttcacaatttaacaaccccgtttgcctaactctgtttgacactagtactgcaagtgatctatgactggtctcaggcagagactctgatggcatgtgttagtttttgggtgtttgatctcctctagctaatgaatggtatacacctttggggttactgtgtctcctgcatttgcagataacatacatattatcaagacttaggtatattattatatattggggtttctagatatgatacaattaagcaatgaaagtgctttcacagctgctggcattctacaatgggaccatgtagaatggtattgccaacatggtactaagtggctgttctaggctcgttcttaaccacgggcagtatagaatgctggaatagcattctgaaagacagctgtacccatccttttaacaatgacttctataagattgtctggtccgggtgacctctgctgtttatactcataaaggtccctccactttggtgaagttccttggcacctgggagtcaaaaagcagaaacagacgaagaatctacttggtatgccaagacctgagtttttacacctcaatagttatttccttttgttgtacctgtcataatttcaacaggtggctgggaggtttgtgtgttcatattacagacaaatggatggatacaaacttggatgctctcctgacttcctgatgacactgctagctacacctacagaagggcaattttgattctctctttattccaaacattctaaatttctgttgtatgcttattctgcaagtgggagattttgctgcagtctctatacccatatagtatactctatccacagagtttctctggtgagaaagtgcaactcctgctttcatgtggaacttactgttgcagaaagaaagaacagaccacataggttgtccttaaagataatgatggactgtgcttgggcataaacgtgcctgaccaaaaaaagtgaaagtgtggttggagcatgaataactctctcttcacctttcttgcagatattaacagactgtaccaaataatcctctgcagcgatcccacacaatgacagtgcaaagctatcacaatgtgggatttgttatgcttaacatactcaactgtggaggaccttctggaaattctactcccagataacaccatgggaattactcctacctggtattaaccagagttctcatttgccctggccctccattaactcttcccttactagtcatgctgtgtaaaactctactcaacttctcaggtgcagaaaacacctactcttacatctcggctcccagtggatccatgccccacattaggagaaccccaaagcagcataaaactctcaaccaaatacttccacttcagacctgcagttgagtctaatagcatgccgacagtgtgttaaccccagaaaaacataaatgccaagtggatataaaatgtagcattaaacctctgtaatccagtggaacctgtcgtcttatgtgaaaggcatgcttaccctgcctcccacctgtaaataacactgcacattttggaagtactatgagacctttaatagtgactcaaaatctaagacactggtcacttttccagctgtggtctccagggctagcattagagcctatctgcaggtgtcaaggatacaagctttcattactttgtacaagggctcttgccttgaatagtcacctacgaagctgaggatatgaccagcaattgctatcatgggaaacgctgccattgagaaagcctgggatcatatcactgaaattagtattgcttccttgacatgagtaatattagagaattgcatagctttggactttttgttggatatgcagccagattgctcatgggagctctgtatctcctaatgctgtggtatattgtttgttttagaatttctctggctatatgactctttcagcactgtcaacaaacactgaaggcaccatttaaaatctaattgctttctattgcagatggggacgcatatatctagtgagccacaccaagggtcagggggtggactgagaaggaataaaccctcagtcttagctaaatgggcatgggggctctcttccttctcttgttcccaagacccatcagcaaacctgcttagccaccgagctgatgtgcagaggaacagtagggtctttagctgctgttctcaaagtccttggtttgtagatcctggtcctttgtaatgcaaactccctagtgttgttcctaggcccagaggtcctttgagatatatgttgtttcttagaataatgaaggacttggactaacctcgaaatatatagtggtatgaaggcagagccttctctttgagtgatcttgtttcttgtccagtctctaactggacaaggcacacccctgtggaaccactgtaggggctcagagatcccctgagtgctctgttacttatctgaagttatcatcaccaataaacattattgttattagcactgtgtgtaatgcttgtggtatatattaccttgcctcttgtacaacacgaatttaatttaattaatatttttctgtgaaggtaatccaatgtctgatatcttctccccataatattaattgatgttaatgttattataagaattttttaaaaacttgtacatttaatgttaaatctaacctttctttattaagaacacattatacttttaaggaacttttaaaaagtaataaataagcagctgggcacagtggctcacacctgtaatcccagcactttgggaggccgaggtaggcagatcatgaggtcaggagatcgagaccatcctggctaacacagtgaaaccccatctctactaaaaaaatacaaaaaaattagccaggcatggtggcagacgcctgtagtcccagctacttgggaggctgaggcaggagaatggcgtgaaagtgggaggtggagcttgcagtgagccaagatcgcgccactgcactccagcctgggagatagagtgagaatctgtctcaaaaaaaaaagtaataaataagatgatgacaataatgtatattgttaatgttgaattaactttcagcacccatttatttacagtagtttctactagtttgacacttactgatctttatcagccttgcctgtcagacacactacgtgctcatattatacacttgtatgttctctttgtcttcatacgtgctgtatctttccaattagattgtgagctttttgtggatagggacaggttaactgattcttttgcatcttgttttgctcaagtgatccccctatgccagcctcctgagtaactgagattacaggtgcacaccacagtcagccatatatatgtgattttagtagagacaaggtcttgctacgttgcccaggctcgttgtgaactcttgggctcaagcaatcctcctgcctcagcctcccaaagtgctaggattacaggcatgaaccagtgcacctggtcttcttttgcatctccacagcacttagtacaaggcacaatacaggtgtaaataaacacttgatgaataaatcatctgagttttttcctcattttaattagctgtaagataaagagaaggaatctatacctattatttataagttcttagcacatagaatacagcagacgtatattcccttattatttcattaatgtctattaatatgtctattaatgaaataaaaaacttcagaagaaaataaagtgaaaaattatccctacttccccctgctctgcaatgaccacaaataagagtataaagtacaactgctatttatatatcactttgcagttgttttagatccattatctgacatgatccttgtaacaatcgaagaattcatatacagcttattaatatttttttgcagaaacagaaatcagtgtccagagaggttatgtagaagagcctggatggaaatggaggtctaatatgtaaattcaatcaatgataatctgaaaggcctaaaaaaaaaaaaaaaaaaaaaaaaactgtctcctataagctattcttataaaaccttataaagacattaaattatttatttacttatttaaatcttaaagtattttaagtgtgcctgtgatatataaagtactatccttccaacactatggaaaattaaaagcacagatgaagattataagatttaaataaggaaatagtatatatattaatgtgctaaaataatggtctaattaattatctgcttttctgggagttcaatttcacgtttattaaaaggtccacttaaataagctgggaagtttgtggaaaagcttaggatttgagctggatcaagaaggatgggtgaaatttcgatggtagaagaaaagcagattattattataataaacaagatttggcaaagatgcaaggggaggaatacacatgtgttcagtgagtagactggactagttgaattctcattaacagaacagcataaagacagcttggggtcagaattgtatacagtcttgaatgccaggctaagtacatatttaactacatcatgttacaggttatagaggtcatttaaggtttcagagtagagacatgatatgatgacagaatgtgatggaaggagggaattgtatatagagaagttgaggacaggtgtaataatccaggtatacaatgataaagaactgatttcagtagtgttgcaaagagactgatttcaggtattttgaaggaaagttgatgtcctagatacttcaagtttacatgcccaagtgactaagaagaatgtggctcttaaacatattgaatatttaactggtctggggtagggctcagattgatcattttcttaagcttttcaggtgattcataaggttaaaaagccactcacctaggcattaaaaaaaaatctttgttggacatttgagttggttccaagtctttgctattgtgagtagtgctgcaataaacatacgtgtgcatgtgtctttatagcagcatgatttatattccgttgggtatatacccagtaatgggatggctgggtcaaatggtatttcaacccaaatgtccaacaatgatagacaggattaagaaaacatggcacatatacaccatggaatactatgcagccatagaaaaggatgagttcatgtcctttgtagggacatggatgaagctggaaaccatcattctcagcaaactattgcaaggacaaaaaaccaaacaccgcatgttctctctcataggtgggaattgaacaatgagaacacttggacacaggaaggggaacatcacacactggggcctgtcgtggggtggtgggagaggggagggatagcattaggagatatacctaatgtaaatgatgagttaatgggtgcagcacaccaacatggcacatgtatacatatgtaacaaatctgcacgttgtgcacatgtaccctagaacttaaagtataataaaaatatatatttattaaaaaaaaaactgctcttaagtctcctaggcactgtactaccttttttttttttttttttttttgagacgcagtctcgctctcttgcccagtggcacaatctcggctcactacaagctccgtctcccgggttcatgccattctcctgcctcagcctcccgagtagctgggactacaggcgcccgccaccacgcccggctaatgttttttgtatttttagtagagacggggtttcaccacgttaaccaggatggtcttgatctcctgacctcgtgatccgcccgtctccgcctcccaaagtgctgggattataggtgtgagccaccgcacccggcccaggctctgtacttctaaatgacccatacttttgtcattttaaattagatcctatactaaaactttgacttaatttcatttcaaacaacccctcctattgactgctctaattcattttaaagtatcattcatttatttatttatttagagacagatcttcactcctgttgcccaggctgaagtgcaatggcacgatctcggctcactgcaacctctccttgcctcctggcttcaagcgattctcctgcctcagcctcctgagtagctgggattactggcatgcgccaccacacccggctaatttttttgtatttttagtagagatgcggtttctccatgttggtcaggctcgtcacgaactcctgacctcaggtaatctgcccgcgttgacctcacaaagtgctgggattacaggtgtgagacaccgcgctcggccaaagtatcataatttttgttatgtatgtatatatgtatgtatttatttatttttgagacagggcccgctctgccacccaggctggagtgcagtggtgcactcttggctcattgcaacctctgtttcctgggttcaagcgattcttgtgcctcagcctccagagtagctgggactataggcacgtgtcactgcatctggctaatttttgtactttttgctagagacggggctttgccatgttgcccaggctggtctcaagctcctggcctcaagtgatctgtctgccttggcctcccaaagtgctgggattaaaggtgtgagccaccatgtctggcccataatttttctattgggaaataagccattaaatttatctctaatttccactttcctacattatactcaataatttcttacagcaattcaaccttcaagatccttctttctgtcttccttttatccctgtttgctcctgaggttatggcctccctacttcttagctgggttactgtaacggttccacagtcagtttctttactacttcttccaatccaatgcgtactttgctcccaggttatctattttagtgtaattcccctgccaaaattagtctctgttctccaagagctcacagtctagtggcagagatggccatctgtaccaaacattatgacaaaatgttaagtaaggtacataatgtttctcagctttgatccctctaggcacttcactttcataggttctgagcttactctttagtgcagaatcctaacattattagagatgcctctgggatcattcctgaattggaaagcaagtatacagaacagaggtctatttgtataagctagaaaattctcccaagtagatcaatcagaacaattcatttttgttagatattgagattctgcataacattttcatttaaaaaaaagtgatcccattactaaaaacaaaacccttaaaagcaactgctttatttatattttctattagagtcatctatatgattagccagtcttctctccccagtggactataaacatgacatggattctattttatacagctttgtgtctcctacagtgcctagaaatgtctagcacatagcaggcattcaaaaatgtgttttatcttccatgtctgatggggacaaaagtgttaatgttagtgcttacagattttcagaatgtaagaacatttttgcttccatgtaccaacatgagtcaatagctattctaaaatatataagcactaacataacacttttgtccccatcagaatttggcatttgaaaatgtccagacatggagctctgaaaagttaaattcgagaaggtttactgagcacataaatgcataatgcactctgctagttaatgtaacagaaatggagccagcgaaagaaatctaaaggtagaatatcatgaatttgtggtaacacaaaattcaaaaaaggaagaagtctgaaggagaaggaagtgatcacaaatttcaaacattaacaagatttgaaaaggaatgaggattatgatgaagatcttagatttaagcaagttacctgcagggggttactgtcaggatgtatgcttattgtaaaagaataaaccacttattgggaagtttgacaatgggaagaaagagaaatggagcagcagctataaaaggtaatatagatggaaatacaagtctctgtccaccaaagaaagaaagaacagcttatgtctgatgtcagaaagagtagcaaaagaatatcaagggctaggaggaagtgtgtatcagtgaaggggcattatgagtgcaaaaggaatgagaattaaggttttacatgtttaccaaacattgattatgggaacacaaaatatattgaagaagtaacagagttttaaaatatatagtttcttatttaacaatttgtatcggattatgagttctaaccttcaccactctccatgccttctacaaaaatccccccacattggggaagaatccagtaccggcgtctgtaacgatcttggccaaacatcactgaacgcaatgagtgagacgcatcaaagagcttccttctgtactgactctgttgctgttaaaaaaatggtacatataattaggtttgggatgttaaatgctttaaaaattaatatatatgtaactttatacttattgtacctttaagcacataaatttcactactgggaaaagagcaaaaggtctaaatattcatgcctgacttcaatttcagtaacatttataaagatagaaatcattttaaggataattatttttgttgccatggagtaaaaggataagctacctgataaaataaaacttatccttttacttgataataaacaatgggatcaagtattttatggagccaaagcaaactggttcaattcaattctattgcttacagtatataacaaataatacatataatatggccaggcacagtggctcatgcctgtaatcccagcactctgggaggctgaggcgggtgggtcatttgaacccaggaattagagaccagccttggcaacatagtgagaccccatctctacaaaaaatatgaaaaatcagctgggcacggtggcacatgcctgtagttccaccaccagggaggctgaggtgggaggatcgcttgagcctgggaggtcaaggctgcagtgaccacgccattgcactccagcctaggtgccagagcaagactctgtttcaaaaagcaaagcaaaacaaaaaacaaataatatatatgtaattggctaaacctgtatttgcctatgtttacactcatgttgtaaacctagacaacatataattaagttttgggataggtctgtgaagaatctaatattaataccatacacaggcatctcgtaatacctttgaaaactcatttttgttcttataaaaagctcatcttaaatttcactaatgctatgaaattcagtttttcttagtttttttttcttttttttttttttttagagacagggtctcgccatattgcccaggcttttctcaaactcctgggctcaaacgatcctctcacctcagcctcccaaagtgctgggattacaggcgtaaaccacttctgaaatggaatttttaacaagatgtatgtaaatacatccacagtttacaaatccaatgcaaataaaacccacaaatatacaaatgtaaaataaaacctaagatgctgaaactgttactatgaaattcaactgaattttttagtaattaattccaagaaataaaactatgccttaattgacattttgtatttatatgaagagctgaagagtatagaatattttctttctaggctctgattaagttcaatatcacgttttaagaggcaggcttttaaccttggcattaagcttgtaaagttcaattgtaagaatgtttctagtgttcctcatcttatttttttttctgacaaaaatgctattcagaatcttcatttttaattactcaccaaaagcctatttttgcttagcagtcagaaaaactaatccccttacaatgtagatttctaaaacactgtgaagaagttaaatgttaatcagaaaagtgcttactttactcagtttttcaatctgtttttccagctcttcaacacttgctgcttggtcaccttcatcctatacataagaaaatacagtgtcatttatctgttttaagatttatttattcaatcagtaaatatttaatgaaagtctcctataggcactgcggaaaggtattaagactcagttcttttctataaactaataatctggtagagagatacataaaacattatgtttaaaaaaaacacaaaaacctaggtatggtagctcatgtctgtaatcccagcactttaggatgctgaggtggcaggatcatttgaggccaggaatttgagaccagcctggacatcatagtcagacccagtatctacgaaaaataaaattagcttagtggcttgttcctgcagtcccagctacttgggaggctgacacaggaggattggttaagcccagaagttcaaggctgcagtgagctatgatcatgccactgcactccagcctgcagaccctatccccagaagaaacaaaacaaaacatagcaaaccacacacacacaataaactcccccaaagcaggaaagtataagggtctcaaagagaggtagtgattaaaacctgtgaagttcaaggcagagtaagactacttttagtggaaatgtataccaagggaggctttatgaagaagtcatgttttaattagctactaaagaatggttagaaatgcatccagcagagaaaagagtctgacatgtcttgacatgagaggtgcataaagaggtaaggtaggagatgaggcaagatgagtttaaggctagattttgaagagctgtaaatgcttggcaattaacaaaatgatcctttgagggtgggttaaatatcagaactatgctttccaaaggttgttctggcaatagttgtaagatggtgtggagcagagaaaggattaaaattggtaaaactagctaacagattagagaaggagggatatggttcttactagcataaaagaaataaagatggaaaaaagcaaatggatgtaagagatatcacatagttatagagctgttaagtcttgccagctcatgaatatgtggcacagaggggcaagggagatgatggaataaataaattatgatgttaaggttttaaatctaggagactggaaaaatactgatactatcaactgaaggagttatttttgaagggaagaagattagttatactatatacttgatatacttgaacacattgagtttttagaataaaaataattcctaacatgcatagtcctaatttcataaatagaaggtttgtaagtaattgtgtgaaatttgtcattccagaaaatgacaacagaagaactatctccaaattgtaggttttagagggaaagcatgaacagaaggtacacgggtttctttggatcttatctgcactactagacataggcaaattacttaacctttgtaagtctattcatctgtaaatttggtgataatgttacctactacatgaaggttttgtgaggactaagtaagaacagatctgaaagtaaccaacagtgttcctactttaataagaagatgcaggtacagcccagattaaagaaaaataacaacttgtttttgatgtttacttcctataagcatttataaaaagccacactgtcaccaaccacacacaaatatatatttctgaccagtatggctactacccaatgaaaaaaaaagtgaaaaaaagactcccatagttgtaccattatctctcattcatccgctccttacccaaacttagggaacccagttacaaaggtatttaggcacattatttgtgctaacagtaacatgaattctatttggaattaaaagaaaactcaaaagataactagctcaacaactcttaaatcttgacttttatgtgaatatttatatatagattctaaaatgatcttctgatcagcaggacaaatgtctgataatctgttcatgcaaaaatacagttcaatcaataaatattcaaaatagatatcaaatatttgaaaatgccatgtatcagccaaatattctaactgcaatttttaagactcttcctatgatgcaaaaagaaataaaatgtctcctaaagttttatttaaaggagttttggctaatagtacttaaaattttcagacattaaaaaaaccttggaagaatagacagaaaggtagtagcagcaacaacaactaagaacacagaatctatcccagtcacagttccccaaccaaaaaacagcatcattatatgtccctatatgtcagagtttaattgtccacagaacctctcacaggccaacttgtgaggttaaactcccataggtctcaacacaactctacggaatgaaggaatgaagagtgaggagaagagggaattctctttgagataaaggggctatgatctagtcaagggcagtatcttctaattgaaagggatcctatgggtctcaataagaaaacctccctgccttaaaggaaaaatcaatcctttaaggaaggtaactaccaataccctacttaaaacttaactgagaggccaaatctattttttgagaactaatgtgcctaacttatcaatttcattaagtagtcaaaattttacttacataggaaattgatgtgtctgccagttctttattataaagaataattcaaatcatttaacatgaaatgttaatttgacttattaggtcctaatatttattactttataaaattttgaaattgttttctcacattactaacaaggatctacctttgccagtgaaatcctaaaatctatttaactctataattcaacactcataaaaaagtgaaatatggctgggtgcagtggctcatgcctgtaatcccagcacttcaggaggccgaggcgggtggatcacgaggtcaagagatcgagaccagcctggccaacatggtgaaaccctgtctctactaaaaatacaaaaattagctgggcgtggtggcaggcacctgtaatcccagctactcgggaggctgaggcaggagaatcgcttgaaccaggaggcggaggttgcagtgagctgagatggtgcccctgcactccagcctgggtgacagagcgagactctgtctccaaaaaaaaaaaaaaaaaagaagtgaaatactaccttaaatgacacatctcctttaaaactttaataatgattttcaaatagtctatgtgtaaagaataaaatgtatggtttgttagttctctgttaaaaaagaaaccaagtgaaacaaataatttctgtaaataaattctagtttagtaagataactatacaggggaataaactaaaatcccagtacatagttgtccaagttattgaacttatgagttaacactttaaaacaatttataatgtgaagtgctaaaagaggctactaattctatgaaaaggtgattaattttggtcagaaaggcttaattcctgctatggaaacagctccacttgccaaatgaagcagattgcttataaatgttatcttttgtttgggtaattacacttctgatactcaaattatatacccttcatattatttgtcacagatgaatgtacataattcagtagtttcaaaagtataatattatgaaataaattatttctgcaaggaatctcaatgtagtctcattttcagattggtactcttaaaagcagtaaagttaaattcattacaatgagttcttgaatatgacatgaaaaacacagggaataaaagcaaaaacagacaagtggcactatatcaaattaaagtgcttcttcatggcaaaggaaacaacagactgaaaagagaacctacaggacaggagaaaacatttgcaaatcatatatttgataaggggttaatatctaaaatatataactcttacaactcaatagcaaaaaccagataaccagattttaaaaatggcaaagaacctgaatagacatttttgcagtgaagacatacaaatggccaacaggtatgtgaaaagatgtccaacatcactaatcagggaaatgtaaaatcaaaatcacaatgagatatcatcccacacctgttagggtaattactctcaaaaagaaagagaaagaaagagacagacaggagtgttggcaaggatatggagaaattggaactctcatacactgttgggagtgtgggattgtaaaatagtgttacactgttgggagtgtgggattgtaaaatagtgtaaccactatggaaaacactataaaggctcctcaaaaaattaagaatagaactatctgatcctgcaatcccacttctgggtatttattcaaaagaactgaaatcaggatattgaagtatttgtgctgtcatgttcattgcaatgttattcacaatggccaaatggtgaaagcaacccaagtgtccactgatggatggatgaataaacaaaatgtgatatatatatacagtgaatattattcagccttaaaaaaatcctgccataagtaacaacatgggtgaaccttgaggacattatgcaaagtgaaataaaccagtcacagaaagtcaaattctatatgattccaattatatgaggtatctaaaacagtcaaactcatagaaccagagagtagaatggtggttgccaggggctgggaggacagggaaattggggagttcctatttaatgggtgtgaagtttcagttatgcaagatgaataagttctagaaagctgttgtacaacctcatgcccatagttaccaacagtgtatactgtacacttaaacatttattaagagggtgaatcttacgttaaatgttttaccaaaattaacaaaaaagaaaagttcattctaataaattttaccattctgatttaaaatacaacattggaaatggagaatttatgacaacattttgtactcatgatatttttacttaagaaagagaattatgtagcatattataaattctacattgattcataaatttgattatcattggttccaactagatattattttcacacattccatcgataaattcatctctcagctttctttcacattccattgataaattcatctctctaagctttctttatttctccagcattactgagttgatgcaataagggaaaagagttctttctagacttccttagctaagagctcttagcattgagggcagaagaaatagttagctgcatgttgttttttgaggtcaattccacagccctatctagcattcttttctgataaaaggtgaacttcaatcttttatatgtgtccattttcatgacttatggtagctttccctaaactcatatacatacacacacacacacacatccctctatgaccttgccttcttccctttgacctactcttcaaaggtagctccttcaccttgattgaagcccctccaaaatctttagaaccttataccacagtgctttttaaaatttcttttatcttaaatccccttctctcattttattgactcttttctttccatcaaaaatcatctcgtctttaacatctgtaaaatccttggctccttctcctgctctaggaactccctgtcttctgaggcacaatgcttgaaatagtcatcttcattttctcactttctattgtaatcaatcaattacagcctggtaggtgtgctcatccctctaataaaactgtgttgacactggttaccaatgacctctatgttgccaaattcaatcaacatttttggtccatatcacactgctttaacactgtttatcactctcctttttgcaatgtttgattttcttgattactgttattattacatgtgtagaaaagacttaacatagcaggcctgattggtatcctctggaaggccttcttacaaggttggtccttggcctggcatatgggaacttggattttgggagggttaagatgagctcttaatatggacctgaactatttgcgctaacaatgtggattatgctgaatacctgcttttcttcagggaatctgatattttggcacatgctatgcagagggtacctacaggtaccagcccccagtaaaaacctggacactgagtctctaatgagcttccctggtagataacatttcatgtatgttgttgagtgaattaagcctgtcctgtgtgactctgctgggagatgactcttggaagcttgtatctggtttcctctggactttgcccatatactctttgctgattttgctttgtttccttttactgtagtaattcattgctataagcacaagtatatgccgagttctgtgaatcatcctagtgaatcactgaacctgaaggtggtcttggggacccccaactcacagaaatctctaacctctctgctcttgcttcttgaacaaggagccttgtgggctcctattaaatactgatgttccctgaggttccaacctcagtccactactctattcactaaaccaatccccctctgtaatcttattacctcatgattttaaattatcatctacctgataataacacccagatctatatttctaagagcaaactcttcttcaggcctcagattcctaaatctaactgactgctaagctcctatacatgggtacctcaaactcagcaagtccaaaaataaataatcatttcctgtcttcaattatctgttcctttacctccccctgcccccaattatctacttactctgttcctgatttccctattttagttaatggcaacaatagcatgaagtcttccaaaccagactgctggaaatcaatcctaccactctaacaacctacatagtctaccttccatcttcaagtcctgcccattcttcctcctaaatatttattaaatcatttcctccctcatcccaactaccattgctctagtttctacccctcacaactcatctaaaccattgcagtatctcctgactgatctctgcacttctgatgttgccccaccttttgtgtctttctcacagctgccagagtgagtaacttaaaaattaatgctgaccatgccattctctgattataacccttcagtggcttcctgccactaaaaaagcaaaagatcctagttcatcattgttgcatatgagactccagtaacactgaagcacttgcaatccccttaaagcacattgtggtttcctgcttctgtgcccttggtcatgcatttctctctgcctggaacactcttccctagacctttacccaggttaatgttcagctcagcttatagcctgagctgatgggtccagaaactctttgtgggagtttattactcagaaagtctaaatgctcttaagttgtatctgcctagcacattgtcaatacccctctcaaagcagttatcacattatgttttctttttgcaaatccttctcagtgagactgtaaattgagatgggactttcagtgccttattcgtctttgattaaaaatacctagaactagagaaatagtaattggtgtttgaggaatacattattttcactaaacctgacaacacttttaaaggcatgaagcgctgtacaaatgtaacacagtatgttaacagaatgaaacaaaatacctgaaattaaaaatctgcatatctctttggagaattctcaagaaattatattaaaaaaacttcttttattcagtcttagtgtcttttatgtatagacattctacaagatatttacataaccatcacaaaaatctttatgggatacagattgtaatatttgtttttcagatgaggaaactgaggcaagtaaatgtcaaaactgaattcaaatccgaatccatctgactccaaattctgtttttaaaaatatgttatgcagttctagttgtcttaaaatcaacctaaatttcattacctcatcttcacagatatcagtcttttttccttttttgtcttctttatcttcttcatcctcatcatcttcatccccttggtcatcactgtcatcgtcatcatcatcgtcataatcactgtctcctcccttccttcttcgcttgcgtcctggagtgggtgtgcccaagggatgctgctcttctcccagatcaatgccacctgaagtgtctcttttgcctgttttcttagcatgaatgattctgagcctttaaatattatgaaaagtgatgacaaggaaaaaaagacttctcaatatacttttaaaagagcaaaacatgagttgtatgcaaaaataccttatggcatttcttttgtgttaagcgatataccaatgttaaaaaaaattagaattaggaaacttaagaaatgtttccataaattacaggatgcattcactttcaagagttattctagatatctctttggaattagactcattaaaaaaaatgatgaaagttgaaaagaagaattctaacaatggctgagtaataatttctgatcccatactaactgactgaataaatttcaattcaaattactacaaagaaactaacctcttaacataggagtaatttctgcctgatattttctggcaggaagataattaagttttaatgctgaataagtttagctagattccgtaaaagcaaattttaattagaaagcaattaagaaaacaagttacagttccaaacattctgtttgtgataaaagcaacttaatagcaaccacaatcttagaaaatgtaattgcttgacttgtttaaaagaaaaagagaaaatgactttcttctaagtatgaagaatataagctcaatgaatctcattatatcttttgtccattgcaaattctgcccctgagttttattaattttatatcccatctaaattgagcattatcttttctttagacaataaaagtttaaattctatctttgcaattcatatgctttactgggaatttgtagaaaaagaaaacagtacattaactttaataaaacaggacttacttgcggagtttaccttctaccacccatttatctctcctcaagtttgacatataatcaatgttcttgtcgatttcactgccaatgcaagaatttattaaaaagtgtaaattaatcaatttatgcaatgcattaatttgatatgcaataaacttgatacgtaaattaatgcatttttgaataagtaaaaatgatacaactgacctcatgcatatacacgttcatatatgtatgtgtttatatatgtatacacagatgttgaaaagtgataacttcttcaatggatacaacattagtattagaaaattcactgtggtttctatcttaaaccaagaaagaaactatgcatcaattgccttagaaagacaatattccaagttttgttgcaggtattttaagatgtgataatttccaaaatcaaagcaggataccagaacacacatggatatttacataagtgcacatacatacatatgcatatacactaagtgtatatatataaacaaccaaacagtaactaagaatattatgatattctttaccattctgttttactttaccagtaaagtcaaatagggatgctttttcccttctaaggcaaaaaccatagtgtaccatttacattgaatttgggtgtatgtgttttgaataagtgccacttagcattactatttgttatcatgctcatgcttaaatgaaattattctttcataaaattgtaagacgtgaatattattatattttttaggatgactgtcagtgaatagcagaaacaaacaaaaaattacattaatacaatatcatagctaagataggtacagaaaacttaaaatttccacactggtagaaatgcatgaccccgaatatttggattgatcctttttctagaaaggtaaaggactaaaagttgttaaaaatctgtaaaataatgaataacaaggacaagatgaacatgaatttgttcagaaatcctgaatactagagtacatgttggtattagtattttactagtaacaagtactagagtgagaactctgacttttaaataggatcaaatgctttaaaaaagtataaattaatacactgataaataaatactctatggttctattagcatacaacaaaataaaaagtggctacgtaattctgtgaatggctactaagcaaaatcaggtagtcatctgtccttaaaagacgtgaaggaaaaaaaaattctgtattcttgtggtggtaccacattctggtaccatagcaactaaaaatataaaaaaagttatgtataaagaattaacagaattattaaacaaaacaggtgacaaagaccacgtattacagacacacagtataatccaaattttttttcaatacactacaaagaaatacatgaaaatattattagtggccatctctaaatactgagataagtacaattttaattttcttctttgtgctagtctgtaactttccaattttctataatcaatttgtattactttttgattagaaaaattcaaaatggaaaaatcacggaaaagcctgggcatatgctcacctgaccacactcttgctgcatgccagttcattgatcaggaaagccaggactgaagctttctgtgctggagtgtgagcctgaaaagctttggtcttcagactttcagtaagctcagtttgtccacagtgggcttccataaatatctgtaaaatctcggaaacattgtctcgattcacaccaacattcagcaaatgttctccaagagctgttttagcctataaaagtttggcatttttatcagtattactcacaaccatttataccataaaaacaataagattaaaaatcctcatattatttgatttagatactactgacaagagctttattcactttttttttaatgaaagagacacaaaaatagtcaatagaagacagacaaatattcaagtatttgtttctttctttccccgcttcaaatccttggttccaagtcaggcagggagaagagtatgcaaattcatgggtagcagaagttttaaattacctatcaagccttccatgactataaaagcgacaccaacctttccccaagtttcatctggatattttatcaggaatgacagagtggggaggttaaaaaacagtattgttttctacccttaaagtgttataggttttactggctggggataataaatagggaaacactgagggagatagaagaaaaacaggtgcatctgggaggttctctctccacaatattatctagagcaaagctccctggaatgtatactgtatttggaattaagataaacatgaacttattgaggatccactgagcagcacagggtcttaacgtgctggtctgtaggtgccttgattagcttcagttattcacagtgattgagagagaacaaggtataatatcagaaggcacatacaagttctagttgccttatgaattatgaattctgttgttgatgaatatcgcttaaggatttccttaaatcaccttggtctttgcctacagctagaggaaaaaagaataacttgagaatggtctacattccttaagctttataaccaggttttctttgtatgaagtgtaacctgacacaaatctacagttaactttgtgagacattatgtggaaaaattagatcaatctatataatcttctgctaatatgctaaagctatctaccaatgcactgacagtacaaatttaaaacattttatattttgtttttttttaccttgtatcctgttattagacctggatcacatacagcagctgagaggagcctcacaagcaagtcttgtacttcacccatgctgtcccctatatttagcaatccctcttgaagaacactcaggtttggaacatcaatattcacatcaaagcccaaaactttaccaaagtttcgtaagaactgcaccaccatgagacagtctgaaaatgtacttccagagagaacaagtcctggaatacgaggcaactctggcaaaggctgaaaataaaatgaaatacaaataaaataaaaacagcttaattttttaaaagccatgatttcgtatcttctaaagtaaaataagctgctaccttttttcccctcttgtattgtaccagtagcttcctttgggatgctaaattctctgggggcatttctgtaacccccatggaactaagcatagtgtcttgaagtatcttcatacaagtaagcaaccattaataaattttggttgaactcaattatgaacttagatctttgcaaaagagacattaattttaatcaacttgcatattcaatcaactgacatatccatattaacaaaacatggattatataactggagcaaaaattaaataaaatataaacatttcaaaagtactttaccatggacatacttataggggcatgtgcaccaatttcttctaatgatgatgacatttaaaaatcacactttttttgtagcttagaaacaaacagcatgcatctgtgggctctatggttggagaaagtggtaccatctatggctaatgaatgcagataaataactaggtccacataactagaatccatgaccctgtacataaacccagttataatgcaactaaaggtctttaggtttccctgtatttaggcaagtattagcttcagtattaaaattagctatctctgttgttatttctcaaatatgctcacatattaacattttaatgacttaattgcagtaccagttgtcatcaacattttaaaatttcaataaataggtaatctgaattaaaaacattttgcctgttaatgagagcctaaaaaagtactttaaattttaattggaaaaaaagtgacataaatatttctatttatctgaattggtccttgttcaaaaatatttctccactctgcatttattgaggtaaccaattgaagactttttctgttaatactgtgtggaaacacaaaactatagataatagctcatctcatacaaatattttatattcttcttgaaagccagttaattctcattctccctttttcttgaaccacaggaaacatatacatttctatgtaattctaaaaatttatgtagcaaagctgagctattaaaaatatggcttaaaatggacttacatatttgatatagtacatatgaatttaaatgaaaataaaagatacaagaaaatgaagctcacttaggatttaaaaagcttgatcactatgagcttattaaatgtgttaactaatttatatacccattctctgcttaggaaaatttaaatatccaaatgactacaactagtaagtatactctcatttttatttagaagcatttatgctaagtaaataaatagaatattaatatagttcaatccattctagagtactaaaagttttctttaagcactttagaaaagagcttacataattgagttaatgggtgcagcacaccagcagggcacatgtatacatatgtaactaacctgcacattgtgcacatgtaccctaaaacttaaagtataataataataaaataaaataaaaaaagagcttacataaatcaagagataatcattatttgcaaatcatttgaatattgcatataagtaaatacatatcctactaattaagtataataatatagagatgaaatgcattattgatatttttctagaagtaccatcttcttaactatagtcaaaacatcattgatttttactcaaaagtatatgaaattatgctggttgccaagattacagcaatgtttctaaatttatacttttatgtatttcagcaacattacatgtctgtgaagcactatggaagacaaaacacatatgaggtgctttggttggacacagtttcttggctttcaggatgataaacagtataggctctggagtttaacaaactggagtttgaatccaaatcgccatttattagttgtgtaatcttgggcaagttccttaacctctttgtgtctcagttttctcatgtataaatgggaagaaatactaactccacaagattgtattgaggattaaatgagaaaattcaaataagtgcttagcacagtcctagcatgtagtaaacatgttcaataaaggtttgccacctaaagcactgaaggaggtcacagattataaatcctcatttatttaaatatccatagggatgtggggaggagttgagatttttctgtgcctggaatcccagaactttgggaggctgaggtggctgtatcacttgagcccaggagttcaagaccagccaggacaacataagagtctgccgctacaaaaaattaaaataacaaaaacccaaaaaactagccaggcatggtggcaagcgcctgtggtcccagcaactcagaagactgaggtgagaggaccacttgagcctgggaacgagaagttgaggcttcagtgagctataatcctgccactgccctctctccagcctaaatgacagagtaagaccctgtctgaaaacaaccaaccaaccaaccaaccaaccaaccaaccaaacaaacaaacaaaaaaaccgccattaccagcacaagagctccagagaggtttacttctagctatctaggaaaggcaaattgacctagagttggaaattcactgctatagttaaaaatgaaaggctttcacaatagcagctctggcaaagaaatcaggtaagaaaactggaaaaattaaacttatgaatgaaatggtgtacatgacgtataaattaccttttggtctgctaagcacatgtcttcattaggcttctttagttcctttgccatttctaattctaatcttcgctgctctagtttacgctctttatttaatcttttctcatcacgtttttcttgtttcaaccgctctttttccttaaaaagaaaaccatgtacacatattcttcttaatcattatatatgttggaataaacttagaattatgtagcaacattgaattattttgcttttcattaatcttactctctaattttcaaaataatcttatgactgtatatatttaatatcaatattagatttgacctagactattttgttattcaaaatttgttcaatcatttgccaagttataagaataaaatacttattaatacaagcaggtacataaaatgaacatgggcaactacatatcttattaaataaagttattagcacaaattttagtgtggctccagcaagcaaatgatttacagcaggaaagtggaagtaacatgtttgaatttgcacaagtagttctttcaaagtgaattagctagtcttaagacagcacctgtgaggaaagaaaaatattattcaccaccataaacaacacttaagagaatgtaaaatcagttgtgaaggcaatgtcaaaagcattaagaatgttttggtaatggcaacaatatggaaataactgacttgtctctctgttgtagggaatgactttgttggagcaagtgattttctataataccattatcgttactttttcatcatatctcaaatatagctctcatttatttaggggagaaataacagtagaatcatcagtcagttctaacctactaccgcacacgtgccacacattgctaattggtttacttttgtaaggctgattatatctcttccttgattaaaagtcttttgattttctatcaaaataaggtccaagtccttacttttgaattccagactcttcttttctaatcttacctctcatatttttttctgtgtaggtttagaattttctattcctgatgaacatttatttcctcagctgcttatactggttcactccaatcaagatcttcatttttcccatcttgcatatttaaatcctaattaaacactaccaatttctattatgtttcatagctcttaactctgattttaacacagcagtcattgctttctgtactatattactatttttgcccatattctaatcatctccatttcgattatcacttgtaagcaagcaccctgactgctgctggagggaaggccaagagggagaaagagaggagtggagaagaacatgggatcagagagtagagaaagtacagtgtgtttgaaaaattgctagcagtttcaagactggagtgtaggctgcaagttgaatagttgctgaatattatgatagccagaggccagatcctaagggcctttttatatgacatgcacaagttactgttcatttttatactgcctctgaatttctgggttactgattcatgcagacattctgggaggacaaactataaggaagcttataagattgttgacaccagcaaagttctataattaattttaccaattataaaccaaaaagcagtttctgagggtttgattttcaaatcaaattattagttaatagcctgaagtactattattactagcccttacaaaagggcagcagagtcaccggtagaataacttttttcccctagaactgaaatttcgattcttaaacccatgaactgttgctctaagaactttccaaaggagggaagatttaagtttttggttcctcaccagagtaatgaattagcatcactaatagaaaaaagcatattaaatatctcttactgatttgaaagtagatactgtaaaattttttgctgcacttctatgccacgtgatgtttgtcactaaagaattgcatgtactacagtgtctatgccatatagcccagatgtgtagcagtctatataccatctaaggtttgggcatgtcactctatgatgtctgcacaatgatgaaactgattaatgacacacttctcagaatgtattgtcatcgttaagtgacacatggctttacacagagctaatccagatctattaatgatgtccataacagcaattataaacatcataattgagactactagttactaaagttgttaaaaatggttgctattacttcttaaaaagagagaaaatccatgtgacactgatgctcttttcactgtgccaacttcccactggtagcaatcctggaggtacatacatactcaatagacacacggacaagctagatagagtgcactgaatgccataagataaatatggattatattcttggagtatcaattttagctggtgacatgcaatacttttttccacttgaaaaagtaaaatatggaatagaatgcaaaagtcatatcgatatttatgataaaatggagatttccaaaaaattagagaaatcggtgtgacctttatcagttaaagacaagcatttattactgtctactattaggcatactttaatggaaatgtggagtctctcaattcagcatgaattgtatagaactaatacaaattctgtggttatggtacaagttaactctgaaagagccagagcttccaaggtcccctcaaccaccaactaatatttataatggcatataaagccagtcacaatctagccccacacaagcgcttgtctcacatctcacaattcacagtggatttctcatgttccagcctcactgtatgacacacctgtgtggagaagacagcatagcccctttgaagttactgcttggatgattaatgacgatgaagcaacaacaaagccaagacgggcatgtacactaggttaaaatggctaataccctctttgtacccccacccccaggtcttgtttagtcacaatactgtacctttgtatatgccatacctactgtctagaatgcctagttcctcctccttcacaagaagtctgtataaagcctgttttttttttatcgttcccacaactacttcagacatggtagtacttcttgtttttgagcttccatataacttattatagcatttgttgcactgtgtagcaattatttgtttaaagttgatctctctcactcaagtataagcctcttctagagggcagaggaactaacttattcacctgtttcttcatggacctattcaatttcccccctggacacctggagaaagtttttaatgagtttatctttctctttgactcttgagcctgtatcagtccaactttcctctcccactggtctccatagtctaagtattgttcttacttctgactacagtagtgatatgactgtaatagatacatgcggtatgccatggcatataaaaattatttgagcatttataaatttgctgaatgattaattcttcaaatgacacaaactaaaattaaggtaacattttgaactggttattaaacgaattcaataggcaatttcttcttcacttttaatattttactctgtgggcaaacataattgctatcttccattttcagtcaagagtatttataaacctgtaatccaaaagtggaattaaatacatttattaagaatatttaattacatttagaaatttaaaaattatctaaaggcttttttgaaaagttaacatttgactgatgactgaacaacaaataggaaccatgtgaatatttggtggaaaaacagcaatagtacagaccgttcattcaggaataataacaagacaaaaatgatcagaatatagtgcataagggacaaattgtatgaagtaaaactggagtgagaggcagaggtcagtgggaaaatgccatggtgaggagtctgaattttatcgtaattgcaatgagaggcccctggatagtgtcaggatatgatctggtttactttttgaaaagatcactttggctgctctgtagagaatgcatagggagtgctgaggaaagcaataatgagaacagagaaaccaggctcgctctttcagctattaggatttaagtcattactttatgtacatatgcacttattggctttattttggtttaatattttaacacagttgccctgccatttcttttcaaagtatttatgcttaatatgtccagccctattaataacttgtattgctccaatataggtgggttaattttccttcagctcttctccctttatctgctacctgtttttagacttaaaagtaattcagatttgcccatgagtattctgtattctacttctgtttctttttgcttaggacaaaggtaggtaggagagggagagctataccaggtttctggtatctctcagttttattggaagaactgtagcggactcactctatttagtcaagagtatatccttttcctcttgagaggtgctcttgggctttgatggattcttagaatatctcattttcatcagctgtatttatcctgtggctaccaccctccactcaacccagatctccttcacctctctgcagcagcttcccccactctccccaggccctagtgggcaaatatgaaaaaccagcgggagggttcatgtctctgaggcctttggggtgcctctttcacctgggcattccccctctcagatgatctcattcttactattttactggatcttctcttctaatgaagcctagtatgcctaaagataacgttctgggttattttagttagctttcctccctgccaagaaaaaccagaatggcaagccctggttctttttattccttctgattaaaaaaaaaaacaaaacaaaacccatgattggtagggaagaacttgtctcctgagggattttctaggtcttttccctgagctactaattgctccctccatttccatctctccagattgagagaattaggttcagtgttcaggcttttaattagtccccttccttactcttcccttcactgtactgtttccataagcgaatagagagcagccatgccaattcctggaatacgttacctctctctttccctgactgtcatttttcagagattatggttacaattccacgcacagatgtatagattcaattattatgttaggtatagagggtgtcaataggcctgggtaatcaaaaggttagggaaaaaaagacagcaggaaaagtgttggagtaaaacttccataacctttaggaaacgtcacagaaagtgattgttgtaatatatgttacatgctatgttaagtctatgctaagaggtactctatgtcagtagttcgcaacctgggatgcatcttgctaggcccattctacacatacgtagtatcaatggttaagtactatgtggtgccaggcactgttccaagaactttacatacacagagacacatatccatttactcatctcttcagccctacaaaacagaattcagtattatcttcattttatagatgaaatgaatcacagagaagttaaataacatgcccaaggtcatatagctggaaagtaatgaaaccagaattcaaattcagataatctggctactttgcacaggtttcaaaacaatacacctattttctctacacatcaaaaacctatattgctaatttaagctagagctgaaaccaaaatactgaaatacagcctcccagcttctagatcaaacagtgtcattttcattaattctcacttattaaatgcttatctcactcaaaaatcccatacctaggaggtaggtatcatctcaattttaaaaaaatggcttgaaaatgtcaagcaaattggtggcagaaccagcaggggaacctgtgtctttcaacctccaaagccccagttataatgactctattcaactgtttcaatacagaatgttattcctttgtaacatatatctatttcaacctttaagtgatttctattaacctccaaataagctcattctgattgtactgcaataattttcttattctgaattatttgttaaaagttattttaagaaaagtacttagcctaattttacatagagaatgctaaagaataattcttagggcagaaatccatggtcggaatgatttgtgtttgaattaggacatacaggatttgtctaggcatgctgtaatactagttttgtgaaactctggtgtgataaatagctacttttatctaaaccaatgttatttactacactaaaaaaagacaattaaaatcttagccaggaaaactaacacatacattggaactcttcctacattcttttatgttctaacactcagttgctatctctaaacttttggtttgcatatgaaaaccagtaaatcacaacaaacctatattctgaaaaatttatatttagaagagccaatgctttaggaaaaagcattactttataaggtaatatttttctagaaacatacacttacttctgcttttttacgagcttccatagctttcataagcatcatgtgttgtcgccttcgctctcgttcctattaggccagataaaatgtggaaaataactcagccacaattaacagtttgattttccaatgaaaaaacaaaaacaaaaacaaaacaaaaactcagtatagcatgtttagcatttatagacaagtcacagtaaatactaaatataagacaagaatggccagtctgtgcatgttttagttcaggtttagaaagcaaatacaacaatcaaaagcaaaaaggtaaagcaatgaacatggagacagtgtaaacagaagcatacaagatttacttatggtcagttgtgatgctccttcaaaagctggcagaacaaaaagcataatggttggctggaacaggtcagttaccttacatctgctattagaaaaaccacaaatactatggccaattaaactaacggttgtgttgttcttaaaattttagatcaggaagaaattgatttatagtcactttaacttcatgattttagagtaggttattttcagtacaaaatcattttgcaaatccaataagccaccaataaattagagtttttttaaggcttttataccaatttagttaaactagtcttgtttcacatacaccaccaatgaaatgggatattcctatttactgatgtctgccacctgatactctatttaaagccacaaaagctgcaccatgggctcacaggtggaatcttaaaggcacagtatgaaaataaggtaagcactagtttaatttgacattctcactttacttttaaaataaaaaaatcacttatttataatatctcatcgatttttttgtttaagcatatttggtttctccaaagggatatttctaaaattatttctaaaatttgtctatgaaaccagaatatatttcatattctctcatcaaacaaactcaaaattcccactgtattcaatggcagttttgcatctagaatgatgggagaatacgggtcataattatatctaattgtatagtgatccaactttctttgtgacatcagtaatgtaaatttttagagagcagccttatttaaggcttgtacaattcaatgtaaaatcttggagatgcatcatacttctttatagacagacaagcagatgtatgcaatgcactgtgctgtaaagccatgcagcagtatgtaatatgacagcagccagtgctacactttatgcattgctatgacaaccatatcacaaccaaatcacaatgcggtgttagatgtacaaaaataaacatacccataccatatctagtctatgcctctccaactcctggtagaaagagttggcacaacattatgaaacagaaatcacagagtcataaaaccaattttttaaccccccaaaaagacaccaataccaaagcaaggcaataaactgtaggttgaaggaaaaacttaagcagaaattatatcagaaattttaaagaaaatattttgaagattttcccccaaataggtttaagcaatattataaaatgtacattcaacaattgtataactatacatatacagacctgatgtttcagaagaacagcttgttgtcttctcatttctttttccttaaaaataagaaacttttaatacgtgatttttagagaagatttagaacatgctaaaagtattaaaagttccttttctgagattctatagtttttcattaggttgaaccatatgaaatggccaatattcaattattttttatttataaaatgtcaattcgattttgtatgcttctacctaacaaatacttacatagagatcatataatatggtaaatatggtagcaaggatctttcttcagtagtcattttaacttaaaatttaacgaatgactgacctaactgcacacttcaatggcacattcattgaaccaactagctagatggtcagagcctatcagatataacccacacatgtatttttaaatcagtttaatacattatggtgcaaccctcaaatctagctgattagaactctctccattctgaatataaactctcaaatatactctataattaacatcatttttttttcatttctatacactacgtatgaattaaagtgacaaaaactaggcaatcagtgtgaaattttcatgtccacctataattcagggcaccattccaaggggatggggcttaaggcaaaccattctaggaatgtcactgatctcagtatttctatgaagttacaatatggatgaaattaatattaacggcagacatgaaaaggtagaaatttaaaaaataaagtaagacagtctatgtagaaaaaataaacagttccctggctttacaaagtataactgtggtggctgtttccagtaccagtaggctcacccagctaccccctttcagtattcagttactggtggacggcagggtgggggaggggaggaaggggacaactctcctataccccatgccaggaaatcagaacaaaacacccccaaatacatgaagttaaaataattaaaagcagctaattttattattggtaaataacagttgatgaagtttggcttttgtttctgtaggcttttcatttttaatagataaaacagttgctgaatattaacaaagaaaaagttataaaggggagaatcagattgagactcaaatataaacatacctataccatatctagtttatgcctaaacataaacataaacataaacataaataacacacaaaacagttttggggggggtcattcttatctagcaaaactacatacaggtattaagcaacaatttgcatttctgatttgatgtctcctaaacagctcaaagcattacaaaaaaccctgcataataaaataaaaatacacatacaatatacatacaaataaaaacatacactatacacatgtagtatctgctaaacatattttcagatagtcattttgaagaaagctattttttcatataactgatgccagtataacatatagtttttatttttcaaaaataaaaactctgattctcatctaaactaacctttattcgtttctcggcctccaataatttggcatttgccgcttcttccttctttttctttttagcctgtgcatgcaaaacaggtctcaaagtcatgcaacagcaccactacaacttgcaaataatgtcagacttgaaatgaagctacatgtctcacaaggtacgaaacagtatgtaacacatatgtagacaattacagatttccccccagttaacattatgtttaacgtaataattttgtttctaatttatagaatagcattagaatacacaaaaatttcttagagtcataagaatatgacagcttttcttcttcaagctttgttaagtctgaaataattgagtgtttatgttcttttaccttaaaatttaatcacagaaaagtgattttatgtcacattgtttttctgattttaaaagtaaaacataatcactgtaaaacatttagaaaacagaatagattttaattaataaataaaaattatttcaagaattagtaatatttgagaatgaacctgtttatttaaaatttatttttaatacttgaaaatttgagataaagaaattcattattggtttatgtctattaagtgaagcatattaagtctgattttccccatctctgtatagtgtggttaagttcaagtgttttttttttaatagaatgaaaacttgtaatctcatctttcatgaggcacaatctattgagaccatgctatttatcaaacataagcttcataatcttaaaatcattaactgtgtagaagtttcataactagtagttactgtcagtttactttaaaataaaaacattttcaatttccggtttttaaaattaatttgaaatgggtaagaaaaaatgtgtgtgtttctagaaggaataaaactgtaacagagaaaacctcagctatccggagccctcagggaataaactgttctataaagcagcagtttccggaatggtggagaagttgtaataaatttaaacatgaaaagtttattttcactcttttagatggaaataattttgagacatgcctgcttagacacagtacactaaacgtaatttggcgttttcttgatgactcagggcaactattttcaacatcagttatactgcacagctccaaagagtaatgcctttgggctattaaggttttgaaaattgcttgctattcaaataaaagattacaggctgttgctaggcttttcagttcctatatatgctagctgaagttttcctgtattttttctttgctgtcttttgcctattacttttgctgttgccaacagatgtcctctatctctattctaattagccttgcagggaagagggatatgctagaaaccagaaaaacaatctgataaaactttgcacatttaaaatttacttttacttttgaaatcttacttctgtaaacatttgtttctaaactaaaagtaaatatcagactataagccctaatgatttttcttttgttgtttacttttataaaagtaaaacattttagcgcatgaactttatgacaactccactgactgctcagaagttttcctgtttcttttgcctcattttgtatatctttactgttgggattagattagcttgctaaataaggctcagataaagttttattctatgcagaatgtttaaagagaatatctgacaaacaatttgtgtgagaaaacatgcacgcaaaatatttatttttgcagacttaaaaatatatggctaaattactttaattatattaaatttaagacttctacctctagaatttgctgagctcgaagttctttttccattctgatttgctgtattctcttaattttttcctgtaggaaaagttatgataacttgagataataaaataaactatctgagtaaagagtatttgagtggaatcaaataattaaaaatataagtacaggtcaggcgcagtggctcacacctgtaatcccagcactttgggaggccaaggtgggcggatcacaaggtcaggagatcgagaccatcctggctaacacagtgaaacctcgtctctactaaaaatatttaaaaaaaattagcagggcttggtggcgggcacctgtagtcccaactactcgggaggctgaggcaggagaatggcgtgaacccaggaggtggagcttgcagtcagccaagatgtgccactgcactccagcctgggcgacagagcgagactccgtctcaaaataaaaaaaaaaaagtacaaaattaccaaaggatggacataaaaatttcattatttagcgtaaaaccatatatattttcatgtctgaaattaatatgatttgataaggtttctcacagtaatttgtaaaatgcaaatgctaaataaacagaaactcagtgaaccaagctgattaaactatatagcctgaagatctttatagatatttgcagttacaaataatacttaacttgaaataatataggactgaatagcagaaaaatcatgtatcagcagtcagaaaacatacagccaattctggattacagtcatttattgaatggtcttgagcaaataataactattcttctataaaatagtgagaggtgtttgccctttctcatttgtcacaattaaataaaatgctttaaaaagtatatagtgacacaattgtaacattattattaacaataatttccattctaaaatttatttcatatgttgaatagcataatataacattgcttttaattacaattagcccatttcagaaataacctgtaacattattttaaaattaattaattataatttaacattccagggaattatctgtaggacataattggggtacacgttgtctaaatttaatgaactggttattggatatgttttataacttagtgatcatataaattttgataaaaatttatattttaacttaaaaaattatctcatattctataaacacattcttagcaatttcatgttccttaatccgttcaaaagtcccaaattggcactgatgagaataaatacaagttaaaaaagaaaactcaaagtttcctacttgaaaattgtacttatcctagaatttccagtgccaacacctgtatttcacaatgcctgctcccatctccagatgctagttgtacctattgaagctatacattaatatgcattttaatttttttaatgtacactgatgttattgattccctgcaggattctactgcaggatgatgaaattttaggaattactgttttgattttacaagactgatcacattctttgattttggtgatcttatcatggtactgaatattaattgtaggctgtcaaaaataaaaaccccaaagtgggccaagtactgtggctcacacctgtaatcctagcactctgggaggccgaggcgggcagatcacctgaggtcaggagttcgagaaacaaacagtgctaggtggtgaaaccccatctctactaaaaatgcaaaaaattagctgggtgtggtggtgcatgcctataatcccagctacctgggaggctgaggcaggagaattgctggaacccaggaggcggaggctgcagtgagcagagatcgtgccactgaattccagcctgggcaacagagggagactctgtctaaaaaacaaacaaacaaaaaacaaaacaaaacaaaaaacaaaacccaaaaccccaaagtgtatcttttgtgtaatttccaaatcttagaaaagattgatccatatttgaagtatttatttgaattagaacttgatatctgagaaaagtatactcttgatctgacttttctgctcttgtcaattataacattataaggtgctatgttttcaagccagcaaaagtcacttgttgttctcttatgcacagacaggcagggaatcttggggcttacgtacacagtctaaagctttatcttaagtattcaagtgacttttatatatatccatacatatttggtagtgttatcattagcatgcagataaacatggtaaattattataatacaggttaactttgtaatgttgagtactcagccactgagccggtcactttacatttaatatcttgtcaatcattaaaaaatcataaaagcttaaattatcttctttttacataagagaaaactgaggttctcagaaagtaaatattttgtctaaagtccaatacttagtaaatatagagtcctcgtcagatcccaatgcctgtgtgcctcctgctttgtaataatgtttctgaaattttccagaaaattgtcttaaggactatctggtgatatttttggtctactaggtggaaaaaataatccaaaggatgaaaacacatgtactattttattctagatcaaatgctgactttaaaatagaccctatataacagagagtatgagtagaattactctatactttgattcactttgttgaatcaaataaatgagatggtattctgagattggcctcagataaatatcttgataaatattaagaccagttcatttgcattaatattgctggaaactttggagctcaatgctttttcaatgagtagcaaagaccatgtggattcaggttgtagctactgtaagactttaggatcataaagctgaattaaaagtactgatgggatctaatgagtctccagccattagtaaatagaataagctataaaactttttcaataaaagtataacagaaacaacagtatttcacttaaaaatgaaatatgaacttattttttcatatatactctttagtaaatatattttaacgaatgcattcactagcctatttcaggtcaatcttacaatgtctagcagtcacaattaacaaactaaggatggaattcaagttgacaactgctactttaaattatggtggtaaaagagtacactgtgtagttggatgttttatatttatctttaaaaagttgagcatgtgttttgttgccagtcactgcagtaggcactttatgttcattatctcatttattcagatattgcagttaacttcttttatgatggaagaaataaagacttaagggttaagccattcatctaaggtcacaaaattattaagtagcagagcccatatttaactgtaggctgactgactacaaacttaaatcctaaatcccaactctatatcaacttctctagtcatattgctttagttaatactggaagaaaccttggagataaccacatcaaatccaacccaagccatttatttagcaggtatttatatagtaacataattgatttcatttcattctcagaaataactacatgcttcctaatatttttaaaagaatagtactttctccccatttcctttctgctttaatgttaccatgaatatgaggagatgggagagtagtttacacattctcatcttaaatgaagctgaataccttctcacttaatttttacctatgaaaatttaaaaattacttctcttacctaaacttaattttgaaaatcacatggggagaaatattgtagatacaagacagagaactctggatttgctaaaataatgctgtcatcatttttttttttttttttgcagtggcaacttttaagtaatcctgaaagcattaagaagcaatgaaggcaaatcttattttgtataacttgaatttaattttctactaatattttacatgtttaagaaaaacaagcttttattaaaatttgaacattcgagcaatatacttcattgactgatacattaatttaaaaattctgaaaattgttcaagatatcaacttatacaaagtctaccaggatattaaagtacttacacaaatttactgtttggtaatcatttctttaaacacttggaagtagaagactttattaaaaaggtaaaattttaattaatagaagatagcaactttctaaataagacacaaatattaatgtgaaatatagttatttaagaaatcaaaaataatgtacattactaacaaatcctcaaaataagtcccatattttaaaagtcacttccaatgtatacacatacctgctgtttcataatctttatctgttctttttgcttccgcttctcctcagcagccattattgctacaagaaaccaaaggatagatatcatcaaaaagggaatgaagaaaagaaaactcttatgaattccccagtactgactcttcgagtttatgttacatttaaatcactcaccttgttgttttttggcttctttagcaacccgagcctgttcctgcttttgaagttttctcaaaagctttatttgtgctgcttgcctggctatttctgaaaaacacaaaatttcaaagaatattaacaactttgtgtaactactaaccaaaaacaataactgtgtgaaaatggtatcatcataaaggatataattattacttttttttttgagatgaagtctcgctctgttgcccaggctggagtgcagtggtgcgatcgcggctcactgcaatctccgcctcccaggttcaagtgattctcctgcctcagcctcccaagtagctgggattacaggcgtgcgccaccacacccagctaatttttgtatttttagtagagatggggtttcaccatgttgaccaggatggtctccatctcctgacctcatgatctgccccgcctcggcctcccaaagtgctgggattacaggtgtgagccaccactcccagccgaggatataatatttaagaaaattgcctaaggtcagacagataccaagtagaagagtggtgtggtagacaacgtcatgttcattccaacggaaactgaatgttcattccaatggaaataatcaaattatttcatcaaatatgatcccatatctaggactacataaaaatgaggtttcttttaatctttatcagagaggcttatttaagtacattttttttcacatttcaagtaaaccccacttagtgggaaaatagctgctaatattttaagacttgtaatgtagcttcagtcttaacatataaaaaaaaaagaaagactctcaattaaaacaaatacaaagtcccctcccacccaaacttagtatttcaattagctataatggttaagttcctgaatccagtgatattttcatttatgaaggagagggactaaatctcctaaataaaaagaaagcagaatttcaatgacttttaaagacaacctagttcttataatcttcaaggatacatgtatgaaactagggtagatgaacaaagttaatgtccccaattcttcatttctccttttatccatgacatttgtaatgtgactttggagcaattcccatcaagaggtggaatatattttcccgtcccttgattctgaactcaaccatgtgattttccatggctaagaggatgttagcagttgtgatgaaaacagagcttgaaagtttagttgtattctttcggcttttgttcttgtgctttgcccaagactgaagatatgatttgggggctaggctattgggagattgggacacagggagcagttgaccctacaaatgtgaacaagcccagccaagataagcaaagctgcttagctaatttccagctgattccatgtgcacaagtgattaagacagtgttgtgtgctactaaggtttggtggttgttaccaagcattactgtggcaaagggtgtaacagacacagaaaccatgtaatatccttgctttcttctgctggcaaacttggtctgaatacttcaaactctaaaagtggtatataatattactcatataatcattttagaaagcatcactttgtattatacattgtttaaattttgtagccactgaacaaagaaacctaaattatgttcattgacaaggaacataattgctaacacgtgaatcacttgagctctaaaaatttccaccatttattgatcgcaggcactattgtgttaaatttttctttttctttcttttctttttttttgaaacggagtcttgctctgttcccaggctggagtgcagtggcgtgatctcggctcactgcaagctccacctcccaggtttacgccattctcctgcctcagcctcccgagcagctgggactacaggcgcccgccaccacgcccagctaattttttatacttttagtagagacggggtttcaccgtgttagacaggatggtctcgatctcctgacctcgtgattcacctgcctcggcctcccaaagtgctgggattacaggcgtgagccagcgtgcccggcctgttgtgttaaatttacaccaccttgtttaatgttcacagctacttaataagatcaacatgattgccccgcttacacaaaaaataactaaggctcctagaggttaaatagcatagccaagaaaaaaacccacaactggctgggcacagtggctcatgcctgtaatcccagcactttgggaggctgaggtaggtggatcacttgaggtcaggacttcgagaccagcctggccaacatatgaagcccccacccctactaaaaatacaaaaattagccaggcgtggtggtgggcacctgtcatcccagttacttgggaggttgaagcagaagaactgcttgatcccgggaggaagaggttgcagtgagctgagattgcaccactgcactccagtgagactctgtctcaaaaaaacccccaaagaaaccccaggactttctgactccacagtctatatgccactatttctaaaaatctttaagcaaagtttaaatgccttaagattttagctaagaacgtaaccatatgtcctcataacagctgaagtgaagttggtcactatggccagttttctatcactgagacttttaaaaaggagaagagattaaaaaagtcgaatttcatctagtaaactggaagtgttaatgaaaaataaaatggaagatgatgataaagtattatctccaatgtcccaaccattttcaatattaggaggttacaggcatcatcaaaaatttctgggtcacacaaaaaagatgtcctgttcactaaatactctaggacataaaaacctataaactgaccttcagggtcagcaacctctgataataatatgggtgaagaatattattctcatctataataatgccagataaatatttctttaacattaagaattgaaagttttgaattctacaatagaggcctgactttgtcttgaaatgtaaagatgtgctgataaaaatgtttcctagaaaatatggcataagtacgatcttttgctgcaagctaaactgatattctctaatataagtttaacttttaataagaaaattctataatatatatagaaccatgtttgtgtatgagcgtatcaatcaatttcaagccctacacaagtacacagtaatttttgtttatttgtttgagacaaggtcttattctgtgacccaggtgaagtggtatgatcatagcttgctgtagcctccaactcctgggctcaagtgatcctctcccctcagcctcctgaataaccaggactataggagtgcaccactttacccagctaattttttaaaaatttctttttgtggtcttgctttatttcccgggctggtattgaactcctggcttcaagcaatcctctcaccttggcctcccaaagtgctaggattacacaggtataagccactgtgtctggccagtaatttaaaaaaatatttgggccaaaaaaatttaaaagttcaactcacatctttttactttagcaagaaatataaaattttaactaatcattaaaaatttacatagattaaattttacattatgggcagttggaaaagaagatgatgtgaaaaaaagaaaaaggccgggcgcagcagctcacgtctgtaatcccagcactttgggaggccaagacagatggatcacctgaggtcaggagttcgaggccaccctggccaacatggtgaaaaccgaactctactaaaaatagcaaaaattagccgggcgttgtggtgggtgcctgtaatcccagctactcaggaggctgaggcaggagaatcgctgaacgcaggaggcagaggttgcagtgagctgagatcgcgccattgcacttcagcctgggcaacaagagtgaaactctatctcaaaataaaaataaagaaaaaagaagaagaaaaaaagagaatacagaggagagagaatgagttagatacctagaaaagttcacccaagctgtagaaataaattacttccagtatcttctcatttatttgttttttttttggttggtgaatatattataattaccttttgaaatactaatttggaaagtatcttttgtggcttaagaaactgtctgctttaatttcaaagatgaagtttattttcagatagaattagagatattttggatataactcatttctttgatcctaagatgcatttttaaacattttgacatctctaaggtcagaatgtaactgataactggcagctcttttctttcttagtgtacatcttaaaataacggtgcatggtatagattacttataggcatctcagtttcaatcgcatatgaaatgaataggtgctacttcatattttggaaaatttgagatattaatagtatcagtcaatcaacaagcaggtttatttatatagaatgaaagtctttatcatattcaaacttggtcagatttttacctatattctgagaaattagagttctcatttcacaacgtttggatgtacattcaaaactcacatttatctcactattctgaaactttcttcaaattaagtctggtttttcagtctagttggtcatagaaggataataatatacaacaaaaacttcttctagaatcctctcagataaccccccaaagtgttaccaaagaaggcttttagaaatgaaaaaggtgataaactgtttcatttttactttcttttcttcacaggaaaaaatgcaaacaatactccatacacttgtaaatattaatagattatttacttactgttaaataatctttatatacatgttgagaaagagtacatgtaatatacaataaggtcaaaggtaacagaacttgcaaaatgcaatccaatgtattataacaagggtaaactatgtaattgaatacaaatcaatttgaaatctggagggagaataaacattcggtaaaagttgaataattaacttctactttgttacaacaaaaatatagttaattttctaaatttaaatttgctattttagattctaacttctaatgataattagatacggcaaatatccatgaagatcccatgttttgattatcagttaatttcaaactttcttattttatgcaaacaatgtccacattccccagcattaaacattattcagaagggtcaatagcttactgacaatatcagtttttaaaacccatctatgcctgttaatttattgactttttaaccttcactagtaactctttgggatgaaagtcttataagaagccaaataaaataaaaaaatctgactaccatactgatatggtttggctctgtgttcgtacccaaatctcatctcaaactgtaatccccacgtgtcaaaggagggacctggtgggtggggattggatcatgagggggtttccccccatgctgttctcatgatagtaagtgagttctcatgagatctgctagttttcgaagtggtggattcccttgctctctctctcttctgggtgccttgtgaagaaggtggctgcttccccttccaccatgagtgtaagttccctgaggcctccccagccatgcgaaactgtgagtcaattaaacttcttcctttataaattacccagtctcgggtcataactttatagcagtgtgagaatagactaatacacatactaagataaaaaatttatatgataactgctaggcagttaagctattagtcaaagtatgaactggagacaatatttgcctgctatccataaaaacttgaaaatgatttgtgtaatatgtttagatttgtataatatatgcttagaaaagtgtaatatatatttattataattgtatgatagtgaagatctagaagtagcttaaatagtcatcaaaaagagactgactcaagtccacttattttaaaaatcaaaaaggatatatatgtatatgtgagtggttgcatgtgtgtgtatgtgtgtacatatttctggaaagattaattattccactgataacaatgagaatgtcttttatttatttctttagagacagggtctcactctgtcagccaggctgaagcgcagtggcatgatcatagctcactgtaaccttgaattcctgggctcagaggatcctcccacatcagcctccacaatagctaagattagaggagtgtgccactacacctggctaattttaaaattttatttgtagagatggggtcttgcttcattgcccaggctggtcttaaattcctggcctcaaacaatcctcccaccttggcatcccaaagcattaagattacatgtgtctttaaagcattctattctatgagttttgtcatagatatttgttttataataaaaaacaaagcagcaacagagaagtctatattatgatggtgtttacaatgaatagaattaagtcttttatacatttcctccacattttgcttatttatagggataataaaaaacccatgagaagtagtaaaattctgttagatttttaagtcaattttcattattaaacctttattttacattgttacatatctttatatatatgccttgcaaatataaggtatctacacatatgttgatatattcagacagtcttaagcggcttcacatttgtaactagtgactcaaactgcaaagccaaactgttctattttactcagccttctctttgccatacatagcatgggactttcatgttgacattttatgtataatgtcaaatcattaatacagtttaggttattatcagcactttgagcttgataaatgataatttctggttatcttaaagtactttttgattttaatgtattaatttgttattctgaaaatatatatactatatctggactacaggagaacccaaactaaaagactggggttacttaccagtaattggagttctctgactgaaaatttactccacagatccacatattttggagttattcccatgtaccacctcaaggaatcgggagctgttaaaatgagaatttccagaaggttggcacgaccttaaggcatgtgccaagtgctggttgattccctttctgtgcaagccttaaaagcttaacacccacctttgtaattctaaatacacaggataggatgtgtttatgagtaatggttcttgaaagattacctaatcaaagaactccagttaccagtgggactccttattttttcattttattctaacacaactatttactttttaaaaattgagagcagtgtcaatcctaagtcaaaaatattagaaatacttttagtatactttttagtatgattattagtgtcagacacattatgtttcttaccttgagcttgcagttttcttagcaactttgcatctgcgttatctaggaattcagcattgccaacatttggaggtcgacctttccgacgtctcatcctggattcctctcttgctcgttgtctatctggatttggtggtcttcctctacgaccttccattgccctgatacgaggaatgacatcctcttctttcaaaagacaccactgcattcccttttaattaacattttatagaaataatatattacaaacaaaataaacacaagagatcaacatgtaagaaaattctagctaaaaatcacatatattttggaatttacaacattagtataagctttaggaatttcatttttaaattaaacttagatgtataattattcatggcctttggcatagctttaatattcttactttaatgacttaagctttaattaaatatatagatttgtatctgtatctataaatgtagagatataaatcttaatcaccatttctgaactataatgaccatcgagttagcagatatttaaaaatgttagttgtacaatgatgccactatagattgctcttatgggttatcagttaaaccaaaacactaagctacccaaataatacatgaaagtttctctttataaatattacagctaacaaattaagacagaaagagttagaatatcaggattctgcaatacctaataaattagttaattgaagaattgaacttgaatggttgcctatcatcaaaaagagacacaactagacaggtatcagcctcctgatggaggctcatacaatcacctataaaatagtactgcccctcacacacacacaaaaatcaaacctggatttgatcaagcctctagatttaattacaataactttaaaagaaacacggaagtataagttaaactatacggcaaaatccattctgtgggaaattctataaatgacctagtttcttcaacaaatgttgcaagaagtaagaaaactgtaggaagtttaactgaaccttaaaatatgtatcaaacaagcccaatttgtggaccttacttggatacttatttaaatagacaaactggctgggcgcggactggccgggcacagtggctcacgacctgtaatcccagcactttgggaggccgaggcaggcagatcacctgaggtcaggagttcgagaccagcctggccaacatggtgaaaccccgtctctactaaaaatacaaaaatcagctgggtgtggtgacaggcacctgtaatcccagctactcgggaggatgaggcaggagaattgtttgaaccagggaggtggaggttgcagtaagccgagatcgcaccattgcactccagcctgcaggataagagcgagacttcatctctaaataaataaataaataaatagataaactgttaagaaaatttgaacaataaagagacaactgaaaatctgagcaatgactgagagttgatgatatcaagaacgtatcaatgtaaataagtacaaccactatggagaacagttcggaggtcgctcaaaaaactaaaaatagagctaccatataattcagcaattccactgctctgtatatatctaaaagaaaggaaatgaatatactgaagaggtgtctgcactcccatgtttgctgcagcactgttcacaatagccaagatttagaggtaacccatatgtcagatggataaagaaaatgtggtaaacatacactacacaatggagtacttattcagccataaagaaaaatgagatcctttcatttgcaacaacatcatggatggaactagagaatatcacgttaagtgaaataagcctggcccagaaaggtaagttttgcatgttctcacttatttgtgggagccaaaaattaaaacaattgaactcaacagagatagagagcagaatgatagttaccagaggctgggaaggatagtgagaggagaggggcaagggagtgaagatggttaatagttataaaaaatatgtgggtaaaataaataagatctagtatttgatagcacaacatggtgactacaatcaacaataatttatcatacatttaaaaaaacctaaaagagtataactggattgtttgtaacacaaagaaaggataaatgcttgaggtgatgaataccccatttactctgatgttattattttgcactgtatgcctgtatcaaaatatctcatgtggccgggcgcggtggcccacgcctgtaatctcagcatgttgggaggctgaggcgggtggatctcctgaggtcaggagtttgagaacagcctggccaacatggtgaaaccccgtctctactaaaaacacaaaaattagctgggcacggtggcgggtgcctgtagtgctagctacttgggagggtgagacaggagaatggcttgaactcgggaggcggaggttgcagtgagccgagatggaaccactgtactccagcctgggtgacagagcgagactccacctcaaaaaaaaaaaaatattctcatgtaccccatatatatatacctattatgtactcacaacaatgaaaaaaattaaaaagaaattatatattaaaagtataatagtggtactgtggttatgagtccttatcttttagagacacaaatggaaccattccttcaacaaattttggaagggagaagtagatgagggtatatgtaaaacagtattggtcaaaatgataattcctaaaacttatgatgggtacaaggtctatattatcagtccatctatttctgtatatatttgagatttctcatcataagcctcctagtggaggcacatgccaacacaatgctagtgtatctgcggccgggctcagtggctcatgcctataacaccagcactttgggaggctaaggcgggcagatcaaaaggtcaggagttcaagaccagcctggccaatacagtgaaaccccgtctctactaaaaatacaaaaattagccgggcgtggtggtgtgcacctgtagtcccagctacttgggaggctgaggcagaagaattgcttgaacccagggggtggaggttgcagtgagccaagattgcgccactgcactccagcctgggcgacagaacaagactccgtctcaaaaaaaaaaaaaaaaatactgcttagcacataaatacatgtatcctgcatgtgtcaatcaaaacaaatacactgttatattaccttatagtccaaaataatatgttcagatataggagacatcttttaaaaataattgtcttattatttctttttaagagttaattccttcagtatgaaggttaaggaaatttttaaaacgtgtttttctctaaaaatatcctcaaagtagaaattttggttgagtcactagaagaaactgtgcaaccaaaaataacccaaagttcttgagttttacgttataacatgatttgcctaacctggggcaagaagtctatgaatatcgcagttaatgggtactaaattgtacgtgattatggataatagctacatctcacattctaagtattgtgctttgttccagatactttgaatagactatacactttaatcttcacaacatttctatctcatatggtgggttttatcgtctttacaattgaggaaattcaggctgagtgaggttgaatagacagcaaagaacagactgtgattcaaacccatgactgtctcactctaaaacctgtgctcctgaccactatgggtacttgatgttataaagatgttcttatacctgataagtgacagatcataacatttagccatgaaagcacagccaagattatgtcaagaaaagaccgtcagaaaaaaactaatgcatatgttcatatatacatatgctaaaaataacatctatactaactcctttcagtaattcttatcttaaagataattttaaaaattaattctgaggaaaatgaaaattttttgctgagattccaaataaagtcaataggaacaatagttgtacaaagtgtacttttaggccataagccactaaaaaggaagatatcagcatagttttatgtcaggttatgttcaccagcatgggaagcttttgattagtttaggttttcatttttttattatgttcttaagcaccaaggcagcatgtatcatataacttgtaaaatataaaggtaacattcatgatacttggaagagaagagtgactactaaaagtctgtaaacaaatctgcatttggtttttaaagtatcttattaataacaaaatcaatttttggccaaaattttaagagttctgtcaacttttcttatccaatttttacatagttacatttttattcagctaggaaaatacacctgtgtcaaaagaggaacaaaatatgttggtgcctagaacttagcagacaaatatagtgaccatatcattcacatttttgcccttggcatttaaaaagtaaatactttctaaagggattgcatatactggattatgtataatgtcttctgaatcttagattttagaaaatgagaaaagaatcattaggaaaatctgaaacttatacaacagctttaattcattgaagagccaaaataattgtgggtgagaacaagtagtatttttctcaataaatttttcctcaggaaaagcaaatacaatttacatcatttgattcacatgccattggctttttatctatcagaagttatatatcaaaagaatttaattcttttttcttgatttctaagacttaaaatagtaaatatttgctgaaaataatttttgttgactaagatttttaaaatatggataagaaaagatgatcaacaagatggagatagcaaaagattaggtttttttttttgtttttttttttttgagctgaagtctcactctgtggcctaagctgtagtgtagtggtgcaatctcagctcactgcaacctctgcctcttgagttcaagtgattctcctgcctcagcctcccaagtagctgggattacaggcgcttgccaccatacccggctaatttttgtatttttagtacagacagggtttcgccatgttggccaggctggtcttgaactcctgacctcaggtgatccacccgccttggcctcccaaagtgtttggattacatgcgtgcgccaccaagcctggacaagattatgttaattatattattctaattctgctttcgagagttgctaatttgtattcttagtgaataataccttcacttctataaatactacaaagagaaaaaaggaaaaaaagaaaagggtttacgttttatttcagaagactgaataatccaggtaaataaggtaatgaaataagtgaaagtacactgtaaatctgtaatatattataaaaatgaagttttcactacttaaatatttgttgaggcacctttactctgagcaaggcataacattatctaaaagtcagctagagagagaccttttccctaaaggaccacatttttaacaaggacctcaggctcagtcaattctaaggcaggtgaccctaggaccacaccctcagtaatgcattagaaaaagagtttagagcttgggagagaaagttgtctcaactgtccatataaaaattatgatggcctggattagagcacaggaattagagctagaaagagagatgaatagtacattagtcttttgggagagagaactggctgaaattgaacaccgcctggatgtgaaggaggaaagcctgaatgtagaccagaaaggcagttaaggtttggagtagtctctaaagaacatggaaaagggaattaagtggcaatgatgttttcttactgaacaaataaggatggagaaatatttgagaaaactggaaaacaaatttattgctcaacttttttatgacttataaacagacttttaaagaaagaaaatatttctttttagtgagttcttaaatattttctgtattcagaaattcaaaagagatcatgaaatttattttcaatatgatcttcctatttcaacatttctgttatatagtcttcataaataaatgactccaaaggataggtgaacccttcatgagggactggtttgttttcaccttatcttatagacagtaaattgcccaattaactgggtttcccacatttcactgaaagctagggtaaatatgtggtttagcagccacatgtttaggtcttaatgggatgtgttctcaagtcttattcctgattcaattttactcatcctggcttgactttttcttttgttgctcccattttttaaatacttgtaagctgatttttttttttgggaaaagcagtatataattatgtaaatacagtataccagtccaccaaaagctgattagctgaatgatttatttgctaagttattgatgactatttttaaagttttagtatcaccaagactgggatgcagcaatttcacatggatttacagtcctgtgccactagatgcccagcttcccaagttaacatttgagatgcctagtactgtccttcttgaatgctcaatgttatgtaagtgaatggaaggactttgctcttctcatatttttctggactgagacctctatctatcccagtccttgcctctggtagtaaaatatttgtggggtatgttttaaatctggattaaggcaattggtctgacaatttaaggcctattagtcatttggtagattgatcatttaccaaattgatttctggttaaataattttcagtaaatttaaccatagcgtaagtaaacaaagttaattttttcctacctttccttttgaaattgtactttcagaatcttttacttcccaatttgtttatatgaaacttttagaatgtcacacctaaaagcaaattgatcttaaagacctcttatatgcatttacattacagatgagagaattaagttagcttcagtgtaagtaatgtaagatatgaaattacccttctagaactaaaaaaattcttcgggaatgagcaaagaaagggtatcagatatttgcgacgaaatttgacaattcacataaaaaaattaacatcatgagaaaaaaatcaaaattttgttggatttccttatgccttttcaatttagtattatgtctatttctagctacttaatagtgccagaggtaggcagtgaaagggtgatagattatcaactttatgacagatattcttaagtcacactagtcatatagcttattataccatacactacatagcactttaaagatgtgaaagagtaagaaccatgagaaaaggtgtcatctattaaaaacaagtgagaaagatgtggtttgatacaactgtttccacaatgctgactatgctttctacttactcaaagtatgtcatcctctaatagtcaacgactttcaatatctcctccttctatatccttggattcacacagttgtcctcctagtataggcctcgcctagccacaaaaatcctacctggtagattagtgacataaatttccggacttatagatttctggtactgatctttcatgttctcagtgtccattcgtgcccacggctatgttgcattaggtgtgacagttaacagcagagctgaattagaactctggttgttgacttccaatcttttgttcttcacttaattcgaaataattaccagcattataattgtgccagaaactgtgtgttgcccaccttactgtgaagcctcctcttactccttattaacaaaaccctaatttttagctgggcagcattgtgcctactgttttatcttcctcagagaataagcttctctaaaccaacaatcatttttttgtattcttcagtttctctatgaacattagtttttcttcaaattcaggctttcaacttcatttctgtactgaaaggtgtgttcacaatttgctctatgggaaaatgcctttaggggacatctacttacagaaaaaactgcctggcacattaagtatttgccacacatatttactgattaaatgactcagaaaaaaaggctcttttcattaagaactgtagacattttactttttatggcttatgcattaaaaagaagaaacactgtacttttttctaaatgcaacatctcgaagaaaaaaagcaacattttcagagtcattttaaacttgcttcttctttgcatctttcaattttatgctttttttgggcctggtaacagtagatattccatactctaatggttctaaacctcctggttgaaagaaataaacttaaggtctttatgcttagatgtatagctttctacaattcacaaaaaatgcttttcaaggtagatcatcatatatttcaaaataatacgttattaacaatttattttgacgccttcctctagtcctaagaaatatgtaaatacctcttaccttagtgttatatttaggtaaataaaaataatgctattttattaccaaaatatgtctagctcaaccttatcttcttttattctgacaatcaaacacaaagtaaaataaaaacaatgccatttattcaacaatttttttataatgtgatgaaacagaagtccgtaggaaatttatttaccttacaccattttcaaaggtgtttcttaaactgctaacagaaattcattaaaaggtagccagccagtacagcataggcttatatagagtattacaattgttttgttccatgaagtctatcactcctctaaaatcaagatttttacagaagctggtaagaagtgtttgaaaactatcaatatgctgaaaagtagccgatgctacaaattcctcactacatctgtggaccaaaataaataaaactgataatggatatattaagtgtatcttataccctatttctttctttacatttttttttttttaattagagacagggtctcaatctgtcacctaggctggagtacaatggcatgatcatagttctctgtagtctcaaactcgtgggctaaagcagtccttccacctcagcctcccagggaggtgggactacaggcatgcagcaccatgcccaggtaatatttttattttttgtggagatggagtcttgatacattgctcaggctagtcttgaactcccggacttaagcaatcctcctgtcttggcctcccaaagtgttgggattacaggtatgagccactgtgctgggccttttatccccgtttcatttgtaatcctattttcttgaattaagggcatctccttttttaaaggtaataattacattgttgtccttcagtaaatgataaatttatctaaattttaataaatataagctcacacacctctcatcttattgtactatacaaaagttaatattttcaacaattgcttgctgttaatattaataaatacatatataatcatatcttaagcccagaaatatcttgaatcaaaaaatgattaagcaaaatatccacggtattcaacaagaaaaaataaaaggcatccaaataggaagagaggaaatcaaactatctgtcttaagagacaatatgattctatacctagaaaaccctaaagactttcacaaaaggcttctaggactgataaacgagttcagtaaagtttgacaataaaaaatcaatatacaaaaatcaataacatttctatacgccaatagcatccaagctgagagccaaatcaagaacgcaatctcatttacaataatagccacaaaaagaataaaatacctaggaatatagctatccaaggaggtgaaagatctctacaacaaaaattacaaaacactgctgaaagcaatcagagaagacaaaaagaaatggaaaaacgttccatgctcatggataggaagaatcaatattgtcaaaatggccatattgcccaaagtaatttacagattcaatgcttattcctatcaaaccatcaacgtaatgtttcacagaaacagaaaaaactattctaaaattcatatgaaacctaaagagcctaaattgccaaagcaatctaagctaaaagaacaaagctggaggcatcacacttacctgacttccaactatactacaaggctacagtaaccaaaacagcatggtactggtacaaaaacagacacacagaccaatggaacaggacagagaactcagaaataagactgcacatccatgaccacctgatttttgacaaagtcaacaataacaagcaatggagaaagaaatcccctattcaataaatagttctgggataactggctagacatatgcagaatattgaaactggacctcttcctttcaccatatacaaaaattaactctacatgtattaaagacttaaattcctaggaacaaacctaggaaataccattctgaacatcagccttggcaaagaatttattactaagtccctaaaagcaactgcaaaaaaaataaaaattgacaagtgagacctaattaaactagagcttctgtacagcaaaagaaactatcacagacaacctacagaatgggagcaaatattcacaaactatatatctgacaaaggtgcaatatctagactctgtaagaaacttaattcaacaaacaaaaaataaccccattaaaaaatggacatgaacaaacactcctgaaaaaaagatacatggagccaacaaatatacacagaaatgctcaacacccttaatcattaaagaaatgcaaatcaaaaccacaatgaaatactatctcattctgacactagtcagaatggctattgttggccgggtgtggtggctcacacctgtaatctcagcactttgggaggccaaggcaggcagatcatgaggtcaggagattgagaccatcctggctaacacggtgaaaccctgtctctactgaaaacacaaaaaaattagctgggcgcggtggcaggcgtctgtagtcccagctactcaggaggctgaggcaggagaatggtgtgaacctgggaggcggggcttgcagtgagccgagatggcaccactgcactccagcctgggtgacagagcaagactctatctaaacaaacaaacaaacaaaagaatggctattattaaaatgtcaaaaaacaatagttgttggcaaggttgcaaagaaaagggaacactttatacactgctagtaggaatgtcaattagtttagccactgtggaaaggcaatgtggagattcctcaaagaacttaaaaacagaactaccattagacccagcaatcccactactgggtatatacccaaaggaaaataaattgttctaccaaaaagacacatgccctcacatgttcattgcagcattattcacaatagcaaagacatggaatcaacctatatgcccatcaacagtggactgaataaagaaaatggtatatatacacccaggaatactatgcagccatagaaagaatgatatcttatcctttgtaacaacatggatgcatatggaagccatcacctaagtgagataatgcaggaacagaaaactaaatatcacatgttctcacaagcgagagctaaacattgaatatccacaaacacaaagatgtgaacagtagacactggagactacttgagcggggaaagtggtggcgggggatggggctgaaggttgaaaaactaccaatcgggtactgtgctccaggatcatttgcacactgaacctcagtgatgcacagcttgcccgcttagcaaacctgtacacgtacccctgagcctacaataaaagttgagagaaaaataaataaagcactgtgtccctaaaaaaagcatcaaactacatgcttaaaaacgatttcattttattgcatgtaaatatgccacaataacattactttttaaagaaaaaagttttttcaattatgggctttttttctttaaaaataatattagcaacaaagaaattcttaaacataagaaaaattaaagattttatcttttctgaaataaaatactgataggctgttgcttctctttcagatttatcacaggttgctgtatagactttgggggtgaggggacttgtttttgttttcaattagcttttttacttctttagtatttaatgttgagctgaatggccttttatgtaaattatactactggaaggaataaatcattatctcaataaactagagaaaaacccagaattctgcaatgcaggtattatcttctagcagaaagtattatctcctaaattttatatataatatatggagaactggaattctgctgatgcaatttttgttatgtgttaagtaaaattagaacatatagaactaacgttgggggttttgggatatgttttaagattaaaaaatgatgaaaaaaatatacttcccaggaaaatgttttaataggagagtgattaagaatagagctgtcccttagtatccaggacctccctctatgaataccagtatctgcagatattcaagtccctgaataaaaataacacagtattggcatataacctatacctatactcctatatactttaaatcatcaccagattacttataatagtaaacacaatgtaaatgttatgcaaatagttgttacatcatattgtttagaaaataatgacaaggaaaaatgtctgtacatgttgactacagatacatttttttttcctgagaattttcaatccacaattgcttcaatccgcaaatgcagaaaacacagatatggagggctgactgtactaatgaatccacaaatacagcatttcatttgctatcaaacatcacaatagatacatgaagcttggaaaactgtagtggcaacatttaagatcattttgtacaatctccatgcatttggaaaactatgaattctcagttttattgaattacaaagaataggggtatttagttttaaaagacaggaaattgtttttctgttgttgtttttttagatggagtctcactctgtcgcccaggctggagtgcagtggcctgatctcggctcactgcaacctccacctcccaggttcaagcaattctccctgcctcagcctcctgagtagctggactacaggtgcccaccaccatgcccagctaatttttgtatttttagtagagaaggggttttgccatgttggctaggctggtcttgaactccggagctcaagtgatccgcctgcctcagcctcccaaagtgctggggttacaggcgtgagccacaatgcccggcctgtttttcacattatatacataaaacaagcaaattttagaaaagacacaacatgcaaaaaatgtagaaagcaaaaaaaatcctttgttatcaccattacatccatcattagttttgacacatttccttctagtcttttaatatccagttttttaaacatgtttcatcatcaaaccacttacacaatttgcataaaagcagatatattgtaaatacgtatgatcatcactgcatggtagcagtagctttgtgtcacactatattttacatcttctacaaaatttagggtgatcaaaattatttcacatcataattactataacaaaattatataatcttggttttcagagaacattcttatataatgatatacatttccagttaaccatatgcttaaacctattaatcacacaatccagtatataaaaatgtacatggttttataactatatgcatctctaattaattaactagaacacttttttggatgacttacctttaattgttgttttctaaaagtatcctgaattcctgtgtactaattttggttttagctaaaagaaatgctctcaaaattacgaatgttttcccctagcattctgctgaaatgttggcagcttaacatatttggctttagtaattcatcctatttccttgattggaattgatctcaacaagacagtatgcatttggaaaacactgattatatttaataaaaagtgaatgcatgtcaaggaacattctactctgtgtaatgaggctttatagattaggtctaattatcactgatataaaactaaaaatcctttatatgctaaatagcaattagctttcctctccgaacaaaaatctagtgaacttaaaatcacaaagacatctttggcataaataatacaagtaagaatctgataacatgaaacaaagacttttaaaacgattaaagtttctaatatgttttatgactttaaaactgatatcgtgtatacagaatgtgtaacactgtggttcactaaaattctaagaatctggtgacagatttagtctaagtcaaaatctttagtttttaaaaaaatagaaaaccctagaatatatttccatatatttctataaatctcagataaacccattttgacattttagaactaccaataaagagacaggtagatctggacataacttctttctttaaaagtcatggactacaatagaaaataggttacatgatgtatgcaaaagattactttttcagaaaccttgagttctagttatgtctcagccttgtgtgtgaccttaaaaaattcctttaagcttccaaactcaaaataaacctcttacagaatgagggagaccttttccatttcaaaattataaaattaaagggtaagataggatagaaaagctccctattcacaaagaaaatattaattgccaaaaaacttttctatgcattataatgggacagaagagagagaggttcaaggaagaaggaaaatatcaacttcagctggctgagcattttagccttttgaaacatttttatgcatatgatctcattttaatcttgccataatcctatgagacaagaagtgtaattataatcgtttctatttggcagataacaaagtggatggaaaagggggcattattttgttattgttcagaattacaagagtatttcacggattaacaagaatctaggtctcatcactccttaactgggacccctttcaatgcagctaaagggaataataagcacatgcagctgaatacaactaaggaacaaagggaaagcattaaagaaaacatacaggaaatgagatctccttggtgggttctttttgctgactggtgaggatgtgtacttaacactgtaagctcaaagggagctgtggtgatatgttcagaaatgtgtaccacttaatgtaaaaactgaatttctgcaaaaaccagaaatttcattcacctaattttaagaaatgacaaaaaaaaacttatcaaacttgtgaaaatgcatcatatagcgtggcataatcaaatggacaagattcttccaaaacactagggcatacatatcctcttttggactgacttataataatagggtcttcatattcaaattagtttttaaaactagctgtacttttcagaaaactaatgttttcctatatttcatatgaagatgcagatgcttttatacctatataaactgtaaagttattggttgaattaataaacagaaaaaatttacttaaatatgaaaaagatacctattatgtcaaagctccttgttactgaaacatagttaattgaggccttaatgagtgcttaccacaaagttatatgtatagccatatgaactaattaaagaaaggcaatgctccagagtgtagtgaaatttacttcatttaggttatggtactactttttggttcaaagactatactttttaaaaagtggatacctgcggtccatctctggcttcatagaagtcacccactcttatttttgcactgaagctgaaattgtcccttgagatatccattattccatttctgctgagatactgaaaaaatcacatatttttccacttcaggttttaataattacaacccagctttgatgtatagctagcttcaggacactaatgttttgcatattctatcaaggggctctaaatttataggagatcaatttaggttaagtacaatagtcccatacaagagaatatttagtatcaaggaactttatctgagaaaggagtacactttttttttgtacatgatcatgcttaataggcaccaaatgtacattatttggtgaaaagtatgtacctttattacttcagggtactgcctaagtttctttccacatggagcataatatgctacttctccttgaaggcgccctccaaagtttcttattcttgtctctctctgccagctacacataacagaaatgaaggttatgacatacttaatttcaagaaagcttttaaaaattaaaaataagttaaagtatacatgttctctagaaaacataaaaaatgaaaacaaaaataaactcctcaaacaacccaaatacattaactctcaaaattatttagatttttagctaattcaactagaaaattaattattcaatttatatattaaactccatcaaaatttttagaaatcatacttgattactttgggtactctgacatttcagtaacatgttaatgtgtactgattttttacatctgaaaagctttaagggaggagtaaagtaaacctggctctctgctgcttggggttcacgtacatccagtctaaaagctgtcatttctaattaaaccattttagccaaactctggttgagtccctcaattttgaccaaagtggcttttactgtcctttaattctatcttcacaaaaacttctcacagtctcatgtactcctgccctttgccatctgatttgctcttggttctttttcagtcatgttcctacttggctgtatcatcccaccccagctctgccatacctccaggaaacaggattaatttcagttttctgatataccaaattccttgccctttgctccggctcttctgctctaataaatactatgcagctatgtacttcttctattaattgtagagaatgagaaatcaagtatacatcaaacttgcataaatatatgggggaaaaagaaaaaggaaaaccttattttgcatacccatattccaatggaatacgcagttcacgttcatctgttactcttcttcttttggaagtgcctttaaaaaaattcaattggttaatataaaacattcattaatataaataataatattgatagtttagaaacttttctttaaaaaagtatatgttaataacttggatttagtgtatttctgtaatttatacattatttttagatggttttcaataaaacactgtataaggcagggggcttttttcttcttttgggtctgaatgacaggataactagtttttctctctaaagaaaatacaatccaaggtaaaaatatacacctttcctctcattttattattaaagaaatggctagagaagcaggagagaaatagaggtttcagaaaatctatttaaactgttgactttgaaaataggagtttttggatgctgaaaaatttcaacagctggctcatatatttaaagacgatttaatttctatgtccatataaatccatagtcaaaaacactaccaggtcttttaattaacctaagccaccaaggaacaggattatgattttatgtaaaaattttctaagaccgagatcaagtttcacaaacacaaataagttcatctaaaattagtaggctatcatattggtatgtggtaaatgaaagtaaagctagaaactgacaagaggagagtgaaataagtaaaacaacaaaatattttactatatacatctatattttcttagacattgaatgagaactgagagtagttgtggaatattaagtgtataaatgtttaatgaagacctctaggaatttataaaaagtcaaatgggaaaaaaaaggacatggcacgttaatggaataagaatgctactctctaatagaaaagacactggctatatattgggcagatagcatcttaagtaaccaagtgagcttttttataaagtacagttggcccttgaacaatatgggtttgaactgtgtgagtccacttatattcagattttcctccgcctctgccacccatgaaacagcaagaccaatccttctcctcctcagcctgttcaacatgaagatgagaatgaagatctttataatgatccacttccaggtaatgaagagtcaatatatttcctcttgcttatgattttcttactaacatttttcttttctctttattgtaagaatacagtatataacacatacaacatacgttaattgactattcatgttatcagtaaggcttctggtcaatagtaggctaacagttaagtttttgaggagccaaaagttagatgtagattttcgattgtgtgtggggccagtgcccctaaatcctgcgttgttcaagggtcaactgtacaaaaaagtccaactgtcaattaaattctatattctagaagcacaaactgaacacaaaagcagaaaggttcaaaaccaaaggaactatcatcaatcagatccttaaactggaaactcggggggaaaaaaaagaccaggtaatgagtcatatcctttgaaaatacaggctcaccttccttagccaacctaaaatctaactttaatcttgattccagtgagatcatctccagaacactcttatcaataaaaattcttgctatggtttgacttctactttagaataataaaaataaagtgtaggtaccagagtgtgggcttgaagtaagtgtggaagaagatgtaccaagaaaagcaggtgactgggattcagaacataaggcagcaggagcagagcctggggcttttgctatgtggaggttacgaggtgttgagtgacctgtgagactcatggaagggcttttgacagaggaagttgttttattcagtttcattgaagttttctctccttcagtatcactatctgattcatcttggtctttatcatcatcatcttcttcttctgatccttctgtatctgattctgaattactatctgattctgggaagtaaaagaagcatttgtatattataactagataatcaccaataatttgcagtttgtatctaaatggactagctcaggaaccagcacctgtgaatgagaactcaaatgagcaattttcctacagagtaaatgttataagctatttgagaacagtgtatttaggctatcaatcttcaaaaacaattttttaagtgtaagttttactcaacactttaaacagttctcatgtgacactattcacatgatgagttctgcttaatggcatcaaaataattttttatttaacagagaaactaaagtaaaagaggggattaaattgactgttcaaatgaacagattccaatggcttatgaagtacagtaagtcaaatatgagaaagagaaatctgaaactaccagcatacttccatttgggctttggagtaaaagaagacaattttcaacaggagattcttggtcttttggctgcagtttttctatttacatacaagacttcatcaggcttttcaggcctctcaaaaaaccaggcttacagaaataattatagtaggataattcaataatttaagtttgttctagctacgtagttctatgtatgatgcatccattcctctacatatgtaaaatctattactagattaaacttgataaacacaggagtgatacttagactgtttcctcatagttcacggtacaatagcttctgtggaattctggtttgtgttataccatttgcctatattgaaattcattataaaagttagttttgaaagttatgaatattgatatttatgatctatcatacaaagttgttttatggaaaccccaggaagagtggttttaccctgagcacgaagtttgtttttaacttacagacactttaaattgtacagctgagtatattttcctattcatattagctgctaaaaaaaattagttgaatctgtagttgaccagtaacaaatccacaaacatttataatatgtatttcatttttgtattcgcaatttaagctctcttgtattttatgttttcagtcttctgtggaatgaggagagggaaggaaaataaaaatgcaaagaagttaaccctagacccagcaaaaagaaaaaaaaaagtgactcaaaattaaatcagagagtcctctatatgttatttaacaaattttctgttattgatgaacattcatagagatttaggtttttggtactttctgaatgacgactataattttatctgtgttcaaaacagctggtgatgcattttaacaagtagcagaagaaatgaaaaaagagtggtcctgaatgaaataaaaattaagcaagttgatgaaattatgtcttaatttatgcatcatttgtattcaccctaaagtgattatttgtttaatgtcaaatgaataacaagctgagaatctgacttaggatttccagtatcaattactcctgtattttatgagctcattatagaaatgcacaaagttgtgtgaaacatagtaaatgacgctgattttaagtctgaattaagaaaccctttaaaatgtttggttcacatagcatttagagaaatactttaaattttaaaatgaaaataacctgattggctgtcatcagattcatcatcttcatcatcttcctcatcttcttcttcatcatcttcctcttcatcctcatttgaatcttcagaatctttactactgggaatgtctgaatctgttcctctgaattgttccactaaagattttgcaggatgggagtgatgctgtgtttttactgggtttacattattgctaactgctttttccttcccttgactatgcaggatgggagaggcagagggcattacaggtgtctgattgccaggggttcttctcccacttgtactcagatttacaggtgaggaaaaaggggtgctacttgcagcagcaatgttttcattaatcttgctctgcattttagttttggtagtaagtgctagaggagcttcttgaatgacactttgaataactccatttggttggtgattacctaaaagtgcatttgtcaagaatggatttgggtggttgttttctaatgtttgttttggatgtgctggtgaactagaggttgcttttggatttgacaaagctgcaataaccttcttcaggctcttcgatgactcttgtttctttaactgtgatgggaatgcctgtttatattgttcctgttgaaacataagttaaaaaacacaacaaaatgtaccacaaaacaaagattgcttttatttgctttcaatatctgaaaacaaattatagctattatatcatatataaatttaaatcatgatatacaaatgctgtaaaagtagcaacagctatgactagttggttgctacattttggctctaatttattaaaatttatttagtttttccccattaaaaattatatgccttttgactagcctcccctctttactgttgcttccattttcacaataatccaaacttaaaaccattttctttgcatgaaatagcctcctcttagaaatttcaagctgacaaaatactgtttattcttcaagatccaaaccaagaagctttccaaatttcccagccagaagcattctttgcctctttcctttgagctcttttacctctttatatagatgctcctcagcttgccatggggtgacttccccataaactcatcgaaagttgaaaatatcattaagtcaaaaatagatacaatacacctaacctaccaaacatcatagcttagtctaaactaccttaaatgtactgaaaacacttacattagcctaaagttgagcaaaataacctatcaacacagtaaactgtagagtatcagttgtctgcccttgttatcatgcggctgaccaggagctgtggctcactgctgctgctcagcatcaagggattattgtaccaatttctactgaatgtgtatagcattcgctccattgtgaagttgaaagatcataagtcaaagaattattattattattattattattttttgagatggagtcttgctctgtcaccaggctggagtgcagtggcgcgatctcggctcactgcaacctctgcctcctgggttcaagtgattctcctgcctcagcctcccaagtagctgggactacaggcatgcaccaccatgcctaggtaatttttgtatttttagtggagatggggttgcaccatgttggccaggatagtctcgatctcttgacctcgtgatccacctgccttggcctcccaaagtgctgggattacaggcgtgagccactgcgcccggccaagtcaaacaattctaagttggtgactatatgtactcttatgccataccacctttagtatacatagaatatgcctatatgacttatacctctaaggagataacttaacatctttgataaattcctcagggtagaaacactcatttattcacctttatggtcttcctaagacattgctcagaaccctgtgcttgatatgtactcaaaaaacaattttaggttgctgaatgaataacttcctgagcaagaacttctttgaagcaaagatttaagatactaagctggtggaaatggacattcaacattctgtgggatctactttagtgtgcctttgcacagtaatattcccgagtaaacaatttagaaaaatacaattttcttggaaaagattataaactattaagccataaaatttatgtctataaacaaaaacttatttaactattagaatccccttgaaaacaacacaatcatgaattttattaagctactataattaaaatattacataaaaattaacagcagcagaattattaaaatcctttgagttaacagaaggagctgaatttcttaatctaaggtaaaattctgcattgaaaatgattgccttgaaattaaaatcagtagtgttgtcagcatcagacctgggctcctaacactaaaatcagcaaagatttgtgatggagatttcacaagtgtaaatgctgatggaatgttatataaaatacttataaatattttattattattatttttttggactctgtcacccaggctggagtgcagtggcacgatcttggctcgcagcaacccccacctcccgggttcaagcctgcctcagattcctgagtagctgagactatgggcacgtgccaccatacctggctaatgtttttgttttttttagttttttttttgagacagagtctcactctgttgccaggctggagtgcagtggcgcgatcttggctcactgcaacctccacctcctgggctcaaacgattctcctgcctcagcctcctgagtagctgcaactacaggcacaccccaccacgcccagctaatatttatatttttagtaaagatggggtttcactatgttggccaggatggtctcgatctcttgaccttgtgattcgcctgccttggcctcccaaagtgctgggattacaggcgtgagccaccacgcccagcctttttttgtatttttagtagagaaggggtttcaccatgttggccaggctggcctcgaactcctgacctcaggtgatccacctgcccttggcctcccaaagtactgggattataggcgagagccaccgcactcagcctgaaatacttattaaatattttaaagcagcagtactaacaagcagtaagcaatgtaaactttttatcttatttaacatctatactgtattagtttagaaaattgttaagataattctttgtaaataaaaactgtcacaaaatatttgtacctaaggcaataccttacaaagagaaagtgcttaattagtaattattcagtaaattctagaaaattatgctagttagatgtaccatttcaatgtaattttatagcaaaattcttacataaaatactttaatatacaagattcaaattttcagcagaaaaattagtgtgttttcgtttgttagaacataattatgtcatgtaataattttgtaatctttttttataggtagtaagttttccttctaaatatataggtctaaagggccatgaaaacaaaagtccctttagtattgtattttaattttctgcaactgttcctcactgtaattctgaagaatcacttcccatatattgacaccaataagtttttaaaaatagccaaagatttctatattttatcccaattactcttttatagtacacatattatcatttttaaaatcaggagtgatgtgtaaaaaggagatggagagaaaattgagacctgtatagcagcaaatctcttgctgctttaagatatccatttggggccaggtgtggtggctcacgcctgtaatcccagcactttgggaggccgaggcaggcagatcacttgaggtcaggagtttgtgactagcctggccaacatggtgaaaccacatctctactaaaaatacaaaaaaattagctgggcatggtggcgggcgcctgtagtcccagctactcgggaggctgaggcgggagaatggcgtgaacccaggaggtggagcttgcagtgagcggagatcttgccactgcactccagcctgggcaacagagcgagactctgtctcaaaaaaaagaaaaagaaaaaacagttgataaaagaaagctgacagaagatctacaaaattctactcctggtctatgtattcaatcaatctatatggatttaagtgacattttcttcagtgtaagggtactgaaggattcaatgattaaataacctttaagaaaataatgaactaatgagggatgcaggtaggtacctctacctcaataataggtactgacaaagagaaggtagtaccttttagagttgagtctaatgtaaatgtctaattttatcatctgtaaatgaggataatattagtagcactcatagatattattaccaataagttaacgtatgttcagcaattaaaacaatggctggcaaacagtagatgccctacaagtgatatctaattaagtcgcctaaagataatatttgtaatattgtgttcaaacataatggtttcctactctaggctgattctagaataaaaagcaataatcatttaattattagaattttttgctggacatatgaatttagtctatgtagtaaaatcaacagcaagaaaaacaaagatgagaaaattctctggagtgtttccagtgtttgtgtaagtagaagttatatttcatataatccattaagaatgacaaaggaaaattttttttttttttttcggtagagacagggtctcactatgttgcagaggttggtctcaaactcctgggctcaaacagtcctcctgccttggctcccaaagtgctaggattacaggtgtgaaccaccatgtctggccagaaaagtgattctttatgaagggtttttacacttaaaatgtgtacattctaggactacagaggtaaattacttgagttcacttctttgaaaaagaatatatttggccggatgtagtggctcatgcctgtaatcccagcattttgggaggccgaggcgggcagatcacttgaggtcaggaatttgagaccagtctggccaacatggtgaaaccccatctttactaaatatacaaaaattagcctggtgtcgtgacgcatgccagtagtcccacctactaggaagtctgagacagcaggatcacttggatccgggaggtggaggttgcagtgagctgagattgagccaccgcactccagcctcggcaacagattgagaccctgcctcaaaaaaaaaaaataaaaaaaaattggtattaggaaaaaaaggacattaattttaaacccaagtaattgtgaagcttgtcttactcaaacatatttatccccttatttctaaatccttagatcttgggtgtggggacttaccttaggcatgggttgcaggggagctggaatgacatgattgcattgccaaaaatacattaaacagatacatatatgaatataaaatcagagaaatttagttttctgctgtacatattctattcctggagactaagaaagtataaaaatgaaggtagaatttaacttaaacttgtgtattgtaagacaatatagaagctctatctttctctaatagtaaaattcttgtataaataatttgtaactcacccgtttggatctcaattcactggtcaataaactagattcttcagaggtatttttattccctgctttaagaacatcaggagaaggaactatgagtttcatgtaagtttcctttttggcttgatttaccaaagataaaggtttcacattggacaccaatcccgtagactgtattacactggtgtgtttgttcacagattcctcctttgcctgagagctttggaaaataaatggaagctgctgtgacaaaacctgaggctgcttctgctgggattggaatgagtgagtctgggattcagacgcaagaggtaatggctggtgtattcttttttcctgggctttttcagttgctttctgtccatctgcttttgggtctgaaataccatgtaatagcacctagatataaaaatgaaaaggtaagttcctaacatctattaagacaaagactatcaagcagtaaaacctggagataaaaacgggtactttcaaagtgttcttaatgccttatgataatatctaaaaatctaaaaattcgtaaaagaaataccgtatgtccctttaaaaacatttcttcatcttctttcttgggcaaaagtatgaactcaaagtaatgattaactttaaaactacagactttgagagtcaagataaaccagttaattcctaaatatgaataatgtttggatactgtccatgaaaaaaattatacctggttgttacttttatgttgtgcttcactctctgaatcagaatcatcatcttcactttcttcaatactttgatcttcttcttcttcatcttcttctagatcatctgaatcactgctactaatgccttcacttgaggtgtctgatgatgtgcctgaatcactatcactgttgctagaactttccattgctttcttccttggtttctggataacgacaaggtagttggcaagactttatttttggaaaacattcaagtttcaataaaaggtgtactctttttaattttcaaatgatattttcaatctcaaaatgtcattgtaggaaaaagtcacatatcgtaaggataattatttaacaaactgatcaacttaacttacatgacagaactcctcaatgaaaagtgcaagctctgtcatgtagaatattgaaaatatcaatatagcatatgtgtagatgtactcatatgactgttattcttcaaaatgtatgacagattaaaaagatcagttcacaaaataattccaactatgatacatacatcaaaagttacacatttagctttagtcttctttctttttgcagacagtgagtcagtagccaaacatttacctataacatgccacacacacctttctgggtatgtccaagactgagtccttgccttcaagaaacttactagtgctggtgataggggagggtacacaaatgcttaatataaaagcaaattattccatataataataagtgctgtagagaagataaagtagggtagcaaaagacctatggggctgctttagttagggtcaaggaatttaactgtttatgtttcatttcagaaaatattaaaaaaaaggtagaagatgaggtagataaatatgacgagagagatttatttttggaacatttaagactctgcaagaaaaataaaatccaaagctggtagaaagtggttattaggtcacataaaagtgaagttttgtgttcaagaaaacataatagtagtggacaaaaagaggaaaaatcatgagatgtattataacaaattaacaaaccaatcaattaacttataaaagaactcctcaataaaaagtacaagctctgtcatgtagattattgaaaatattcataattatttaacaatgggaaagttaaaatttcaccaatagaaagactgaaaaggagaaacattgaaatgatggagccacaagattaagtacaatctaggaacattttaatggcatttgctgataaagaacaaaatatagaaaaaataacaataaattacaaaagttatgatcttaacagaaatacatccttttatgactactcgggattggggaatgaaatacagtaatatatctccacaacagagagccaaattgaagccacggttacagattgcaaatctgtagtctttttattgtgtcttctgaacattgattcaggtaacattcatatgagtgaggagagtcactcccgccattatattccgtttgcaatgactcttgtttttttttttttttttcggggacagtctcgctctgtcgcccaggctggagtacagtggcacgacctcagctcactgcaacctctgcctcccaggttcaagcaattctctgcctcagtttcctgagtagctgggattacaggcgcctgccaccacgctaatttttgtatttttagtagagacggggtttccccatcttggccaggctggtcttgaactcctaacctcatgatgcacccgcctcggcctcccaaagtgccgggattacaggtgtgagccaccacatctggccttgcaatgactctgctttaactgctccaaactagttacaagaaggcctctttcaaagatacacacttcaataagcagactaatagttcccatcatttcttgagttttcttccctcaaagtagggcagacaggaacgagaaactgaattggaattgtatgggtacccacacaatgagaaagatcacaaggtagagagattaaaggaaaataataatatattaatattaagactaccatttatttgtcaaagaaacagctacttctttgcaaccaaaatctgttgtagttttctaagcatgtatagcaagaccacgaaaatcataaggtacctaaactgaaattaacatttttgttttagtaagggataacaaagaaaagaaataagagagctacagtgatttagcagagaaaaattaactcctatttaaatgcccaaggaataagtgtgtagctttttatttaaagatggcatgagaaatggggactatactccccaggaacagtcatccagaggtactggttctgaagctttagggtgcataacattcctgagtcccacttctagacagggcacttaatgtgattctgatgcagggagtctctgccgagcatactttggccatgtgtaaatagttctatttttataaggtaacacatttagtactcattaaaacaaacagaaatgagaagacaagtgtgagtattagagaaatagggaaaaaagatgggtttgtatcaccagtttcattagagtatatatgtgtcatttccacaaataattagctagtaagtctcttttctcttatttaaaatgttttattacttacaaattttttaaatttaaaacatttttttaaatgagtcagggtctcactttgtcacctacgctggagtgcaatggtgctttcatagctcactgcagccttgaactcctgggctcaagcgattctcctgcctcagccttcaactagttgggactataagctaaaacattttaaaagttagtcttcttaggtttatcaaaaagtgatcaaagaacagcttattaattttcccccatccaatctgggaaaacttttcagaaccttatccttgaaccttcatttcactgtatatttatttcttttagtaacaaaacaaatacatattcaaggctatgatgtaccaggcatagttgctcaagtctctggggatacaagggtgtgagaaacagacaccagctctgcctagtgagaactagaagaagagaatcaacaaacaatttaaataaatattttgagtgataaataccataagtaaaacagaataactggatagacaatgtgtggtggggagtggggtggggttttgctttacatgtagtcagcaggtaagacatttctgagctgagacctaagggagagcaagagccaatcacccaaggacataagagaagagcctttcaagacgggaaacagcaaaggaaaaagccaccagctagaagtgggttgagtgtgttccaaaatgaaaaggtcagcagaccagttagagcatagtgaaccagggagacagtgataggaaataagcatggatgaactggtggaggtcagatcacacagctcttataagtcatggcaaggactttattcccactgggatagaacactagtggagggagtgatgacatttgatgtatacttccccctcatttttttattgtggtaaaatacacataacataaaatttactatcttaaccattttaaagtgtatggttcagtgatattaaatacattcataatgttgtgcaaacatcagtgctatccatcctataaaactgaaattctatacctattaaacactaacttcccatccctccttccatgctagccactggcaacaatcattctacttcggtctataattctgatgagtctaagtacctcaaataagtggaatcatacagtacagtatttgtccttttgcatctggtttacttcactttgtataataatgtcctcaaggttcatccatgctgtagcaaatatcagaatttccttcctttttaaagctggataatactaacatgtatttatgtatgtgtacacatgtgcctccccatgtattttgcttatccagttatctgttgatagacactttggttgtgtctacatttcagccattgtgaacaatgctgctatgagtatgggtatacagatacctctttgagacactgctttcaattttgggtggtatatacccagaagtagaattgcagaatcaaatggtaattcaatttttaattttttgaggaactgccatactgttttccacagtggcagtatcatttactattccctaacatgtgatactttcaaaccataaaaaatcagatatgtttttaaaggctattttggttgttgtggtaagaataacttgtacgacagttgggataaaactcattcaaccttgaattgttttattcttttcttaacaggctgtatattttagtcttagtttaattatttaattaaaatatcaatatttattctaaatgtatatgcagactatatgaggggactggacttaatcaatgactttcaatgagaatggctgagataagtaccccacctcccatgggaggtatcaaaattagctgaacttttttttcaaactacatgtgaaaagaatgaatgaagcaactttttaaaaaagttttgaaaactgaagaaatactgggtgaaaaagtataggattttcttctttagttccaatgccctttatctccattttacttgagcaacccactcccacaaacccatgctgaaccacatatcatctgaaagtgctgttcttttgaaatcataagttctagtatgcctcacttgaatagacaatctctctataatgttatttctgcttagttgccttagacactactatggtacctcagaatctatctctaaaactgggtagaaagaggtgcctctttgagttttcagtatgttctcctagtaacagtttttagtatgacagcactgattctgtttaggaatgtcaatgtagattcctcattagaactaagtacaggaactgtgtcatattcatgcctccaagatcttgtacaatgccttacacattgtagaggcaacaaagattttacttgattttagcactacttcttaagaggtaggatagcataagggttaaaagcatgggcatttaacttttggaagcacatataaaaatgcatccaatgatatgatgtctgggatttggttcaaaataatatgggaatcagaaatggatggtttcagtcagtgtctggcatcagagaaactggcagtagctcagagataggaccttagcgcttacaccgagactgccattgaaacaaatcctatgggagaagagccaagagcaggtacagaacaacaggtggagagtatgacactgatacctgtgtccctgggaggaaacaattaagaatcttttatcatgtttgcttcagtgctcagtggtgtaggttgaaagggaaagaaaatggttgtcttggggcctatgtacagtacttttgcatttttgtgatgggtaccgtcaagcttcttagcattaccagatggccttcccccaagtcttcatataagcatgttatactctggaaaatgttttctattgagaaggaaatttaaagatttagaggaaatatatctatgaaatatgctcagcaaaagaaaataaatgtatttgttcagttctgtttcatttgttccagaaaatatatggagcttgatgctgtcttgaaaaaggataaagaaagtttgacaaagtagttcttaggattaaaaattggtgtataagaggcagtagttcagatttaaagtttggatcaatgtcatgtgcagtcagtgactacccatatcttgctattcttgttgtgatgtatcagaagcttcctgtcacaatattacagctgagatggtgaagaacatcatgtgtgtaggatcacaaacttttgactctcttccactggaaaaccaggccctgaaagcagtttttataaaacacagaagagaagacacaactcttatctttgtttcccaaatgtttgcagttgatgacaaggctttaactgggacctctcactcaagaagaaattaaaaattggagcagactaaatccactgataagagtgttctaatacataatatgctagatcatatagttagaggcttctcagcttacttagttagataaatgaaacctggactcaatgatgacctacattttataaaattgagatgtcacagcttctgacataatgtggaagagggaatccaaaagtgcagagtgatcagaatgtagaagtgaatttaccacctgcaagctgcatacccaccctactcctggaaccaatgataagagccaacaagatctactcaggaggaagaaatcgcattaacaatctgaacaggaaaaatttaacataaagaattattgattaataacagaagattaactactaagaggaataaagtgacctctaaataatacaggaaaaggagatgtagggaatatgtactttttgtagggctaaggtagagtaatgaaataaagataacctttgaaaagggactttttcccccaaccccttcattcacccaaggctaagtttcagactttgtgggagaggatgtggctattgcccactggatggcagagaaactcaatgaggtatcacagtcaaggctgacacacacaaaacactgcttgctaagataccagaaaaacatggctgggaacctgtcagctacagtggcagtaaaattagtttgaaagccacctacttttcaaaacttgctagtaaactgcctgctgagatgccaatgaaactcactagacagtgtatactactgggtctcctgaccaccactggatctcctggataccaccagtagagaagctgtcagccagcaagcaagccacccattggcagccacagcgtaagaaaaagaagaaaacactagaaccagaaaaagaagtcccagccacatgtggtggttcatgcctgcaatcccagcactttgggaggctgaggcggtggatcccttgagctcaggtgttcaagaccagccttggcaacatagtgagatcccatctctgcaaaaaatgtaaaaattacctcggtgtggtagcatgcacctgtagtcccagcttctagggaagctaaggtgggaggataacttaagcccgggaggtggaagttgcagtgagctgagattctgccactacactccagccagtgcaacagagccagactctgtcaaaggagaagaagaaagaaaaaagaagaaagaagaagaaaaagaagtaacatcttcttccagtgttcttccaggaccttctactaacaaggactaacactgcaagaagtggcaaagaagaaaagagtgattgagagctgagaggcaataaattgataacttgcaaagttggggatatacatgaaataaaactggccatgatgcgacaactgttgaagctgaataataggtacaaatggtcattctgtctactttgtatatttgaaagtttccataataaaaggttttcttattcactcttttctaatgcacaggagttaacccacttgctttcaaatcctggctcagtcacttagtggctaattattttggtgctttgcttctccatttgtaataacagtagctacttcatttcggatacagggaagagttaaaagttatatgaaaagcaattagagcagagctgatatgcagtgaattctcaatacattttatctattattactatttgtattatttatactggtactgacaccataaatcacgtatctataaaaataaaagttggtaattcataagaaattaaaccatagattctgttgatttgaccttcagaatgctcatcttatatatagatctgttatatattagtccttccaagtacaacttaccttatctttgattttgtcaactctagcatccaaaggctggtttttgctttgttcctgattacattttcgatttcctccacctgagcttgtacttttagtttgtcccatggaacttgaagcagtagtggatagtacagatgtgttgataccaattacagatgatgtattacttccatttattgacccatttacaccttgaaaataaaaataaacatgtttatacaatggaatattattgcatcatttaaaaatgaagtacagatatatgtacagttggatgaacttgaaaatatgataagtgaaagaagacagaaaaggtcatgttgtatgattccatctacatgaaatattcagagcaggtaaacctacagggacaaagtgaaaactgatcgcttccagggctgagagagaggggaatgggaggcaactgcttaatgggtacaaagtttccttttgcagtgataaaaatgtttcagaacaagatagaggtggtggttgtacaacactgcaaatgcattaaataccagtaaattattcactttaagatggttaatattatgttaagtgaatttcacctcaattaaacaaaatgtttagaaagataatgaaatgcaaaactttgtgttttaattgtaaaacacattagagaactttgtaaaacacttcagtgaaaagaaagatagtaaatcatctaaaatgttgttataattttcaaattatattctaacaagttattaattgcagaaatattagtgatcatttaaaaaagtactaggttattaattttaatgaagttaatacttaattacaaaagaagtaacacactatattgggttacatatagggaggtaatgaaatacagaggaaaaaacagtagaattgggctaaaatcctgactaggccacatccatatgtaagtagtattttcttgaacaacttatttgaccttggctgtaaaattaaaatacttctaatctcaaagaattattttaagaattaagcaagaaaatgtgaaaaggtctagcataacactataaaactgttattaaggccgggtgtggtggcctacgcttgtgatcccagcgcttttggaggctgaggtgtgagtattgcttgaggccagaaggtggccagaagtttgagactgctggaaacacagagaccctgttgctacaaaaaataaaaataaaatttaaacacgtagctgggcatagtggtacatgactgtagtccttgggaggctgaggcaggaggattgcttgagcccaggaggacgaggctacagtaagctatgatcatacaactgtactccagcctgggcaaaagagtgagaccttgtctctattaaaacaaacaaacaaacaaaaacaaaaaacaaaaaaaggtattaaacctgaacattatgaaaataatattagaatggaagatttatagtacttcacttatgtaaatgtggatacctttttcgggaccatttcgattactttttcccgaagtccttgaatggaatgaagaagaatcatgattctgggctgggggagcaaatagtggtggaattcccagtaatggtggaaagaaggttgctcctgtacgagtatgagcatcagttgttcgccaccattctgcacctcaaaaccaaacaaaccaaccaaacaaaaatatataaattaactttccagttaacgtcacaatggctttctatgttttatttaaaaaaatttcaagtttcatcttggaacaaaactgaattactcatacttctgatcattttcctaattctaaacagtagaacttgtacacttatcactcttctcattaggtcagtatctaaggatcttcacttggcagctttgtagagttcaaacttgtaaaggacaaaggtagtccatagtttaaaaaatgaaagtgaaaacttggaatataaaagaagtatttcactctttgatgacttatcccataacttttctcatctgtttcaaacccttagaatttaagtttacatctacaacctatgttaagactttcctcaaattacatacaatataaatctggctctgataaatcagttagtctaaataataatataagactattgtaatccactatatctcaagtacatttatggaagaaaacttctatacttaaagataaccataaatatagcaaaatcagtaggcctttttatgttctaaaaaataagttctcaaaggagatttcaaaaacaagtaatttcacattaaaatattaaagatttataaagcctctccccttaaagttaatgatgaaagcctgaattttgtttttacttccactcattaattacagataacaatgattgttttattgatataaaatgaccagtggtagaaaatcattcaataaaaggtaaatacttaaatagtgtctcttaaagttttagaaaaggaaataagccaaattttatacatttttcaaggaaggatgaagtaatcttatattgacccatctaaaatctcaaaaacaatcttctccaactggctagtctgctagattaccaaatcagttattatctttcagaccaatctcccaaaagatatggggtatttttcattgactgtgacaaccataagaacattagaggaaaaaaacccacaacaatacagtatgggagaaactcaaaattgtcagtctttatattatataatattaaaaacttttctaggaatatccttcattaaaaatagaatgtaaaatggtatgcaccttcattatctaatggcaaaatctggtttaaaagaaaagtgaaattttcatggtagctgccagtctcaaaggtctaaaaaacagtataagtagaaaactgcaaaagctattcttctgcactgcaggaaggcattactagtaaaatgacaccaatgtatattcagccatgcctgaacaatgggaactgaaccaagaataactatacaaaagcattgatcatttatccaccgtttagatgaaagatgtacatttagataggaagaaaaagtatgtgttttgggcttgtatcagcacagtcacaatcttgttatttataagtttgaaagctaagttctacctagctgataaaaagttactgtactgaggaccaggcacagtggttcacacttgtaatcccagagctttgggaggctgaggtgaaaggttcatttgaggccaggaatttgagatcagccttgggcaacagagagagaccctgttgctataaaaaattttaaaaagcagggagggactgaggtttcccaaagatatttatataatttaacacagagtctgtaattaaagtggaattcatagactttgtaaacaaccaaaaaattgctaaggtaatcaaagtgtaataagactcaaatattttagacataatcaaactcagaaaaaaaattttaaaaagtattggagaatgtcaatggtaaataagcacatagctggtgtggtggtatagttctgtaatcctcactactcgggaggctgaggcacaagaatcacttgagcctgggaaatggaggttgcagtgagctgagatcgcaccactgcattccacagcctgggtgacggagtgaaactctctcaaagaaaaaaaaaaaaaaagtaaagaagcacacagtagagattagagaaaacaatgggaaaatgtgtgttataaataacctgacaccacagaagaaaatacaaaacaataagatcagttaaataaaaagatgtgaatggtagagcttctgactataaactttacaaatgtctgatactatttcataggaaataatttttgttaagtgacaagcttgtcttctaaatttaggaaaataaacaaaatttagtcacaaaccagcttgttgacaaaatgaaaaatacaaaataaggattatataaatcagcatatggtaaatttctaagtatattcaaaagaaagaacagcatagtagcaacatttaactcttttttttttttttttgagacagaattgtgctctgtcgcccaggctggagtgcagtggcctgctaggggctcactgcaacctccatctcccggattcaagtgattctcttgcctcagcctccagggtagctgggattacaggcatgcacaaccatgcctggctaatttttgtagttttggtagagatgaggtttggctatgttggtgaggcctcaagtgatctgcctgcctcggcctcccaaaatgctaggattataggcacgaggcaccatggccagccaatatttgacatatttaactcaaagattctattaataatatttcagaggacataacagatctcaatttgaacctagaagatttagcagaatttaaaaatcgttcatacttgatagagccaaaaatacttcgcaaaaattcatggtaatttaatatgaaaattaactacaaaaaagtacaaatattttttaaattatcatgaaatactatttcaatataaaatggaaataattttattatgctaatacccattaaataaatttacatttattgatttaatctgaaatgcataatactttagaaagtgcataaaatataaaaaattattcctcattaaaaactcctagtaatatcttcctgttgtgtcctcatttatttactgggcaatttaaaagtctggcaatttggttacccttctgaataaagccaattatagaaaatttatatttaagttactgtaggaaatctgcaaattaaacaaaatgaatctttgaaaactaggcatagtctctgcccatttggcaaaaagtatgctcatctaggcatacttttatcactaaagactctgtcttgtaattgtctgttcatctatctcctaaaaactgtaagcaacatataatatactatgtttattcttctgtttctggccttgtgtgcagagcatagtagatgtccaaagaattttgtaccttaaatgaataagtgaatactttattttggctgggggagctatcaaatttttttctatatagtagaagtatcaacattattgaactccagatgagtaattttttaaatgtgttaaccatcattctagtacaaaagacatttgattttaataatatagtatttacattgtggcttagaaatgttcaaaagcaacagtgtaataaagcatgataaaacaataaaaatatttaagatatcactatctatattgtttttatctattttgatatttattcagcaatcttgtatttcagtaaatatctgtggaatgctcatcttgctaaacaaccatgctagaaactgaataaattcctattaatatttttgaaggaaatgttaaaacttggtttaagacttctttaactgtccactcacattactcctccttagcatccctgcttcccagacaactgaattaaagaagtaatatgactcaagaaacagtacttgaaacacacatttaaccatctatcctttctacacgtagttttaaaaacacttctttccttttaaggaaggatttgataaattattaaccattaaagtgggcaaaatgaaataataatgatagttaccaattatggactaattatgtgcaccagatactgtactcagcactacatatgacttaactcctttaatcctcacaagaaccctgtaagtcagatactattattatgattctcgtttttcagatgagaaaactgaggctaagaggtcagataatttgttcaaggtcacacagctatgaactaacaaagccagatttaaattcaggcctatttgtctctagaattatgctataacgttttaaattatcttacatacactaaaacatgcagacctcactaaaatttattaaagccaaattaatctatagaaaatacatacaaatttaggctttcaagataatataacaaattgaagcacgtttgtcgaaagttttaattaactgatgtcttactgaactactaaatcctcattatctatagaattttggataatactggtcttcttccatgtaagtggtacaactctctagttgttttgatcaaatacagaaaaataggctgggcacagtggctcacacctgtaattccagcactctgtgaggccgaggtgggcggatcacttgaggtcaggagttcaagaccagcctggccaacatggcgaaaccccgtctctactaaaaatacaaaaattagccagacatgatggtgcgtggctgtaatcccagctactcgggaggctgagacaggagaactgcttgaacctagaaggcggaggttgcagtgagctgagactgcaccactgcgctctagcctgggcaacagagcaagatttcgtttcagaaaacaaaacaaaacaaacaaaaaacagaaaaataaagaaatttaagagtctagctcattttccttacagtgaagaaaagtaagaccttgaaataggagtgtaaaaatactcataaaacctgaactttagtttcacactaaataattttttaaaaaatcaaataaggctgagaaaaattaattcaactctacatttacactatgtatacttttctgtatattatacttcaacaaaaaaacatgagaaaaacttgcctgaattactctctcctgtgacagacacctatttctctagttaaatacctggatatctaattaactgctctgccacctaacacacttagggtgtttaattttttgcacatgataaataggattaagccaattcttgcaccaaagttttaaatataccaggcattagactattccttttgttcaatagacaaattattgcttgaacattctcaagctttcctccttcccttgaacactgtttgtaacagatgtttacctggaaaagatgctagttggggatgtgcggctaaggctgtgggtgtaccaagtgtccccaaaccaccaaattctgaatgccctgagctggctgaatgtagaccaaagactgggtggctgaccattgggaaggcactcgacactgtggacaggttaaacggttgatccccagctgttctgaataaatgtcctgggagggaaaaaaacacacttaaagttgtactataaaaaacagatgagacttatctgatttcagtgtttatagttaaaatttataataatttacctattacatttttattttacccttttcctgctgcattttctactcttcaaaccctataaaatgtttctagaaacatgaagacatgctaaaaatcattaaaataaatggcataaattaacttttgaatttgagatttgagaaccaatgttttaagtagataattttcactaattaaaattgtctgacctgaggaagtgaggccaattttctgttaatatatatacattaatatattttcaatatattttactcataagaagggaaataaaaaacatcctattaatctaaggttgaaagccactgaaataagtccaggatctgtcaccaggtcaatactcaaattattatacactctaagcaaggccatcccagtttcaacatgccagagttgaagctctgttctctaacacagtcatgagttgtttaatgatggggatgcattctaagaaatgcattgttaggtgattctgtcatcatgcaaacattgtacagtgtacttacacaacctaggtggtacagtctaccacacacctaggctataggatacagcctattgctactaggctacaaacctgttcaggatgttactgaactgaatacttcaggcagttgtaacacagtggtaaatatttgtatatctagacatatctcaacctaagaaaggtacagtaaaaatatggcattataatcttagggggctactgtcatatatgtggtcaggcattgaccaaaatgtcattatgcagtgtatgactatacttcttaggtgagaagagtatcttgataccaaaaagggaatatattctagtctaataaaacaatgcacaagacaacataagtacttaataaacttacaaagatatttctaaatgtgttcacaagtggttaccaatataaaaatcatttttagctttctctgagtaagacaatgttcaattcaaatgagtctgacattttaattctatttttaaagataagtgttataactccaggttggaatgttatatgataaaaacatgacttatttttcatactttgtagtaatttggcagaaaacttttctaatacttggaaatcttccctttacttccaggaaataattaaggtaccctgtcttgctactgtgaaaagagaatactctaggttatcttaagaatttactgtgtgaacagtattgtgctctgtgttaatattagaataaagcttccttattatctcttgtttatattatatcagtcctgactgtgcactgcaatttaattagttttaacatagtatgtttgaaatttacaaatgtaagttaaaaatagtatacttattattatttagttatcaaccaaatctcttctctttgctttcttgctccctgaaaaccaagggaaagtcctaaaaaacggtcagtgtaccctctaaagtctgatataaaacctatattctttattaaaataatgctatattctttactgaaacaagaagatctgaatgacttttaaaaataagatttaaataaattgcattaagtatgttttgtatcaggctatataaggaaaaagttctgattcaggatagtgctccactacaacaaagcagtaactagatctcacagggaagatcctcaaagtatctttacaaggaaggcccacaaggatactgtgaggtaagaggacaaggaaagggcataaacttgggtgtctcttctaaatcagctaatcattgtttttgttgaattggttcttctgttttatcagagtggactgcattagcactgaagatgagtcaaaataaaacagagtatgctactgccaaaaaagctacccaaatgtcattatctttaagaccagtgataggttaccagaaatattgtggtttttttttttttttttttttttttggcaaattctcagaaacccagctagtttctcaaaaaaatgagcttgtaactataaaaaccagtttttactttcatttgttattacatataaaatctctggttctcaccagtcaattcaacttcctgactcaaatgttgttaaatgttttatttataaacatactatgatcagttcttttctttctccatcaatttgtgtggtaagcaagttgaactgaacattgcagttttggagaatttggggtcatctgtaatttatgttttacaaataacaattcctaaattatatcaattacatgtatgtagttgtgatttaatacaaagaaatttgagggaagtaacctcaaaattacaaaagctatattaaatattacaaaaatccagaataattgaaattatcaaggattagaaactgatagaaacacttctgcaataactaactgtaattacaattagttgtaataactaattggtaataattggtagtaagtaataaataattggtagtaataaataataagtaatacataattggtagtaagcagcattcttagatgcatagttacagcattaatttcattattgggaagaagcaaacaagctaaactttgtagtctcacaagcagaaaacataagcagtaaataaatgaagttatcactcttgtggcaacaatgaagaaccaatgatacatactttgacaacaaaaagttcttttttaactctaaaaggaatgacatgtggaagcaactgagtagaaaatttcagcaaaatgagctgtatacatcacagattcaaatgaaaaaaatatagatctgtacacaagaatgacatctatgcctggcaagaatgcagagatgggagttcagatcaaggctacttcaactctacttcctaattctttcttctaaaattcttggttaaaatagttaaagcatggaaagcatccttagtgacgactgagtcttacaggtccattccttgctggtgagaaaaagattcacgtctatatttagtaaagtatactaagatcacttatcataattgtagtaataccatgcactaaaaaaatacccacgtgaaagacttcctgtttcatgcgggaaaggttatactagagaagggaaataatttaagaatacatttcacaattttactatattttgcctttatagcaagaatttagaactcagtgatatttttaaaaaagtaatctttttcattaaaaagttctgtaatgctatatatataattttaatactgtttttcttccatcttttacaaaacacagatagtaattccatgtaaaaatcttacagaattattctgttatttaacagtttcagtaattcaaacatttcatgaacatacctattaaacatcaggtgctatgcttaagtaactggcctacaaggatgagtaagacaatctctgacctcaaggaactcatgttttgagcataatttaaacagtgcaagactatttttataccataatgtataaaacaagtttgttaatatttcagtattacaaattggtactgtcatatacaggactcagtaatacaacccaaacacctaaaacagtgtctagtacataacggacataaaataaatgtttttaatgaattaattcactactcatttaaagcagaagaggcctatccatgggactcattccaaaggctttcaatcagaacaaaaagctgtcttgagtctttaggcaaacttgcagttatggttcctagattcctttgccttatttcctcaacccctggtcctaatttgttaacattaacactggccctttattcctccttgattccatttaggtcacatgttggatttgatcacacagaatcctaccacctccaggatcttaaactcttaaagtttcacccttgaaccacaattttcacatttccattcccttatttctcagcaccacctccagcccctcccagggccactcctttaccctgtctgtctctttccctctcaatacatcaatacctctcctgtgttaaccttaaaggaaacgtcctatacctgctatgtctacttcctcctcacttctcagaatctttcaacatttgtgccaagccccaagcctcccttccacttggtctgtaaaaggaaagttttcataattcctagatccctctaatctttattgttttcattctcaacctcttatataagtctggcattcctgactgcctctttcatattattatttttttgacatggagtctccagccacccaggctggagtgcagtggcacaatctcagcttactgcaacctctgcctcccgggttcgaatgattctcctgcctcagcctcctgagtagctgggatttcagctgtgtgccactacgtccagctaatttttttgtattttcagtagagacagggtttcaccacgttggccaggctggtctcaaactactgacctcatgatctgcctgcctcagtctcccaaagtgctgggattacaggcgtgagccactgtgcctggtcctttcttttctattctttcttttttcttttttttttgagacggagtctcgctctattgctcaggctggagggcagtggtgcgatctcggctcactgcaacctccgcctcccgggttcacgccattctcctgcctcagcctcccaagtagctgggactacaggcacccaccaccatgcccggctaattttttgtatttttagtagagacggggtttcaccgtgttagccaggatggtcttgatctcctaacctcatgatctgcccgcctcagcctcccaaagtgctgggattacaggtgtgagccaccgcgcctggcctggtcctttcttttcaaaacccattatcatccttaagatctaggtcgtggaaccctcttgatcctcttcttaactatacatctttcaataatactatctcctttattggattttcttttgcttttttccccctaaatgtaaaagattcctaaagattttgtccagctatctctttccttctcttatgctttctccttcagtatttcacatgcttatactgtttaaactatcacctctatgcaaatgaattataagccaggattttagatctttgaggcaaaaactgcatcttatttagctcaggatttccaataatctgaaacacaataagaatttaataaattgtttctcactgctgtatttttggtcacattatttcttccacttgagaacctccaaagcctatataacatgctctttgatttctgccctttataattatattctttactaactatttcaagaacctattgctcaagaagtattcctgaatctccagacagttatatttggggcctcttttcattgttcatgatagattattggcaatttgtcctttatcagaccattactagggtataaaagttatgaaggaaacagccatttttactctttacaaaacattgcacaaagcaaactgttatcagttggcagaggcaacacttcataatacctgctataggcatcttcaaaacagtacttttcaattctttgtttcactcttcttttaaaaggctagaataaccggaaattattctttaaatgattaaaatataacatgtcactttgctccaattgcaaaagtcactcacaaggttagtaaaagctcactaggtatttagaatgatgtcactttgtggctttaatctttttatacagcagggattgctgttttgtttacacccttggctccattgccaggacaatgcctttagtcttcaactatcttaacatttcaaactactgttcactaggaaaattttgatcatagactgatgatggctcagtcaatcctataattacatttaaaacaaagcatattcagtattaataaaaaagcagaaagatactttcacaaaatgaaatacagctcaagtcaaataggctctattaaccttataagtacaaaacaaaattacctggatagtagaatgtttcacttttagaaaagaaaatgtttcttacattaatatacttaatatcaacagatgtattgctcacaaaacctgtcttgatgaaaacttttgagttctgctcagagaaaacatttgcaagctgatgaattataccataaaataatatttttagaagaccacaattttttgcagatattaacattcaaacatagtttcaatattattaatgtaaatattattttagtttctattttaagataggtaactgtatacattttacataataaaaattaatacacatctgcaatgcctatgttctcaaattacaatgagctgaatatttttcagcaaagcttttcaaattctactagccaaatcaaatcactacatataaaagtgattaaaatcagtacacaaatgctggtgtgtgtcagtaacaaggcatggtaactacaaatgcctttattaatattaaagaataattcaacaaggttttccccctatcagaatgaaattgtactgaactaatgccttgactctaaactaccagtgaacaaaatctcccatcactaaggaaaagtccagaaagcaaataaaacaaaataattgtaagaactaagtatgttaaagcactcaatctttttaaaagtcaagaaaattgcttaccatgacataacttcacgtttttctgtgtgctaaaagtgtcttttaatctttcaatgctacacaaaattgttatatcatgtcttcaaattttgtctccagttgttcaaaatggtaagcataaatttgcaacattaaaaatcaggatctaatgtacatcttgcaaagtatggctattcattaaaaatggtggtatattcaaataaagttgttatgaggactttaattaatatcagtaataacttagtgtaatagcaaaaagaacatcatcaaaattactgtaaatcaaagcaatattcaaattactggctcacatattaaaattcttaagtatattaatgtttaaatatttctgaactcaaaatgtccaaattctgtaaacttgaactttgattaagaacagaaagaagtctacagttactggtgacaaaacatttctctccaagtaattctcatttcactcttgcattctaaaaatgctttgagccagttaacctttatatataattttagaacaaaacaggtatatttctattagactatctcatacagaagatagtgtggtatggatggatagtatggatgacaaataatacaaatatattttatttgaaataaacaaaaatgcatacacagctcaatgggtacttggaaacaaactgttccttgactatattactgagcaaaaacagaactgaagcacaaacacgttttttttttacatgtatgtggagataggcaggaagacattacttgttttttttttaaactgaccttcccttaaggcctggtcatagaactgtaagcaatgtaaatgaatccaccattaccagttgttatattatatctatgtcacctgtgtattctgagattacacacatacctgccaatatacctgggacaggttattttatcacagttacacttgagttcttggcaggcaggactgaggaagagtaatctgaaataagttttacatcctatttagaagaaatcgttagtatttccttaaataacaggttacaatagaaagatactgcctggaagttatccttttcattttggttcattttcagtttttgtttatgatttacatagctgtttaattcatttgcttatagtacaatcctgccataaagtattaaagcacaagatacctgttattccttcaacatctgcatttttcaagttttatactctatatccacagtatgtcagcagttcttgactgtttaaaaaaataaatggctaaaactcttctaaaaatgcagatgtctataactacaatggtactaagatgggaaggagacaatgagagaagggatgaaagcaaacgtgttcaagtgcagggaatgtggttcaagtctttggatttaaaaacaagttccccagagaagctgacacttcctttgccctccaaaaaggacctgaaaagtcccaatccaaactttggaaaattacagttctgcgatgcaataaatgatgatcaaagcagtcagagggagaaggatgaatgtgccttccacttagctatagactgtagtacagcctctttaggtgctggtggatcagtaaaaaccactgcagtatcagaagtgcttggaaggataggggtagaaagtaatgaccatataccttgtctaaatcagtagcagcgcttcatggctaggaaacttttttaaacagtaaaatgtctctaggatagatctctctctccaacattaaatgtggcagaattaaaaaaaaaagacttacacttggatatagcaataacagaaaattacaaagcagagaacacaaaagaatcagacaatgctataggttcaacagtattccatgaggttagaaaactggttaactttgaaagctctagcaaaatatcactcttgtttataaatcacttatttatcatatgaccacatgttgaatccttgtctttccacatactgaagaatcctacattcagcctttaggcattctgcatttctttgctaatgttgtagctgagtaatcttgttccagtcaattttggtgcgggtaaccggaagctgccggcgcaagaccttgaatgtggtatctgacattgtttgacagttttcactaattgctgtctgatattcattttctgcattctctatgattttaataaactccttggcagtttgtgcgtcattcgaaacagttagcgaatcctgtacatctttatgactaaccaactgaacactgccatcttcgtaatagtgaacctgaatcttaagcactccaaccacctgggctgtaggtggtgtgatggtaaacttccactctgatctccaacgaccattccagaagtttttaggctgacactcatggctttcaatacatgcaataatagtctgttgcccatcgatagtttttagcataaacagtacagaagccgttggaataatggtctttcacataggctcttaaagcactgtcacaggattctctccaagacttcagacctccatctacttgttttggctgggggtcacttgcttttttctataagtgatcaaatgtaaaggaaattttgtttcttggatctaaaactctgctattacccaggtcccccatgctctgtaattatgacctgatcttcacatccttccatcttcacgggtgtgaactgatccatgttataatgggcaaatgcacgtgctgccctttccctgaggagactgtcattattacatagtagccgaatatcactgaatacttcattaaattctcctgcgggtgcatgagtgatgaatttagcagctatgcataccttctccttatccaacacacaatcattgaagttggccatcttgggctgttctcaacatttatattttgacacttaaaaaagacgattccttaacgtgtctattgttaatcgttctgcaatgaacatgggagtgcagacatctcttagacaaactgtttacaagtcctttgggtaaatcccacaaacaggatggctggattatatggtaattctatttttagttttttgaggaacctccatactattttctataaaggctgtactaatttacatccccattaacagtgtacaagcgttcccttttctccacatccttgccaatacttgtcttttgtctagttgagaaaagccaatctgacaggtgtgagatgatagctcattgtgattttaatttgcatctccctaatgattagtgatgttgagcattttttcatatatctgctggccacttatatgtttcttgagaaaagtctattcagattgggttttattattattattttttgagacagagtcttgccctgttgcccaggctggagtgtaatggtgcgatctccgctcactgcaacctccacctcccagtttcaaacaattctcctgcctcagcctcctgagtagttgggattacaggcgcccatcaccacacccagctaatttttgtattttttagtagagatggggtttcaccatgttggccagttcggtctcaaactcctgactttgtgatctgcccacctcagcctcccaaagtgctgggattacaagtgtgagccactgcgcccagcctatttttatttttaagtagttattttgagattattttgactcacaagagttgcaaaaatagtacacagagttcctatatactgtctacccaaccttacttctccttatgttatcatcttacatgactaaagaacaactttccaaactaagaaattaaccttgattaactaattaaaataaagaatttattcagatttaattagttttcccaccaatgtcacttctctgtcccaagatccaatccaggatctcatattacatttaggtgttgtgtctccctagttttgtacagtcgtgttatttcctcagtcttgtttgttatgactttaatacactgaagtgtactggtcagaggtattctgtaaaatgtccctctggttgagtttgtctgatgtgttctcatgattagaagaggtgatgcattattagaaaagatggtcaatgtgcccttctcagagcaatttatctagggcccataatgttgctatgtagttctggtgacattaacttcgatcacttggttaagctggtatctgccaggactcgccactgtaaaactaccattttctcttcaaaaggcatttttattagaaaacaagtcactgggagccgcggtagctttgggaagaaaagctgccatttaataacatcaaacatgccgaataagctttgttcaagaaatgatgcaccaatactcaggcaaatgactattcttaaaagataaggacagttcctcttctgtgataatttttgttggatctaatgaaaataattagagttcatagattaaaatgctaaaaatacggaatattttatatacatttctatattcaaatatagctgtacttctagtaaggaaacagaaaaaactaaaagtaatataattcttgttttactttacttaccttaacctaaatcttgttctacttatgtttcaatacataagaaagtcttagttttcccataatgaacataaattattacaatcagctttgaaagtatagactgggtgtattagtttgctagagctgccataacaaagtaccacaactgtgtgacttagaacaacagaaatttattgtctcatagttctggaggttagaagtctgaaatcaaggtgtcaacaaggccatgttccttctgaaggcactaggaaacatgagttccatgcttgtctcctagtttcttataaccttgggtatgcttcctgtgtcttcacatgtgcttcctgctgtgcatgtctctgtgtctacatttctcctttgataaaaatactggatatgtattggattaaggcccaacctaatgatctcattttaatttgattagctctgtaaggtatctatatctaagtaaggtcacattctgaagtattaaggggttaggattttaacctatgtcttttgagggggaggatacaatttaacctatagtatttgctttatttttaagagaacttaattgacttgaacatattaactttctcaagtaacctactactaaaatcccaaattaaaactacaaagttctactaaaaagtgaagtaaaataatattctgaaaatacttgtgatcaaacctttcattaaataaaccccactgcaaaaaaggctagacagttgaaaattcaacagcctgaacaggcgcgatggctcatgcctgtaatcccagtattttgggaggccgaggtgggcagatcacttgaggtcaggagcttgagaccaacctggccaacatggtgaaaccctgtctctaccaaaaatacaaaaattattcaggcatggtggcatgtacccaacttcttgggaggctgaggtgtgagaatcacttgaacccaggaggcagaggttgcagtgagctgagattgcaccactgcactccagcctggacaacagagtgagaccctgtctcaaaaaaaaaaaaaattcaagagactttatttaggatgtatagatgcctacaacattaacacatcaactaaaagagaaaatcatgctgtaatagttcagagtataacataaatactcaaagaaactttggctttatccacaaaccatcaagagcaggcctatctcattccctgatgattctctactaagtataaacttaagtcttggctgtctcttaagttctagttaaaccataattttgactttcaggtttgtttttcatacattgcctcttcagtaatctcaactgatcttttaaattccttatcctgtagcttatgatgcccatccccaactaaaatctgcatagtcacttgattattaccagagcaatgcacagcacagctcagaaaacttattaatcagagttaattatcatttaagttttaagtcttagtcctgtaaattcatctctccttcccttcctttcttcaataattgtttcttattattatatattttgtgtcaggcactgactggatacatattggtaaaacagataaagtccttgccctttaaatgcagaagaattgacaaataagtaaaacaacaccaaatgtccaattctaaattgtgaatagtgctatggaggaaattatagctgcagcaattacctagagactataattagaggtctaattaaggtctgtattagtcaagattcttcacaaaacagaaccaacaggatacactaatttattatatatgatttattataaggaatcgagattatggaggctgacccaggaaagctggtggtataattctgagaaccgaagggctgatggtgttaagtcccagccacggaagaagactgatgtcctagatcaatcagtcaggcaaagagaactactcccctcttcctccattttttttcttctctgcaggtcctcaatggattagatgatgcccacctacactggggaggacaatgtgctctactcactccactgattcaattgctaaacacccttacagacacacccagaaatagtgttttacctgagtacccacgagccagtcaaggggacacatcaaattaattattataatatctcaggatatctaacctgagacaaagcatgaggaagaatcagctttatgaagattttccagacagagggacagcgtatttgaaattctgagttgggaaaggatgttttgtatctaagaagtaaaaggtcagggaggctgaaagataaggggtcagaatgagaacagtgccagacaaatttgagaaggcaggcaggattaggtcatggaggatgtgcagccttatgtaaaaattaagttgaaagtacaaaatatccagctcgatatggctaggtgaaaaagttaatctaatgactcacaaaactcaaaagcttttggaaaaggctcattgtagagatgaagaagctagactgaaggtttaccaagacctaatttatctctcctcttctggttctgcctccctcagacgggcctttcccccccaggtttctggagcaggaagctgcgggggccagtgcaaggggaggtatttttcctcccccagcaccaataaaaatcccagaatggaatctctttgctttgattaattgacttatgttgtgtccattccttaaccaatcattcttgtctaggaaagatgatatttggattggctaggctgggtcacatgccacacatctgtagtgtcttaggaaaaaatttttttaaattaagtgatttattttggggtcggagacaactgctggtaatggtggagtgaggtggtcgtataaatcctccacagagaataattactaaaattgggctttaaaaagccccctgaaatactggaaagcatccaaaagcagaagaatggcagaggagagtttagtctggaccaatggttaacaagaagtaaaaagtatgactttgtagctttctggtctgctgcctaaatcacatagttataactacagatgatggtcaaataaaaaacagcaggcttatcaactaaaggtgcaagaggtcagaattcagagctaaggcagcatctcaaaatgtaaaggggaaatcttggtagtgagcaaaccacagcaagtatgagacccaaattcaatttaaactatccaaacgcctagctgcaagtatactgtgcatgaatgaaaaaggactccagggtcagcacaaactagctggcagagaatgaagataaatctactcttgaaaagcagagctgtatatagcagatctgctgggtttgatgtatttatttactaagtgcactccctcatcatgattatctcaggcggcaggaagtacgaagtgtcacagcactgagcccaaagcaggcagagcaactgaaaattagggggtaatcttagaagaaaaacaacaacaacaacaacaacaaaaacaaaacccaaaaaagaaacagaggaaaggagacccatctctgcctaaatactttgccaatcaagaattttcacaggtacagaggagacccagaggagtctagcatgaaaaagcagaagtgggaagccaaaagaatcatagcacaaatattatcagtacattttctaaccacagtaaaactaaaatggatatcgattttaaaaactaaatgttaatgacttccaaactacccatcagccaaagaagaattaacaaaggaaaatagaaaatgtttttactggaatggtaagaaaatgacacataaaacttatgtgccgcagctacagcagtaattacaagggaaattcatagcattaaatacatatataagaaaaggacaaaggtgctagataaacgatctaagcttccctctagaaagtaggaaaaggccttgtgcggtggctaacgcctgtaatcccaacactttgggaggccgaggcgggtggttcacaagttcaggagttcaagaccagcatggccaacacagtgaaaccccgtctctactaaaaataaaaatataaaaaaattagctaggtgtggtggtgggtgcctgtaatcacatctacttgggaggctgaggcaggagaattgcttgaacacgggaggcagaggttgcagtgagctgagattgagccattgcactcagcccaggcgttagttcaagactctgtctcaaaaaaaaaaaaaaaaaagtagggaaaaagagaaaatcatacccatagaaaaacagaaggaaataattaatgagagaaaaaaaacagaaaattgagaaaactcaatgaaaccaaaagcttgttcttaaaaaaatctgtaaagttgaaaaacctctagtcactaaaaagaaaagacataagttatgtatatcaacgatgaaagaaaaaatctctctaccaatcatacagacattaaaagaatgaggcaatatctggaacaactttgggcccatacatttaatgatgtagacgaaatgaacgaattccttgaaagacaccaaccaaagctcattcaaagagaaaaagatatcctgaattgttctatgcctacattttttacttattttatttatttatttatttttgagaccgagtctcgctctgtcacccaggctggagtgcggtggtacaatctcggctcaatgcaacctctgcctcccaggttcaagcgattcccctgcctcagcctctcaggtagctgggattacaggtgcccgccaccatgcctggctaattttttatatatatttttagtagagacgcggtttcatcatgttggcgaggcaggtctcgaactcctgacctcaagtgacctgcctgcctcggcctcccaaagtgctgggattacaggcatgagccaccatgcccggcctatacctacattttaaaaggtgaattcatgatttagtatcttacaacaacaacaacaacttaaacaaacaaacaaccaaaactctccaggcccagatgtttcaccagtgaattctaccaaacatttagagaaaaaataatatcattatatattctttgaaaaacacaagagaggcaggaatcttacccactcatttccaacaaatcaactgcaagaaaactatagaccaataaccctcatgaatacaggtgcaaaattccttaagaaaattttagcaaatcaaattcaacagtgctttatttctatacttgctttctgcatgaccaacactattctgaaaggataacccatcataaccaagtgggattaatccttgaaatgcaagattggcttaactataaaaaaattaatcaatgtaatttgccaaaatagcaagttaaaaggaaaaagccatataatcatttcaaaaagtgcagaaaatgcatgtgacaatatttaataccaattcataataaaagactctcagcaaagaacgaatagaagggaactgtctcagtaattgccagggcagggatggagggaggaatttaacttcaaaaagatacaaggcaacttcctggagtaataaaattgtcctacagcctggaggttacatgaatatatacatttgtcaaaattcattaaagtatacatttaaaatggtgaattatattgtacataaatcacaccaaaataaagaaactaaaagtaggagggtttgcatgtgcagcttcactctgttctgagaggaacagataaaagcagggcaagcatagaagtggagagccagttagaaagaactgcaatgatatagacgagagattttagtgcagactagggcagtggtagcagagacagaaagaagtgtacagactcaagctttattttgaaggtagaatcaacagactttagatgtgagggtgaaagagaaatagataaatccagagatcactatatttatggcttaagctactggatgattgtggtatcatttaatgatagagaatgtgaaggaaacaggttttgggagaaaaccaaaagtttgttttttggatgtgttaaatttgttaagtttgagatgtctataaaacctctatgtaaaatgtatatgttcaggagctcagagagaaagtctgggcagagtcttcctataggtgtatttaaacaaaaagacaagaaataacaggcctcagaatcaaggcttggaaaatgcaagccttgatttatgagtacaggaatctgggggaaaaaaaaaacttaagaaggagttgtataaaaaaatttagagaaaaactatgagtagtataatggaagctaaaaggaaagattttcaagaagaagagagtggtcagctatgtcaaattctgctgaggttgaatgagatgaggctagaaagatgacactgctgtgagttgggatgtgtgtgaaagacaagaagaaagcatatgtaactatctcctttcagaagttgggctgtgagcattctggcagaaaacagggcaatagccagaagagtattgggatataaaaatggtttgggggccaggcgcagtggctcacatctgtaatcccaacacttcgggaggctgaagcaagaggatcgctttagcccaggagtttgagaccagtctggacaacagagtgagtctctacaaaaaaaaattttaaaaattagctgtgcttgcctgtagtcccagctactaaggaggctgaggttgggggattgcctgagcctcaaaggttgagactgcagtgagctgtgatcacaccactgcactccagccagacaaagtgagactctgtctccccctggctccccctaaaaagaaggtgttttgtatatactgctttttttaggatgggtgatactaagagcatgcttttatactgatgaacatgatccagtagataaagaagaactaatgataaagtacagaagaaatgaagtactgaaaaagtcctttataatctttaataaaaaaccaatagatatttgctattgtctgtgaaagttaagagccatatcactttgagttgagcatttattctatttggcttaatttatattcttacatagaacaggatttcaaaggagatttgtaataaatatacataagctactagatgcactactgaaatagattttaaagaaatgggctgttgaaatgggaataaagttcatacacatgtatcagaaaagtttattacaatacagagctggggagatatggcagaggagctataatcagatgagttcaaatgggtagataattggttcattcaagatttgtttcaacttctttttagtgagcatggaatgtttttccatttgtttgtgtcctctcttatttcctcgagcagtggttatagttctccttgaagaggtccttcacatcccttggaaagttgtattcctaggtattttattttctttgtaacaattgtgaatgggaatttactcatgatttggctgtttgtctattattgctgtataaaaatgcttgtgatttttgcacattgattttgtatcctgagactttgctgaagatgcttatcagcttaaggagattttgggctgagatgatatatacaatcatgtcatctgcaaacagagacaatttgatttcctcttttctactggaaattttctattggaaattttctattcctctttcctctattggaataccctttctttctttctcttgcctgatggccctggccagaacttccaatactattttgaataggagtggtgagagagggcatctttgtcttgtgccggttttcaaagggaatgcttccagctttagcccattcagtatgatattggctgtgggtctgtaataaatagctcttattatttggagataggttccatcaatacctagtttattgagaggttttagcatgaaggggtgttgaatattatcgcaggccttttctgcatctattgaaataatcgtgtggattttgtcattgtttctgtttatgtgatggattacgtttattgatttgtgtatgttgaaccagccttgcatcccagggatgaagctgacttgatcgtggtggataagctttttgatgtgctgctggattcgatttgtcagtattttattgaggatttttgcatcaatgttcattagggatattggcctgtaattttctttttttgtcgtgtctctgccaggttttggtatcaggatgatgctggcctcataaaatgagttagggagaattccctctttttctattgtttggaatagtttcagaaggaatggtaccagctcctctttgtacctctggtagaattcggctgtgaatctgtctggtcctgggcttcgtttggttggtagactattagttactggctcctctttgtacctctggtagaatttggctgtgaatccatctggtcctgggcttcatttggttggtagactactagttactgcctcagtttcagaacttgttattggtctattcagggattcgacctcttcctggttttgtcttgggagggtgtatgtgtccaggaatttatccatttcttttagatttctagtttatttgcatagaggtgtttatagtactctctgatggtagtttgtatttctgtgggatcagtggtgatatccactttatcatttttattgcatctatttgattcttctctctattttttattagtctggctagcagtctattttgttgatcttttcaaaaaaccagctcctggattcattgattttttgaggggttttttgtttctctatctccttcagttttattctgattttagttatttcttgtcttctgagagcttttgaatttgtttgctcttgcttctctagttcttttaattgcgatgttagggtgttgattttagatctttcccgctttcttttgtgggcatttagtgctataaatttccctctaaacactgctttagctgtgtcccagagattctggtacattgtgtctttgttctcattggtttcaaggaacatctttatttctgccttcatttcattatttacctggtagtcattcaggaccaggttattcagtttccatgcagttgtgtggttttgggtgagtttcttaatcctgagttctaatttgattgcactgtggtctgagagactgtttgttatgatttctgttcttttgcacttgctgaggagtgttttacttccaattatgtggtcagctttagaataagtgagacgtggtgctaagaagactctatattctgttgatttggggtggagagttctatagatgtgtattaggtctgcttggtccacagctgagttcaagtcccgaatatccttgttaattttctgttttggtgatctaatattggaagtggggtgtttaagtcatccactgttactgtgtgggagtctaattctctttgcaggtctctaagaactttctttataaatgtgggtgcgcctgtattggatgcatatatatttaggatagttagctcttctttttgcattgatccctttaccattatgtaatgcccttttttgtctcctttgatctttgttggtttaaagtctgttttatcagagagcaggactgcaacccctgctttttttgctttccattttcttggtaaatattcctccatccttttattttgagcctatgtgtgtctttgcccatgagatggggctcctgaatacagcacatccatgggtcttgactctctatccaatttgccagtctgtgtcctttaattggggcatttagcccatttacatttaaggttaatattgttatgtgtgaatttcatcctgtcattatgacgctagttggttattttgtctgttagttggtgcagtttcttcatagtattgatggtctttacaatttggtgtgtttttgcagtggctggtactggttattcttttccatgtatagtgcttccttcaggagctcttgtaaggcaggactggtggtaacaaaatctcttagcatttgcttgtctgtaaaagatttatttctccttcgctgttgaagctcagtttggcggggtatgaaattctggattgaaaattcttttctttaagaatgttgaatattggcccccactctcttctggcttgtagggtttctgcagagagatctactgttagtctgatggggttccctttgtgggtaacccgacctttctctctggctgcccttaacattttttctttcatttcaaccttggtgaatctgacgattctgtgtcttggggttgcttttcttgaagagtatctttgtgttctctgtatttcctgaatttgaatgttggcctgtcttgctagcttggggaaattctcccgggtaatatcctgaagagtgttttccaacttggttccgttctctttgtcactttcaggtgcaccaatcaaacataggtttggtcttttcacatagtcctatatttcttggaggctttgttctgtcctttcattgttttttctctaatcttgtcttcatgctttatttcattatgttggttcaatctctgatatcctttcgtctgcttcattgattcggctgttgatacttgtgtatgtttcacaaagttctcatgctgtgtttttcagctccatcaggtcatttatgttcttctctaatctggttattctagttagcaattcctctaaccttttttcaaggttcttagcttcatcgcattggtttagaacatgctcctttagctcggaggagtttgttattacccaccctctgaagcctacttctgtcaattcgtcaaactcattcttcatccagttttgttatcttgctggataggagatgtgatcctttgtaggagaagaggtgttccggtttttggaattttcagcccttttgcgctggtttttcctcatctttgtggatttatctacctttggtctttgatgttgttgacctttggatggcgtttctgtgtagacatcctttttgttgatattgatgctattcctttctgtttgttagttttccttctaacaggcctctctgctacaggtctgctggaggtccactcaagaccctgttttcctaggtatcaccagtggagggtgcagaacagcaaagattgctgcctgttccttcctctggaagctttgtcccagagaggcacctgccagatgccagccagagctctcctgcttgaggtgtctgtcactgccgctaggaggtgcctcccagtcaggatacacgggggtcagggacccacttgaggaggtaatctgtcccttagcaaagctcgagtgctgtgctgggagatctgccactctcttcagagctggtaggcaggaatgtttaagtcttttgaagctatgcccacagccgcacattcccccaggtgctctgtcccaggggtatgggagttttatctgtaagcccctgactggggctgctgtaaaaggctttattttaaacatggactacaacactgtgaaagttaaaaaaaaattattttacctacaaaatgaaaaaaactcatgttttaggtactaaaaatatgtgttaataaatgacacatttctggataaatggaattatactttcattcaatgtaagcatctcaatataaatactctatactcttttttactagtagcaaataatgattaaaaaaacgcatccctttctagacaaggtttctaatgttattcagcaactcggcatactccatcccttctgcagcttccaaccatccactaacaaacaaaaaatagtgcccaacatatgactcatgagaactgcaagcaaattccaatgtcactaattcagaaaaccaagtgagaaaaaagtgttcagaaaactcagaatctgtactcaaggatgctattgaagccttcaaataagaaaagacatttctttaggaatactatgtatgttaaagactaattcagaaataaataagacagcagattagaatacactgaaagctcacaacaagggtaagagaaagaagaattacaaaaacaggaaaatataactacacaagtacaattgtgtgcaatcatttacacaaatttatctaaggtaaaaagtcaatcatagcatcgctatttttgagcacagtatatcatcagaggcttggacacttacagtccagccatcattttgcgtataagggaaatgtgaacaaacttgttaattacttgatgaagactgtacacaaggtggagaagttatattgatttttaaaaaatatatagtgcggctgggcgcggtggctcacgcctgtaatcccagcactttaggaggccgaggagggcggatcatgaggtcaggacatcaagaccatcctggctaacacggtgaaaccccgtctctactaaaaatacaaaaaattggctaggtgtggtggtgggcacctgcggtcccagctactcgggaggctgaggcacaagaatggcgtgaacccaggtggtggagcttgcagtgagccaagattgtgccactgcactcctgactgggtgacagtgcaagactctgtctcaaaaaaataaaaaaattaaaaaatatatatatatgtgtatatatacatacatatatacacacatacacacacatatagtgctattttagttattttgtaatccctaagaatatattagaaaatggtttgatcataatataatgacagaatgacatcctttttgtcattccattgattggaaaaacaaaaataaatgaaaacatttatttgacaatttgctaaggtattttgtaagcaaatattatatatttatgcatcacatttatgcaaaagtttccattttaattctgaataagaaaaatatcatttagtttactgcttataaacatgaaataatgtataagataagaaatagttaaaattaaaatgtttcctaccgataaataaatgagttaattaactttaggtatttaataaaaggaatgtattctaccacacctttgtaaaagaaccaagagtgattttgggaggtgcttaaagatatcttctacctaattaaagaaaattgaggatattttcacgtttgaaataaagctctccttagtttcgctcttgttgcccaggctggaatgcaatggcgcaatcttggttcactgcaatctccatctcccgggttcaagcgattctcctgccttagcttcctgagtagccaggattacaggcatgcgccaccatgcctggctaattttgtatttttagtagagatgaggtttccccatgttagtcaggctggtctcgaactcctgaccgcagcttcccaaagtgctgggattacagggtgagccaccgtgctcagccaaattttattcatgtttaagaaacttgttatgctctaaactttaaaaatattttccatcaagtaaatgatctgccttagtatacatctgtgaactggagtagctggagcttacaaggtcatttcaaatactggaaggaaatctagggcaaagtgtctaccaaggacttccttctatttctttccctcttgggcctattgttttaaaagacttcattaatttattaattaaaatgataaaacaaattaagatatcaagatttaactctcaaagacaattcctaggaagtatagaataaccagtgctatcccagcgtaaaatcctgaaaaagcaaaaagactaggtgtttaacctagcctttattcaacaggtcaatgcaagtcatgagaatattttattcagtgctcaataaaatattatgcaaattattaaaagaatggcattctaaaattgagttaaaaaagggtattcaccacatgggttgattgtagagctaagtgaagcaactccagtggaaaggccaccttttgaaactactgaagccacagaaggtgtcgaagatgaagttggtgtagtagaggaggctgctgaggatggtaaccgttctccagactccatatctatgagaagggaaaatgttaattctcagtatcagataaaaaattttttcaaaagaattcaacataaactttttgtatacttttaaaaatataaaataaatttctaaatacatgttctttggaaagagaaaatatggagtagataaaaacaatataatttaaaataccaacttatggaataagtttaagtataccaaatcctcttgagttttcttataccccccaaattaatagtggtttgaatatagtaatttcacacaaaatgtgtattgccacaaccataaattaacatgttatattcgtcttattcatcccaaattacctcacatcagttcacttgcaacagaattcctatgttaccttaatgaataattaaaaaaaaacaccaccacatttgaatggtctgcccccttatcttctaaatacagatagcaatatacttgtagctcttaagtgtccaagaatctggcctgggaatcccccccatacccctcaaaacaggcaaatacatttcagagtttaacttgaggcaagtttaaactatgatttcaaaatggccttagttgtgacccatttaaaatgacaaaagcacttctaatcatctttattaatttgttgggctttatggttgtagccttgcattggttttattgcaataactaatgctgatattaaaaatttggaatataatgggcattttatattcattttaatactctatgcatgcactgatcccacaatcaagcaagaaagtcattaaattcacagatgctttaaagagaacacgatctacaataagaaaaaagatactgcttgcctataaatgaatttatgatcagccacatgaaaactcttaccatttaaataatctaactatagaaagatttctgtattgaattctacaggcaactcacagaagaactgtatctttactaagaaaaatagttggatttcatttaaaaaattgactaattaaaataatgcaaggctagtgtttgcctaattgttgattgaatccataaagtatgtagataatttttctcataagataagatatatatggggaaggtaatcttaaattgacatgcaacatcattagaaagaccatttcaatgagccttctaatcatatagaattcaaaaacttctcttcatattctagtattgctgtaaatcacttccataaatgacagtactgctatgatgagtctgtccatattcttacagaatttgtatttctctttatcagcattcatcatgggaaaggcatagttgctactgatggctgcatgcaactaatgtttaaagagtaggttttgggtcagcaacagtaactaatgaactctgagacatgtggctgtctgatggtaaggcccataaaaattatttttaccaagtctaattttcactaaatacaaaaaatatggactctttacctagaagtgagtttaggaaaaagctattttttctttatagctggtaacctcattgtcttcaagaattctatctgctacgtaaatatactatgtaaaaaaaataatggaaggggtttaaaaaaatttgcctttgtactccacagcagaagtaatttggtgacataataagataagcactttagctgagtacttggcatataagagatcaatataaaatagtcattaactttttataggataatatgctatgaagtataggtatttcttattgttgataaaacctgattcaggactaaagtaaggaaaatcaagaaggcaaaagaagtagtcttgtatacatactgcttaatggatattactttccctgaagaattaatctgaataattatttaaataaacgcacatgcacaaatatgtgtgcgcgtgcacacacacacacacactcacagataaagtatcattaggtaaagtgatatatacaacgttgtttgctacagtactgcttaaaaataaaatttaaaactggcaatgagagtagaactagagctagtagtataggctggggccttttttagtttcagtaaaggtgtaattttttttcttctatatctggttctttttgctcatttaagtaagaaggggcttaacttcttaaaaacatatgcttatgtaaccattttccttagaagctctattatagacattattcatgtattattttatttcaactatatttatactaggtatttttagcctaagatttattagctggctgagtagtcttcttgcatgtaaagtactaattctctcatactggtcttaagtagttgttgtttttaataggcatttcttagttctaataaccaaaaattgggtcaactactgcaagttcatcttacacataccctttttttgtcattttatagaaatttaacaaatccactctagcctttgcactctagaatgaagattgtcttatgcctgaatttacaaggtttagttttaagtcttctttttaagttaaatattattctttcagttttatttactatcatcccctctaaagcacaagaaatcctggccatcaacttgatagttaaaaggtgagaaggcaatgcctttgtaattgtgaaattgtataactgtgaaaaatccacaaaacaatcattggcttaccatatcgtaagaactagtcaaagaacaggtatagatatgtaacaaacctgcatgttgtgcacatctaccctagaacttaaagtataataaaaaatatatatataaataataaaaacaaaataaaataatatgcaccaaaggttactaaaagcagtgggtcaaaatttgaggagaaacaggatatttgcatagtctcaaagtatctcctccaaaatatcaattaaatgaaaagatgaaaagaatagtttcacagtggagaaacaacattacctataacaaaatatcaacatcatgtattttctgatgccccagaagagtccatcacttctgtggtattcttcccaaaactacacaaactcagctgaaccatgagacaccacacagacccaaattgaaaaaccatatacaaaataactgactggtattcatcaaaagtgtcacagtcatgaaagaaagaaaaaaaaaaagactgtggaattgccataggttggagactaaggagactaggaattccttagtgtgagacctaggatcccacaactaaatgtgatgtgggatcctaagttggattttagaacaagaaaaggatattaatggcaaaactagtgaaaatcacataaggtctgtagtttagttaatagtattctatcaatgttaatttcctgatgtttataattttgataattgcactctggttatacaacttattaacattaggggaagctggatgaaaaatatatgtgaactctgttttttatttttaggtctaaaattatttcaaaataaaaagtaaaaaaacaaacaaaaaaaaaacccacaaagtcttccatatagtaagcactaaaaaaaaaatacatatgcattgaagttaaagagtataaaaaactaaaccttgaaggaatgaagaacagactacattgtgtcactgagatatttgctaataaacattatctgggttcaaacactgtgcctgaagtttattagttgtgattttgtaaaaattatgtaatttctctcagttctcaatttcctcatgagtgatttcaagaagatgtagttgggaggattaaatgagataatgcatgtaaagggtagagtacctagcatttaatacttgttagctattgtttttaatgagtgagcatctatgtatataattacccatgtgtatatgtggcaagaaaagaaacctcaaggtattctaaattattcatgttaaagtgaatatttaagagttatactatttatagattatgtatatccttaccatggaattatatttttagccagatagattacgtgctaagaatttaaaataaatgtctcataattgtaccgatatcaatgtggtaaggtacgttatcttaaaattttccaaataagctgatttttcatctataatacaaatacagatgaaaaattaatacattcattttgttgacaaaatatgttatcatgagttactatttataattcaagcatagtacataaaaatctgcagaaactcatttattcatatctttttagaaaaatatattcattaaaataaaaacagttcaggtatccaagaaccatctattcctagatttctgttagggccagagcatccacatctgacacctacgctcctataatggcctctcgttctgaccctttgtgttaagaatactcctttcatcttgggttccaaatgatcacgaactaacccattctttgtgttcaaaaccagcctagatatcacaggatcacaacaaatggagtataataacatgacctcccgtctataattcaacaatggaagaatatctagtaggtacatcttttaacttaaggccattcaagagattatagtttctaatgtataacttggtcatttttttttgagaacaaggtctctctctgtcacccaggctggagtgcagtgttgtgatcatggctcactgcagcctcaacctcctgggctccagtgatcctcccacctcagcctcccaaataactgagactacaggtacctgtcaccatgcttggctaagtttttctattttttgttagagacaggtttttgccatgttgcccaggctggtcttgaattcttgagttcaaactatctgcctgtcttcgcctcccaaagtgctgggatgccttatttcaaaatttaactaggcttggcgcggtggctcacgcctgtaattccagagctttgggaggccgaggtgggcagatcacttgagttcaggagttcgagaccagcctggccaacatggtgaaaccctgtctctactaaaaatacaaaaattagcaagacccacgcggtagtgggtgcctgtaatcccagctactcgggaggctgaggcaggagaattgctggaactcaagaggtggatattgcagtgagccaaggttgcaccactgtactccattctgggcaacagagtgagactccgtctcaaacaaaaacaaaaccaaaacaaaacaaaacaaaaaaatgagaagaaaagaaaaaagaaggttaactagttaaaagacgactataaccacaaattaacgcaaaacactatagtaaaaaaaaaaaaatgttgtgaaccatgggagaaatatgtgcaaaagatgaagggactacaaatgatttgatacattatagatgtttcctgtagcctaaagcagtgattttggttttctgacacaccatctcccccaccagggaacatatgggtgacattttcggttgtcacaactggaaaagtgctaatggcattgagtggagatagaggccagggatgctgttaaataccctaaaatggacaagaagaacagtcttcccctacagaattatccaaactaagttgttagtgttgctatggatgaaaaactctgatctaaaatatcaaaaagggtattatttgaaattcaactagctaaaactttaatagtaattctatataactataatagtaaggtgagtcaagctgattttgatgacccaaagctactgtaataagtgataaaattatactcaacatcttttgtgtcagcatccttctaagagtctaatatttcacattttatccaaatgtttaaacactgataatgtatcacatgtaattaacacacatcacaatgctcactcatactgggtaacatacatttgctgtattttactaaaatgacatttatctataacaattctgagcgcaaataaaaatccaaatttatgaaaatgacagaccacaacttcttccctgcatgatgattttatgtactataaaaggattcaatgatcagttgttaatgataatattgttcaagtttatgtatctcaagtattcctgttttgtgtaatcatagagttcatgaacactgacagctggtaggtgtaaacctgaacaggtgctaacagggagaccaagacacgttgcctgagatatgtaaacatgattagttccctgtgtttcaggtgcactgatactttagtgttgccatataccgtcaagaaaagcaaggtaataaaaaaaaaagtatagccacagattaaagatgcagaaattacaaataaaaatagacttagatatttttcctgaaaggactttttttaaagaatgattttatttgtactaacagtagcaaaagttatctgtgggagttcaaaacacagcagattcagtgagtccttacttttcctttataatgtaacctcagagaaatatgataattaggaagaatatcaggaggtagtcactatgctacttcttttggtttatcagaaccactaagagtagagttttattatacaagttcaatattttctaaaaattctgagaaaggtttacatataattatttgtttagacaacttccaggcaactgaacatttgaacatataaaacttcaagatattaaatagcaaaacagaaacaaaaaccaggcaacaaatgaaaaatcttctgttaaaggacattcagaaataggggatgtggccgaaataccttatcagacagcagacaaaattattctttgaaaataatatgttcataggaaaaagattctattcataaaatttttatttacctaaattttctgaaacagaatttcaaagaattaagtatggtatacagtggtttaaaatgtgaatatgtaaaatgaattgctttttttgtcatttgacacattttaccactataaacaaacaatttattacatcctcaaacagaactggctggcaaccaggtgttctgtgtgttaacctgtgatattcagcaagtttcagactcccctaaatactagtttccttacctaaaaaattatgagattgaattaaaccagctctcaagtttctatcagagttttacaaaattggtggttaaaaaacaactgacccccaaaaccaacaaaaaacacacacaaaattaatactgcattgaaatatttaacaatttaattccattttgtccttatcattcttttcattggcagtcttgattctatctccaaatgtgtatcatgttaaattatagatttctgttaaatcttttaaagatttactcttgttgtacttctatctcaaaagacctgatggtgagaaattatccaagggtaaaagcagtggttttcatattgctcagcgaataatctattcagagagtatccctttccatccaaaggattaaatattcctttgcaatgagctatctgtggggaagacgttatcctaagacttatgaaaaagatataaaagataataagagttaagaaagatttaatatctctatatcaactaaattgtaggtatagtctgtgaatttaaatactaactagacttagaaatgtctaacaaggaaacgaaggttagaaagataaagagagatatggtgtatggttagctgatcctttcatctacaaatccaaggggctccaaagaacaagcaaaagacctaaaactttgcttaactaagaaacacaattaaaattttaattagaatatttaagatagttctggaaagcaactgaaaccaatgcatgagatgaaaaaataaagcagagaatcaaacagaaatcatattactctatataaaatatccatgtatactcagaagcccaggaagcaaagtctaagtactacatgtctgatgaactaaaataaaaagtcccttttaataggaaagatgcagaaccatataacaggaacaatatacctcttaaagaacaaagtggggataacaggttgtgaataccgtgaaaaaaatgtgggcttttctttttcttcttcttttttttttttcttttgtgctggtcaccctcacattaggtttgtctttttagtattaccactttcctactcaaaagtcttcaaaggaatatatatcctagaaatatactcaaacacattggtaaatgtatacataaaggatatttattacaccactataatggcaaaagacttttaaaaacacatttccatcaataaagaattgttaaattagattttaaaaatctttactagattactatgcaggtgttcaaaaagaaagaggtagacctatactagctaatatgttaaatataaagagcaaggtggtggagactataaatagcaagatctcatttgtgataaagaaaaataagaggaagatatattcatatacttgtatgctcatagactatttctagaaaaacatgtaagaaatttgtaactgtatttacttctaggcaatggggaaactggattctaggatgggataattatttttcaccacatattttttctgcttgaatgttttaccatgtgattgtattaatgacagttaagtcaacaaaaagagaaagatttctaaaggtttgttattgctagaaattacctttcaaaatgctccagagtcttatgctacctttaagtcttaggaagcagggaacctactcccagtaaccttgaaatagaggctctagctctggcccacataccaactacttgtgtcaaggatcttcttttgtatgttttgtacattgtgattctatgtgagattttgtttaaagaaaaggtcccagtgcttttttaaaaaggtggtaaaccattggtttaatgaatatcagttctcactccagttcttaataacatgggtatctttctaatcctactcactgtgatgtcagagtctgaatcctcaccttcaagtaggaggcactttcactgttccctggtctttaatttctaatttcaaaccactgcccacggtatcttaaatcttatttcctcatggtgatcatattcctagttctgcatcctaaacatctagactctgacctgttgagtcaatcacctacttggggaggttttaagtgatttattttgttatctatccactattccctttccaagtttcaacaagagaagcaaacaaccagaagaaagaacttcagagcttgaagacaaggcttttgaattaatccaatcagataaagaaaaaaaaaaagaatttaaaaaaatgaacaaagcttccgaggagtctgggattatgttaaatgaccaaagataagaataatagtgttcctgagaaagaggaaaaatctaagtttggaaaacttatttgaaagaataatcaagaaaaacttccctggcctcgctagagatctagacatccaaatacaagaagctcaaaggacagctggaaaattaatcacaaaacgatcaggattacaggccacagcccaattggattttttttttaacacaaagaattggattttttatttttattttttaattttttagacagagtctcactctgttgctcaggctggagtatagcagtgcaatctcggctactgcaatctccacctcctgggttccagtaattcttccgcttcagcctcccaagtagctgggactacaggtgcctgccatcactcctggctaatttttgtatttttaatagacacaggatttcaccatgttgcccaggctggtcttgaactcctgaccttaagtgatccacccgcctcggcctcccaaagtgctgggattacaggtgttagctaccgcacccaccaataattggattgcttttaacacaaagaaaggataaacacttcaggtgatggatatcccatttaccctgatgtgattataatgcattgtatgcctgtatcaaaatatctcatgtatcacataatatatgccatgtacccacaacatttgaaaataaaaaagaacaaaaaaaagaaatacaccaaaatgttaacgatggttctcagaatggtgaaattataaatgactaatttgtttttatacttttcattggttttttatatgtttcagtctatttcaattttccacattaaaaaatattacacaaaaatgaaacacacccattttctgtttttttagggggaagaactaaccttaaaatttatatttagcataggaaaaactactgatcacaaggtgatcaacaatgaaatgagctattttacagaggtaaaatctatccttgatgatactttaggaagctgattaatagtcatttctccaggatggtccagaagaagtgaattagtcacaaactctggagcttcatttccaggtaccattaacctaaagagtcacaaaatttcagtaacactaaaaagaaataattttacattaaaaagccacatgtattttgagaaccaacctatcagtgttactggcctattcactaaccaaaaagcaagattctagattaactcataaagcctatttcctctcatttacgcttttcccctaataatgaagagacagcatactatccatggataggtatttcttgatgtccaatatgttacaccactgagtcgctgattattcaagttatcaagaacaaacttgatagaaatggaaaaacagcaatgaaatagaagacataaagaaaactaatagaaactttagaactgacaacagtaatctgaataaaaaactcacgaatggactcaatagcaaaatgaagatgataaaaaaaaagagccaatgaactcaaaggtagatcaatagaaattatccagtctgaacaacagacaaaataagcatcgaaaaacagttaaaactgacccagggacctgtgagacgataacaaaatgtctgagattcatgtcaacagaatcttaggggaggaaaaatggtgtagagttgaaaaattatttgaagaggtggtggctaaaaacttttcatttttggttaaagacataaaaacctaaagattcaagaagatgagcaaaccccaaaccggataaaccgaaaaagaaattgaaatctagactgaaatgccaggtgtgatggctcatgcctataatctcagcactttgggaggtctggtgggaggatcacttcaggccaggtgctagagaccagcctaggcaaattagaagaacccatccctactaaatttaaaaaaaaaattagccagccagtatggactacaggcacctatctgtagtcctagctatttgggaggctgaggcaggaggactgcttaagcccaggagttttaggctgcaatgaggtttggctacaccactgcactccagccagggtgagagtgagaccctgtctcaaaaaagttagaaaaagaaatctagacagaaatgaacaaaatggacaattttcaactatacagcttccatcaatttattccttgaaagtaagctgaagcttggaattacattatattggttttcacctattctttcttagtcaatgtcaaaaactaacttcttataatgttaattttttcctacatttatgacaaaatttcataaatgctagcgtctaaaagaatacatagcaaaatcatgctttaattctttttgtaaatactaaatttacttataattaataattcttaatcgagaaaccatacatcaaacagatatgaaatatatagatgaaacatgtaagatagtcaaatctccccttgttacacttttcaatccaagctttaaaaaatggtccaattattttaaacaaaattttataatgcagaagtccaaaatagcaatagaatctacgcgacctcctagaagtttactagcatgggtatgacccatctaacctaaaccaaatcttagtattatggtttcatattaacatttcacgttaactctttccagattgataatatcaaaagtaaaccttgacgttttgggttttagagtttttttgtttgtttgtttgctttgagacatggtctcactctgtctcccagcctggagtgcagtggcgtgatcacagcttactgactgcagcctcgatcttccctgctcaagcagtcctcccacctgagcctcctgagtagctaggagaccacaggctcatgccagcacacctggctattttttttttatttttatttttgaagagatgggatctccctatgttgctcaggctagtaacttgaaggttttaaaggggatataaatgctatagacacataaagaaattaacatttaacacacactgtgctttggttagcacattgcaaacctctggagctccagcatgcatccctggtcagcttccatttttctcagaggtctccattaacgtaggcaagattgacaacaaaatgcacctataacatgctttctgacattactggtcttgtctagaatgcatgaaaacttcccccaaaaacagctttttcagaacctattataaagatctgcaaaaacccagaagtttgcaggagtctattttatggctactattaagtttatataaattttacctgtttaatatgtctgagggtcatattaaccttaaaacaaaatttttaaagcaggctcacaaaaatttattctagtcctatcaacactcactaatgtatgtcctccctcctttagttggctattgatatcaataacaaggcttagaaatatgcaacaaccaaattgcttatagatttaaaaggtaatttcaaacattcccaatttaagtaatgtgcacttctgatgtttaatggtttctaaactaatgattgctagtttaacacgtgcctatctgctagaaaggaggtatataataatactagtgtttgggagaaaattaactctctaattgatgagtattaaaagtcttctgttggccaggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcccgggcgacagagcgagactccgtctcaaaaaaaaaaaaaaaaaaaaaaaaaagtcttctgttaaaggttatagcattttagagctctaaactgatattcaaatttttagcaatcatattactttaaaacttcccataggctataatagaagtcaaaattctcctattaataattaactattatagccaactgttgctgaagatagtcattattaccatcctaattcttctttttatttctctgacctgaactgtcatctaattcattcctctttccccatgaaccaattcattgacaaaagtcatgtggcagcacatatctattctcccattcgtattaacaacaaaattatactgaaactccttaggcttgaccttataggcttacttatttctcaaaacttactttctctgtatttccaatcaaacttaattagtcaccatcacctggttcttgcaccatactttcccaaatccttaattccaactgcatccctctccttaacatgttcttcatcccttgccccataattgcatatcaaatccttcctatgctttaaaccccaggtcaaagtgacaccatgaatgacacccctgacaaggatacccataaattacctaagctgaaagtcagatatcccaaacccttagcactgttgactgctgacaatttggagaagtcaaagttctaaatccataataaagtattttatcactgtctctttcactgcacttaccatattttatcctgtattacaactatgaacttgcatacatttgcctaagaattagtaagcttatgggagtagaaatcatgtttttagtatcttacatttcccagagccttagaggaatactttgcttaaaacagttgcttattgaatgtttgttgaataaatgaaaatgtgtcttcattatttatgtgccttaaattaatacttcatattttaaaacaaaaatatgacaagaaaaacagcaacactgtaactattaagttataaaatctggatattggagctagtattttatcaagtctgtttcaaaattatcacagattttaaaattcaaagaaaataattgattaaaaataattgtatttcatacttcaatgacagaagtcattatcaacactttcaattcaaactcagaattatagtatttttgttgttatctgtttttacatttgtagtccttgcttttaacatgtcaaaaatctcagttaatgtgccaacaacctctgtttttgacactttcggcaccaacactaacataataatacaattactgaaaacacagttcttttgatcctcaaaatacagtaaactagtaaaactaaaatatctaaaagtcactttaaacagttcttttgtgtggttataccttcaactagacacaaaatcaggtccactcattacatttcattgcaatttttaaggacagcattcaaccatacagcaagcaattcagatgaacccaaaatcaatgtatcaaaagtaatatctaaaagtgcactgtccaataggacagccattaaccacatgcagaaaattacatttaaattaattaaaattaaataaaatttaaaagtcacactagccatattttaagtgctcaacagctatcacatcattatagaaagttttatggcacagtgtctatctaaatgataatattcttccctcagacctgaaatcctctcacttagtgaggaagcctgtttcatactgagtaactcgactattaaaactgttaaaacatgagttggcagctttagggcagatactaccttattaaagttttcttcagaaagatggatgtgcagtattagatacaaatcagcagttagctctatgaagaaacttaaactaatatcatgttaccatgttttcttcacagggtatacttaccattactaaaatgttggaatttcattaaaatcagtggtagattacttgaggtggagtttagcttatttatattcacttaaaagcttaaactattcactcagaagataacctgaaataactctcattacatctttcattacttctcaaatgtttccactgaaatatccctagcacaaattggaagaattttgttctatttgcaatattgtaggtccaggttttactggcagaagaggccataaacatatacctgatataagtgctcaatgtattagttaaaaagaactgaacagaaaaaaagcagaaacaggttatgtgtgcatgggtttccctttgcccttccactgatgctgatgacactctccgtacagggagggtcttcaagagctggtaagaaactaaagcctaggtattccactgcccttttatacactaaagccgaggtattccactgcccttttatactagcacttgcattagaattccagaagggcctattactaggtaggcaaagcaaacataaataatatacaggtaatgctggctaccaactctaaaattttaagtcatttctattgactgaactctttagtcccagttacagcaatatttttaaaacttcgggtcataacccattcaaggtcatgaaatccacatagtagaatcataaaaaaatgaaatattctgggtcactctcagagatatttgaaaaacacatatatatttggtttcccagtaatgtatggtttctacagggaagcacagaaggattttacaatccctaatcatactagctgctatattaaaatgattactactatataaatatataaactactatttatacatataagtacatttatataaacatacacactcacatatacatgcacatactactactactacactagcagaattcaggctttctgtacacaattcactgatgagagcagctgtacaaaattctaagaattcctctagggctcggtggcatatactcttaaccttccagtctatgacaaagaaatatggagtatttaatttggctgggcacctggaatgccacctaaatactagtcttttattctatatactcaactaattaaagatacatcaaagttatttcacccagatgctctaagtgataattatacaaactttaaccatttatgaaaacatctgatgttcaacctttcagaaagcatttgccacaccatgaagcatgctaggcgctcaggatataatgaataagtcaattaggtcaaatacactacctcaagggtttatactctagagtaggttggagcaatagtggacctaatcaatgctgagttaaacagattcttactagtaagaaattgagctaagtgatagtacctgggtactaggcattagaagatggtattatataaatttaggaaatggggtggccttttcaggggccatatgtgtagatgagcaaacaaattaagaaaataagtaagatatgcagttggaagatattatatttattcttaattttgttaataattagggatatctatattaaaagttatgcattttctcatgctccaaaaaatataaaaacatttaatatgaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgcctctgcactccagcctgggcgacagagcgagactccgtctcaaaaaaaaaaaaaaaaaaaaaaaaaaaaaaaatttaatatgaaaaaagaaaatgcttctgaaaatagattgccatcttagaatccaatattaattatagatttagaatagtttttataatatataggacattatataattttaattatttgctaattatcaaatttatgattcatctttacttataaattttagtatctacaaagaccacatggtagtgttggagtaaaataggagaaacagatatgagtatctaaaactatatatacattttaatcgaagaagaaatactttttttttttttgagacagagtctcgctctgttgcccaggctgcagtgcagtgggtcattcggctcactggaagctctgcctcccgggttctcaccattctcctgcctcagcctcccaaggacctgggactacaggcatgcatcatcccgcccagccaattttttttttgtattttagtaaagatggggtttcacgtgttagccaggatggtctcgatctcctgacctcatgatccgcctgcctcggcctcccaaagtgctgggattacaggcatgagccaccgcgcccagccagaagaaatactttttaaaaaattaggctgagcacggtggctcacgcctgtaatcccagcactttgggaggtcaaggtgggcagatcacgaggtcagaagatcgagaccagcctggccaacatggtgaaaccccatctctactaaaaaatacaaaaaactagccaggcgtgatggcacatgcctgtagtcccagctactcaggaggctgaggcagaggaatcccttgaacccaggaggcggaggttgcagtaagccaagattgcaccactgcactctccagcctggtgatagagcaagactccatctaaaaaaaaaaaaaaaaaaaaaaaaaattaatgctaccagaatggcttgaacgtgggagggccgattgcaccactgcactccagcctgagcaacagagtgagactctgcaggaaaaaaaaaaaaaaaaagccagccacggtggctcatgccttaatcccagcactttggaggccaaggtgggcggatcacctgaggtcgggagttcgagaccagcctgaccaacatggagaaaccccatctctactaaaaacacaaaattagccgggcatggtgaggcatgactgtaatcccaactactcaggaaggctgaggcaggagaatcgcttgaacctgggaggtggatgttgcggtgagccaagatcgcgccattgcactccagcctgggcaacaagagggaaactccgtctcaaaaaaaaaaaaaaaaaaaaaaaaaaaaattaatgctaccatagttaaagaagagaattttgagaattctgataaaaattcaagaaaaaattgttacacattaaggatttattccttttttgcctcttgtgttgaaataggtggtgtattatttatttaacaactatttttgagcattaactacaaatctctatgctggtttagtcgttagaaaataaagataaaatcatagtccttaccttataaaagttcatcatttaataattctcactactcaattttctctaaatttcttttcatttaatactgttatctccataattcaacctaaatctcaattactataatttttttatttttctgataaacagaaatgtatgtgctcacttcactaaattcggagtagtgagaggggtacaaaggagatgcaaacacaaagattttggagacaggcagtttcactcatgaactaccaggaagaaaaaagatcttttgccttgatgtaatttttaaatgatgacagttttcataaaagttccaccctccacctccatccaggaagtaggaaggtccatgactcattatgctttccctgtgcttgactcaggcttcctctttacagactgcctaattcagcagataggacttcctgatgttgaggaaatccttgtctcttaacagtgggccacatggtcccattcctgtggtcaaagctgtctgaaacagatataacccaaggagacaagagttggccagaaatctatgtgtcagtggtctctaaaagattctatactctaatcagattctttctgatataaacattttcaatgatagaaacagggaaagtggttgctgagattaagagatccttaaggctgggggcctaagtatacaagtttaaaaaagtgggttggaaaaaaataatggaagagtaaatgtacagagaagttgagtggccttgagagagagagaagatactcttctgttactgttccctgccaacgaaagagcctagtagaaaacttcctaacaaatatgatgcttgtcttttctcatgttcactcatgctacttacaccactgagacatattctggttttcacttccaataatccaaacaatatactcctttaaatatacgccctagtgttcctttatccataaagctggatgtgactaaccttgggtcccaacttcccatctttgaattatggagcactttagcttctacccaggaagctgctaattgcatgacttttttacagctctgtatttgttttatgaatacactgtattattcagcacacaactagtatgtctgttgagctttggttgctgaatcagtacaatgaaactaattatgcttacttcaaagagttataaagagagggcctagtacacttcctgccaggtattttgttcttacgtgtttggccaggagaatacaaagaagaaaatattttctttaaacttatgatataagggtaaaaaaaagctcaataaaagtcaacattatttattttataagttaaatgtaagcaaacatgttgaaatgtcaagataattttcaattccaagccgatttagttcacaggtaaacctaaagaggtgttcaagagtatattaggcgatcccctgtcaatctagctttcaaaaatgccatctttaccttagctttagataatagtataatttgaaattttgttttagataatagtgacatttttattttagttcttagataactaaaatagtaaaactgcttttccctgagaagttaatatgtaattttataaccttcattatacacaaaattaattttgttcagactataacagtgcatttttcagtaatctagggaccaagttttctccttttgacattaataatctccaaatatacacaaaaagttattattataattccccctaccattctcttaagtataccatttggtcaaattatgtattaacttattgtttcaattatgcttcatccatttccctcataatttttattattttctgaattgcatacacttgtccatgtcttactgtacttactgtattggcaatacccaaatattaacataaataacgttgacttttattaagctgtttttctacccatgtatcttaagttggagaaaatattttctttctgtattctcctggccaaatacataacaaaatacctaacaggaggcatgctacaccctctctttattattatttttttcttctacttttaagttcaggggtacaggtacaggatgtgcaggtttgttatacaggtaaacacgtgccatggtggtctgctgcacagatcaacccatcacctaggtattaagcccaacatccattagctattcttcctgatgctctctctcacccccgtccccgccactccgacatgcaccagtgtgtgtatatctcctctttgtgttcacatgttctcattattcagttccacttacacgtgaaaacatgccatgtttgattttctgttcttgtgttagaatgctcgggataatggcttcgaactccatccatgtccctgcaaaggacatgatctcattccttttatggctgcatagtattccatggtgtatgtaccacattttctttatccagtctatcattgatgggcattaaagttgagtccatatctctgcaattctgaatagtgctgcaatgaacatacacgtgtatgtatctttatactagaatgatttatattcctatgggtatacacccagttatgggattgctgggtcaaatggtatttcagcttctagatctttgaggaatcgccatactgtcttccacatggctgaactaatttacactcccatcaacagtgtaaaagcattccttttcccctgcaacctcaccagcatctgttgtttttgactttttaataatagccattctgattggtgtgagatggtatctcgttgtggttttgatcagcatttctctaatgatcagtgatgttgagctttttttcatatgtttgttggccacatgtatgtcttcttttgagaagtgtctgttcatgtcctttgcccactttttaatggggttgtttgtttcttataaatttgtttaagttccttgtagactctggatattagacccttgtcagttggatagattacaaagttttctcccattttgtaggctgtctgttcactctgatgatagtttcttttactgtgcagaagctctttggtttaattaggtcccatttatcagtatttgcttttgttgcaactgcttttggcattttcatcataaaatctttgcccatgcctatgtcctgaatggtactacctagattttcttctagggtttttatagttttgggttttacatttaagtctttaatccatcttgagttaatttttgtatatggtgtaagaagtggatccagtttcagttttctgcatatggctagccagctctcccagcaccctctgttaaatagggagtccttttcccattgcttgtttttgtcaggtttcttgaagatcagatgattgtaggtgtgtgatcttatttctgagttctctattctgttctattgatctctgtgtttgttcttatacctgcaccatgctgttttggttactgtagccttgtagtatagtttgaagttggggagcctcccgtgatgttctctttgaagtgatgcctccagctttgttctttttgcttattgtattggccttctctttattataatattcctagtttttatatggaagaatgaagaccctctgtgacaatgctcagagaaaataaattccttcatagtacaaggccctaagtatacatcctaaacatgtcttaatatcacctgcattaaaatatgaaaacagctgggaggccaggtgcggtggttcatgcctgtaatcccaacactttgggaggacaaggcatgcagatcacctgaagtcaggaattcgagaccagcctggcagactgggtttcacccagtctttactaaaagtacaaaaattagctggatgtggtggtgcatgcctgtaatcccagctacttgggaggctgagtcaggagaattgcttgaacccaggaggcagaggttgcagtgagctgagattgcgccactgcactccagcctgggtgacagagcaagactctgtctcaaaaaaaaaaagaaaaaagaaaaggaaagaaaacggctgggcacgatagctaatgcctataatcccagaactttgggaggctgaggcaggcggactgcttgagcccaggagttcaagatcagcctgggcaacatggtgaaaccccatctctgtttaaaaatatatatataatatatatatatattttatatatataatatatataaatatataatatatattatatatatttatatataatatatatatttttatatatattatatatatatttatatatatatatataaagtagctgagcatggtggcttgcacctatagtcccagctactcaggaggctgatgggggatgatcacctgagcccagggaggttgaggctgcagtgggctgtgatcatgccatgcactccagcctgggtgacggagtgagatactgtgtcaaattcatatgctgtacacatacacacacactgtgtgtgtgcgtttgtgtgtgaaaacattcaatggttaaacacagtgatatcatgaataaaactatgagccaaaaattttttagtatttctacaaagtaaaacaaagtacaaactcagtaataaaattattctaaaaatgaccattaccatgattttacactttttaaagtatcctttataaacatagttttctgattactaaaattaatgtagtcttatgataaaaccatatatacctaatttaaccacaaaactgtctgtactttaaatgatcatctaaatattctacttcaaatgttgaaaagttaagaatatctgagttcctcaaaaggctaaacattaagagttactgtatgacccagcaattcaactcttaggtagaattctactcctattcttggacatataacctaaagaaatgaaaatatatgtctatacaaaaactggtacctgaatgttcatagctattgttcataatagccccaaagcaaataacccaaatggctatcaactgatgaatgaataaatgtggtatatccatacaatgaaatattattcaacaataaaaaggaataaagtgatacatgaagcaacatggaagaaccttgaaaacaccgagctaagtaaaagaagccagtcacaaatgaccatgggttacatgattccatttaaatgaaacatccagaaaaggatactctgtagagacagaaaatatagaactatgggtaggttgggggaaaatgaagagtgactgctaatggatattgggtctgtttgggggattatgaaatgttttaactgattgtggtgatggttgcacaactctgtgaatacactaaaaactgaattgtatactttaaatggacaaattgtatgatatatgaattatatctccataaagctgttaaaaaaaaaaaggctggcaaggtaatttacacctgcagtcccagcactttaggaggcctaggtgagaggatcccttgagctcaggaattcaagaccagcctgggcaacatggcaagactccgtctctcaaaaaggaaaaaaaaaaaaaaaaattagccaagcatggtggcacgtgcttgtggtcccagattcttgggaggctgagacaagaggactgcctgagcctgggagactgaggctgcagttagctgtgatcgtgacactgtactccagcctaggcaatagagcaagaccgtctccaaaataaaagaatatctgcatctctcaatggtactcaatgacagaatgccatttgacttaatgaattctctatgggaattttaaattcaatattcttgattctagactctatatccaagaccaaatgtagaatgtctctaatatgatttttcatgtgctataatgaatgatatgctgagacagaaaatcaagtcacatactcttaccaaactctctcaggtgctcgtccatttagtaatcttgcacctccacattacatatactttttaaaaacttggtaaagctatattaattcagtttggggactaacaagtttatccaatattaaaagtatatatatcttctctctattcccaccatcatcttaatacaatcctgaatcagttcttattggaaataatgcagtagccttccaagaggtctctgcttctctttccttcaatactgtttctaccaagagtaatcctgttttttttaaagcagtaatctttttaatataaaaatctgatcccaccactcccctacttaaaatctttcagtgtttctatatcacctgtatgataaaatcccaggtcttctgctaggcataacaaggtctacttaataagcctctggtttctttggtctccttttccactctctactcatacattaggtgactaaacaacttcttgccattcccaaatacaccactgtctcctcctgcatccatgctatgtttttagtgcatgatgtttgttctccctcaaatgccctgcccttattctctgccttactcctacatatactctaggtctcagctcatgtgtaacttctaaggaactgttccgactcacaaggaagtcttaggtcctttcctgttaatcttgtgtattccctaattaagtcacttataacattgtactatataacaattttttattttttatctgccttcttcttttttatttatttatttatttttgagatggagtttcactcttgttgccctggctggagtgcaatggtgtgatctcagctcactgcaacctccccctcccgggttcaagcaattctcctgcctcagcctcccaagtagctggaattacaggtgcctcccaccacgcccggctaattttttgtatttttagtagagacagggtttcaccactttggccaggctggtctcaaactcctgacctcaggtaatccacctgcctcggcctcccaaagtgctgggattacaggtgtgagccaccgcgcctggccgatatctggcttcttctggcaaatcagaaaatctcttcaaaagttcccacaaagtagtgaattgaataaaatatgccaaacatctatattttgctttaatgttttctgaatatactgtaaacttagtaaggcaaaagcataaatgttgattagtatatttatcctaacattaaataaacatgacttgcaaagaatattatacaaattcttctgataagagatgcatgttggcacttaggcctcttaattttttttttgtaatacttctttattttatttttttaatttattattattatactttaagttttagggtacatgtgcacaatgtgcaggttagttacatatgtatacatgtgccatgctggtgtgctgcacccactaactcgtcatctagcattaggtatatctcccaatggcctcttaattttaataaagtgttgaaaccttaaaaattttttttaagagatgagggtcttaccatgttgcccaggcccaagtgcagtggatattcacaggcagaccctagtgcactttagcctctaactcctggcctcaagcaatcctcctgcctcagcttcctgcgtagttgagactacaggcacatagcactctgtccagattgaaccttaaaatttaacttgccaaccaagaaatctatttgtgccaataaactctgcttttccatatttatatcaaacttctcaaattcactaaaggcagggagttaggcaccactagtttatttgtgtaagctaattttattttactaaaaacacatcaataccttgggattaatccagtcacatttggtttatcagtcccatattgaacatccttctctcttaagacatatattggaatctcataaaaggcaaatagggttctactcagcttaaaccgtaagataatttttatataaatatgcaatactatatacaaatacataaaaacacaagtccagaacattcctttagctatcaaagttctacatgaacttatttggttctctagttcaatctgtatatataagctatattttaaacaaaggtgcagagagcaattatctttcacaatctgccttagatgatagaacttaatttataaagctacatatttattatataatcatgctcaactgattttaatcttgatggacaaagaataatattatgaaaatgacttatgcaatatcttcaaataaaagtaataagctcattgtaaatggaggtagtcatatacttagagaaaacttgaccaataaaaatcttaatttagaaaacagtgaagcaaagaagtatatgtaatttcatagaagagaattccagcagagtgtcatctcgtagtttttcaagtattttctgagtgtaaaatgaattttttacttcataaacaagtttaccatacaattcctttaatgtaatgattcacaagcctggctgcatattagaaacacatgggggatctcaaatatatataaatctgtgacaaggcccatctccagatcaattatatcagaatctctgggggtggggatgtaagcattaacaggttgggaagccctccagaagattccaaggttaagaatcactgccatagagcttttataagcttcactattgccagattatgtcaattttgaagttcaaatgaaaataataactaacattcactgtcttgttggcccagtacttaatattaaagatgctataagactcactaaaacaaacaaaaatttaaaaagaaagaaaatatctgctaatataagggaatgggaaaatatctgctaatataaagaatgggaaaaatatacagatagcttggatgaaaaggtcccataagaaggcggcaagaatatagaattcatcatcatcttaagccccaaaagccaagtaggaaaataaaaggagaacaattcatacaagtaacagcaggtatgtgtataaggcagcttctaaaacctgaaactgacaatgaaagacttgaaaaataattggctttactgctaactgaggctctgaatagttacacattggcaagctaagcgtataatacattataaactatctacccggtgtccagatgagcactcaggatgagaggtaacaaggacagttgtgagaactcccagctatcctcctgtcaacaatgacagagaatctgaaacggatctctcctttccaagagtcttctgcccctcccaaaaatctcttacaagggctggctggcaagtttactataactagagtaggcatatggaaaggtggtagcaggacctccacccctccgaaaaaatttctacaaggacatgtgactacctgggtaaggctctctacccatgaatcccttgctaggtaatccttaccatggtctattgcttcttgaggctctacctcacctatatccagagcgagccaggatgacaggagggaaactggacctagcaatggaacctactgacccagctatccaggagatctgagctgtaatatgctgtattacactaggataaatgaatatccacaaagttccatttcaacatcatgtctaaggaatgattaacaagcagatttgaacatacagatacttattaggaaatagaaaagcttccagaaagggttgatgtagacttctattagctgcttagatggaggaatatctcctggtacttgggcagtaactccgcaaagaaccagatcggcccagtccagaaaaactccaaactttcaggaagattactatgaatacttcaggcacagcttagaaaagcttaaaaaagaaagcctgcgtttcagaaactgtgttatctataagaatacaggaccaacaagggaaacaccattaccacaatgtcttttctcctctcagtttttaaccctgaaaactttccttttgggatcacaaacaaataatagagagtactgagttcttttccaccctcagtaatttgtgtcctagagtgaaaggaggataagaaaaaggaaaagagaaagagtaattcaagcaagagaatctaacaagcaagataaactatccaaagaggtcagagtctgaaaactggcactactggtgggactgatgaataatccattactcacacacaaatctcttgttcagtgtcaggtgcaatactttgtggagcaggtcaacataaaagtaatggtacttctactaagttatctaaactataattataaaagttttagattcatggggccccaaaataaagtctggtataattacaaatcaaggccttctgaaaaatgcttagatggtcgtcaaagagagattaggtggctgcaaagaagagctaaatggttttgagaacaaaaaacttgaggtttcctgtgtaaaatatagcctgatacattaaagagaagtacaaaacttgaagaaataggctccagaaaaagtttattaggcaacagatcaacagctgatttagtaatgaaagttaggcttcaaacaactacgacagtgaggaggttaaaaaaaaaatctaaacaattatatctagaaagaatattaattccaagttttgggtgaaaactaagagttggaaaggtgtttctttgaagagaaaagcagtggtctccctaaaaaaatttcatttgaatttcacatatactagaggtccagaaagttctaaggtattaagggtttttgaatgtgtgtctgcttgtgtataagggattaatatgacttcggaaaatttgatgtatttttcaatcaatgcactaaaacattaggaatcaaattagatctaggattcattataatcttcctaccatgagaagtaatctaaattgaataaccaaaaaactttaaaataagaaaatgagaagggacaaagtgggtaagagttatactaaaggtatgattacttttaaaaagaaggaacttaaacgttttaaaaacggaggttcaaaagagatcatgttgtttcaaaatggaggtagagacgttttgaaataaaaataacagcactacgtaagttacttatttatttatttagagtctccctctgtcgcccaggctggagtgcaagtggcatgatctcagcttgccacaacctccacctcccggttcaagtgattcttgtgcctcagtttcccgattagctgggattacagtcatgcgccaccatgcccagctaatttttgtatttttagcagagatggggtttcgtcatgttggccaggctggtctcgaactcctggcctcaagcaatctacccgccttggcctcccaaagtgttgtgatcacagatgtgagccacaacgcctggcctatctatctgatttcaaatatgggctattatacagcctcataaatagaacttccatcacaagttcagcaggttccttgaaatggaagttggctttgacattttcttatcctctttaaattttctatttcacttaatttttagtcacagtgacttcttactttcttgccagatcagcaaagtcaaactaacaacatttaaactacttatctaattactgaatttgtattcggtaagttattcagagtatttagtttgttacaattatatgctctatagattattgaaattttgcttttaaccaagtggaaacttatttcccaaaagatttctccaagtctaacttttgttaatgatttaaacaccctataatctcattcccagttcctacttaagattcaaattcatattaaggcaaattgcctcagaggtttgccaaaaataaaaaaaaaaattccatgagctatccatgtcagtttcttcaaaattgctggctatttcaatctccctatgcattacatactctcatgtataccccctgaccagaaatttaaagaaaacttccaattagttttccttttatttccagaaattactctccgatgtcctaaataatattgtcatcaggatgacccattatatctgttattaccatttatttccttattgaatccacaagtggtaattcattactgtttgtgggtttgtgatattatatatccctcttagggaaacttgtaattaggtcaaagtttccctgttttaatattgctccccatttcctcactcttataaccttatcaagccagtgaaataatccctgccttttggcttagtggtccctcactgatctatgaaaagataggtaaacattgttctcctaatccatattgaattccagaatttatacttgtaagagtgatctcaaaaatgctgaatgaaatcattatagtcctctctctcacttataaaatataaaatattaacatatatcaaagaaaataaattgactaaaaagaatatattggaaacactttccagtcagatataattcagtgattttatattataatgcaaaaaaggcaactaatagatatcttaaaaatgggcagaaatacacttttaattctaattacttgtggaaacatccttttataacattgttcctagggactaagaaattcaaactcaacgaccacttctagaaaatattacaaaactggggttacatacaaccagaaggcttaattattttttaaaagttcactttaagaggtggctatttacacatacatatgttttcacacataacacatatggcttttttcctctcttttaagaaaaataccctgtatgtgctgaagccagtattcattcagcctaatcttttacattcactatacagtgtaacagaataaaatcaatgcttgattcagctatctggaaacagttttgtggttcctccaaaaagttaatgtaaaattactacatgaattgaaaacagggacttgaaaacatacttgtacacctatatccctcaaaagatgaatgaataaacaaatgtgatatacatatatacatatttaatatgtatttgcatatatgtacaaacatatgtatatatgtacatttgtatatatgtacaaatatatggatatgtatacacaaatatatgtatatatgtacatgtatatatgagcaactgtgtatatatgtacatttatacatactagtgtgtatgtataaatgtacatttgtatgtatatatgtacacatatacatatatctataaaatggaactataaaaggaaatgaagttgtgctacatgctataacatagatgaaccctgaaaactctaaagtgagataagcccaacccaaaaaaggacaaatattgtatgattccacttatgaaaaatatgtagaagaggaaaatttgcagagatggaaagtagattagaggttactaggagatgggggatggtgagggaaatgggaagttactgcttttttttatttttaaattttttttgagacagggtctcactctgtcacccaggctggagtgcagtggtgcgatcacagtttactgcagcctcaacctcctgtgttcgaggcctgagtagctgggaccacaggcgtgtgccaccatgcccagctattttattttatttttgtagagcaaaggtctcactacattgcccaggctggccttgaactcctggtctcaagtgatccttgagaccccgtctcagccttccaaagtgctgggattcaggcatgagccactgcatctgaccaggagttattattacttaatggttacagagtttctgtttgggatgatgaaaaaattttggaaatacactaatgatggttgtacagcgctgtgaatgtaattaagaccactggattgtgtagataaaaatggttaaaatgacaaattttatgttatagatattttactgcaatgtaaaaaaaatgtaatataccaaaatccattaaactatatactttaaatgggtgaactgtatggtatgtgaattatatctcaaaaaagctatttgtaaaaattaatgtttgaagtccttcttcagtgcttgaagatactgttctagttccttttccttaaaggagctttcctggtcattccaatgaccgctctcttactgtcaactcataatattttacttacatatcactcattaagcaattaatcttatgctccttttgacatctctggtttttttaattactgtaacacatttaatatttgattacactttgcttataaaactagactggttgctcaaattatcaaatcaagactcatttaatatttgtttatactttatttaccaaactagattagtaatagcgcagattgtcaaatcaggacccagtagccctctatgtcttcaaatcatcaaaaaatattcaattttatacttgcacaaatacatcaaattttaataatgttaagacaaactattccagaaaaaattaatcagaatactcattctctggacatttctttctttctttcttttttgagatggagttttgctcttgtcacccaggctggagtgcaatggcgtgatctcagctcactgcaacctctgcctcctgggttcaagtgattctcctgactcagcctcccaagtagctgggattacaggcacccaacaccacacccggctaatttttttgtatttttagtagagatggggtttcatcatgttggcaaggctggtctcaaactcctgaacttaggtgatccacctgccttggccacccaaagtgctggcactacaggcgtgaggtgtcgcgcccagcctctctggacattgcaatttataaaggatgtaacagatttagttcagtataattatttaaaaataggcaataataaaatactttgaacagaaatttttttctgatcaaccagtcatttctttttccccaactgaatcaaagacattgtccaaataaaacaaattttaaaactaagtgatacacaaacatttaacacatacactactatttttatgactaagtagaaatgctcaggaaatataattttaatcataagtggaattaattaaaatatgaaattacatagataacttagttaaaataaagaatgttgtaggggtcaaacaacatttttgtttacttaaataatctgtttaatgattacagtgaccataaaataagttatacctaaagaagtctttaagtcatgataataaaataaaaggaaaacttcagagaaaggtataggaagaatgaatacatcttttttgttcctttgaaaaaatagcataaaattttgagaaatgtatcaaaacagcagacttggtgtaaagtcatgtatttatagaacagaaatatatagacaatgtaaagtttctacctattccctcagtatatacttaaaatgatcattcagactcatatcctattttaatctacaccaggtttttaaaaaaactggtatttctgtatgtttgacatggctttgtaaaaatatttctttcttgcagtttgtctgaatgacttgctcttaagtatctttaaaaacatcataaatgtaaacagtattaattcacatgaaataacttctatttcgatccagaaggcaaaaggtttaagtttttaaaatatggcattgtcacctcaaaagtaagtatgtttcaaagaaaaaccatatttttattccctactgaagttgaaccacttacgttcacttttacaatgaaaatacccagcggcatcttagagattactggttttccagtaagaaacatagctatttagcaaattcacttgcctaaaaaacagccaaaaaaggaaaagaaataaagacggtctctaagctgataaaatgtgtggattaaaactcattcttcattatttagaatgtctttgtgcccttaatctttgaagttttataatttacacatgattccaacaagcttgggttcattcccaaggtcacagtatagtacaaacaaaaagatgatgataatagcagctgtaattttctaagcacttattaagcactatacacagggatgggaaccaggagtagagggagtgtctctaataggtaactatactgaaagctctgtagttattcaaagaacaacaacaaatggtttgactccttgatcaagaatctaaaagccttatgtcccaagggtatgactgtgttacactacagaatgataactaacatttaaaaaagacaactccttgtgacctcaaacagaagtctaaaaaatttttaattttaacatcatacatttttaaaataaggagcatgatcaatggaatctaaagacctggatttgaatccaggcctatcacctaatctatcaatgaccttagggaatattaatctccctcatactcagtttctccaaatgtaaagcagaaatactatttacatgacagtactaaagtgagaatcaacatatgtaaaagcagatagtacaattcatgaaaacagcagtcaatgaaatactcttaaaacttgactacccagaataattttgttctttgaaatatttttgttactttttaaatgtttttacttattagatgtttagctgttactttcattagtaaatatgtaaagtagataatgccaagattcattcaagtatgtagcaaatgctctcaaatttcactataaactacctgtttgactaagtaagtccaattcattcttcagtctcaatttgggttgtacccactctgtaaagccttctcacatctccacttgcatatctaatgaacattttggtctaccacatccaaagtcaaagtcctgattcttcatcctcatcccacaccttctccacctgaaattcttccctatgtcacaggtgatggcaacaccatccttccagctgccaaaacccttaaaatcatcttttctcctctttccttgtatctcacatccagcccatccagaaatctttttggttgtacctcaaaaacatccagaatttaactgctactaggccactaccttctctcatttagattactctaagaaccttctaactggtggtccatgactccttacatatagtctattctaaacatagcagctggagtgatcctttttaaaaatactgaaagccctggagtggctcctcaaagtccccactgaggccctacatgaataacccactcactcatttcctttgacaatacctcctcttactctctctctccatacccgtactcacaatgacaaccattcatttccctgagcaaaccagtcatgctcctgcctcatgccctctgcctggaagactttccaaaggtatccacatagctaacttccttaatctttcctcaacatcatcttttttgtgaatccttcctcagcccctgaatcccatcatcacctaaccttcacatcctgctcctttttctttacttcataacatttgtcatcttctaaaatgctatgcagtttatttattattattaatctccactcctactacatgtgccacaaaagcagagacctttgaaagtttcatttgctgatatttcccatgtacctagaacaccacacaaatatgcaaattaaatacggaaataaaacaatacattggatatctctcctttgcgtcacctttagcattctgtactgacctatattttatcagttatcacattgtactgttaacagcctattaattttctgcctcttccactagactgcaggctccttgagacaagggattttgtactgctttataatgctattgcctgtaattccttaaagtgcctgatacttaggcattccataatatttgataaattaatgaaaaaaataaaaccatccaaatcaagtgtgtaagcacctttactatctccaaaatataaacacaatggttaagggtatgacactggagactgttctggattctgaattgtgttagtgttttcagtctggctctggtatttactggctaaggaccttaatcaaattatttaaattctctacaattactttctcattgataaaaatggaagtaataatggtacctccacctcatgtgattatcatgaatagtaaatgacaaaagaattagcccagaggtttgcatatagtaagtattcaataaatgacataaattacttattataaattaaaatagaggcactattataacttttactttgataacttgactaagctagaatactcacaaacttaacctttagaatctcctcagaatatgccagtaatttatatcaaaaattactgagttacctaaaataaccctgataagcattatgtgaaagaaactaccttaattctttcaacaaaagaaggagtctatttacattatcccattttttaacattcctagatgttaggttctataacattcttcagtaactacttttgatttttcataatcttatgttttctttttatataatcaacatacctaatactacagtttaaaaattaaacatcttactacatagatcacctgcacttatatgtccataatacatatatacatacattcttccctctactctgaacaattttacttccagaaataagacttttgagaaaaagttaaataattttaagtatatttgtcactctttactaaatcacctttaagctttctacttcccatttcagtcgtgtatccaacaacatgtatattcctatttatattcctttggtaatattatattaaagattgagcaaaactaagagttctgttccaaattaaaaagccaatgtaatggtgtttcttttaaagccataaattttatttatctgtctattgttactgcaaatgttttcctatgtgcagagtcagttctccattttataaaatacttgtgaaattcatttcctttgtagtttgtaacactatacagaaataaacaaacatacacattttacttaagcactcacacagacagtagacaagacaactgaggtaagcagtttaaatgattgtcccaagaccacagatggagtgacggccagatttaggattaaaactaagaagctcattattcccttcttatattctgaatacttaacattgtttttatatcataaggatctctttgctaatttaagaataagttaatttcataattaaaattgagatattttgagaatatgtaaatagaattatgaaacttactaaatcaagataaaattagagtttatccaaagtctctgaaaaaaataatctttttactacataagttatttttaaaattttgtttagagtggcaagaaagtggcagcttaatatcatttatcatttcaatgtctttatttaataaagctaatttctttaaccaaaacctacagtatgtgtatgagctggttggatttaagataccaaacagaaatactttttcattttaaaaaatcctccaaacttaaacagtagtttctactctaattgtaaactttaacttcaggatatatttataagagatctatctatgaaaaaacaatgttaaaaagtaaagaaaacaccaaatacccttgcatttacaggagaaaaagacatagagtataacattaacagcttactgtggagagtgggtttaatcaggaagtagccattatcctttcgattcagagcagtgacagcactccaaaacaacaagccgtgatatttttcagttaaaaggcatgaaagaatacctactattgtgtcctagctttgctgaccccaagggtcagcatatgtcttttatcaaaagctatcatgaaaacataatccaagtaagcatttacaatgctctatttgttgaaacacctaaaatctacctaacacaacctctctctctctcagttactcacaaaacatggctgtcttattcagagattagcaattattgtaatgagatactgtcggagagggtcaaatagtacttcctgcagtttacacatcttgatttcctggtaaacaaactgaaaggcaggtggagcacttagatcaccagcaaacgtgaatgctcacgtgataaaactaagccaggtaaggttgatgtctcaagtaatcgttcttttcttaattttattaatgtcaaacagacaataaagagaagaggtctttcttcctttttaaagaagggtttactcctcacataaactcacatgataggaatgcttgaaaactggcactgtttaaaagcaggtttcaaaaatcacttctggcagataaactataaaaacaaagcaatgctaacaaataagaataactgctcaaaaacctgccaaaaataaagaaaagtctttaaatttcagctgctacaacaaagtacacaaaataaatttctgagttataataaaagaccaaaattaattgttttgtggtcaaagcatgtctatttttttatttggacaacttcctgcaaaataagactgctttataatttatgtggcagtctttgaaaaaaaaattcctatgatcagaaagtttacataatttgaaacttttctctacatcattttaaactcatatatcaaaaagaaaacaaaacaaaatatttaacctgtgagcattttttaaaaacattgttagcttgaaaactaagtttctttgtccatagttttttttttccccccaaattgctgttttttcactctctgaaatttttagtgtagtttgatgagggaagatttaaattagccatgggtatcaaacaaacaaaaaacccaactccatcaaaatgataaactaatttactacttaaaaaaatctagataattctgtaaattcataaaatttgcatttatctttaaaattctatatttactaaggccatgcatcaatatcctaactatttagaacaagtaagatttaattttaatgcaaaaagctcttaagagcccgttacaacaatataatcatgttaagatattaaaattatactacttaaattaggtttgtatttattcattttgcaaaataaagttataatgcactgaaatagaacaaaacagaatgataacaaataacaaaaagaacacccaggagagaagactgtgccaagggtatagaatctcagaacaggtctcattacatatacgtaatatgtcatttcaaggagtatgtattcggtattgagccacattaatgcaagttgctaacatcactaatcaccacctttactacaatgacacatgaaatagcaagttttcaaaaaactacaactacgaagttaacatttccagctgaatttcttggtcacgttaacattaaataatttaaaaaccatagtagtcacatggaatgcaaaacacagttcttatttcctttatagaaaatttgagatgtaattcctaccacataagtagctttgagtatgtaattcatacaccaaaacaaaacaaaattttaaatcagaaaattattatttcaattgtttcaatgatttatgaccatcttagtttcctataatgtgtcaaatttagagcacgatgaaatgaaaacataaagaggtacagcaaataaatttgatatttggtttcactgaaggtggtttttatcaagaggcagtaacttttgatattatgagtttacaattcagttaaaaggtaaggaacaaaaaccagttggaaaaagacttgccctcagagctgacaaatgagaaaaatatatcttttccttctcttgggtatatttcagccctacttatcctctgaggcattctttaactggacctggtagtgctatacagacaaaaagcttcagagtgaattcccctgtactctggaaagtccaagaaaccacagagctcagtcgtccatattaagaactatgtgcaaaatgaggtgggaaggcagagggagagacaagaggaggaagaaagtttcctactttttgcttgcttgccttctgctacaataaataggtgttacataattatttatatcccatcttattccaacataatttaagatgacttacaaaactatgagtagaagaacagaatgccgtctttaaaactaatatgaataaaagggaaaataagaggacatgagaaagatgaaaacacaaggtaaagctggaacaaagaaacacctatcgtaaggtcttgcacaagtctatgatgtgggtggttcagctccttagcaatcaaagtgggaaacaagatcaaattacaaaattctcattctctgtaagatgtaatttacaaacaagctccaaagcattctctaggacttagaattgagagaagttttaaaaataattttcaaaaatgcaacactggagcatacaacagttttctcaatagaatctttacagcaattaaaataacaaatttcacataaaagtttcttttaacatttcctcagtgcaagccagagtgataacataaggaaagattccccaaaataagccatcttgctaggaagtgtgcaattcttatctggatctttaaacatacactaacaatttccagaatcttatgttaaattccattttcaaattccaacttcatattctattttcttttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtattttttagtagagacggggtttcaccttgttagccaggatggtctcgatctcctgacctcatgatccacccgcctcggcctcccaaagtgctgggattacaggcgtgagccaccgcgcccggcctcatattctattttctaaagtcaggttcttatgctagatgagagcataagatcacataaaatgagataaccagggttccagatcaggcaaaagataaaacattggtaggtaggtccagacaattataagggacctttcttcttttttttttttttttttttgagacagagtcttgctctgtcgcccaggctgcagtgcggcggtgcgatctcggctcactgcaagctccgcctcccgggttcacgccattctcctgcctcagcctccccagtagctgagactggccaagggacctttctttttaactgaaatgagttcctcttttcgttggtgatcttccttctatgatcctgcccattacaacagctgggagtccaatctatgatgatgtttaatcctccccagtttggtatttctaaccgtagtagataaatgtgactctgtcttcacattcagtttgcatcaatttagattcatatttgcatacttttagaacatttactttttgttactggtgcagaggaaagacagcaaaactgatacaaaggaaatgtcctatctcttattttattatacaagaaaaaacaagatctaccagtgatgtcaaacgacatgctaccatggtataatatccagcctgaacactaataaaatgtaacaatgatgcattctggttttcatgtcaggtaaataggttgtagcaaatcatatcttccttactactgggttggtctgctctctgcctcccaaagatcctaaatttatgtcctcctgcctcccagattatgcttatgttgtttcatatctcttctcctacctcattatcagtttaggtctcatcactttcaggatggctctctctcagactctacttgaagggcccataaaagctttctctacataatttagctatatattactatataattatttggggattctccttattagatcttgaaattccttcttttatattacccaccatgaataacaaaatgctcaacatgtagcaaatactctaaatacaaataaacttactataatgcattaataaactgctgtatatatttataacagctcatgtttgttcaacataactaggatatttattatgattgcatcaattgaaccagaaggcaaatttttaccatacaggtgatttctgcatggtatacaatcaacccatatttaatcaaaccttgggcttttctgttttcaagcttgtcaaaataatttcaattgtgagacaacttttgagaacactaccaaaaaccaaatctattttgtaagctagtgtcaaacctcaaaatgacgaagattaaatgacaattttcatccaatacagtttgattcgtatttgaactcataacataaaatttatgaagcttattactttattaccattcaaagaattcttccaatgtgtagccattaaaatttatttctgaacttcctattttataaaaattcaaaccttagtaatctcaatatataattctgctattgtaaaaggtagtagtctttagatttggcataatatatacactcccttaccataatttcctgcaataaggaaaaccactcctaatatttaaaaatatgttagaaaacatacactgaagtatctcatattatcaacttaaatcaatcaagattcattctgttcattaaaaaagttataggataattatcatggttacattattaaccatcttataattgtttacttcaaagaacaaaagtaggaaacatttccataatataaattgaaatggcttttgaacaaatttaacaacaaaagaatattattcaattttctttcttttccttaaaaacaaaatggaaagagtaagccaaagacagatacagatgtgtatattttcatttattgcaacataatagatacacacagaggctgtgagaatacaatattcatttttctgcagaagaacagacattgcataacaatgagatttgctaatgaaatcaaccatcaacctgaaatacatatgtattaaaccaagacctcagtgtcattttctttttgaatcgtttgttcttactttcatttttttctcgaccttttcagtatttttgtcctttagattttagaacttatgggtgaagcaaaatcaactctatattacaatgtattgctttttattcatcacatttattttcaatgtaaattccaattgttctgcttctatcagcactattagtgtaccttcagaaaaaagaaatcaatggatgctaccagaagaaacaaaggaggtttatttctatagagaattgttggatctcaggtccaaaaaattttttatcaatatttcacataaattctatgtgaaaactttaattgcaaggcgagtgcttacttatttaataagaaataagaaaataataaatacattttaaagtcacttttgtaataatataatttcctcgacaattttgactactgataattattaaatgaaataatgtagggctaatataatcattaaaatgaaaattattctcaagtttttaaaataatacttttccctcaaaatgttttactatcctggtctgcaaatgttgattaccaattaatattttcaaaaataagtaatactgggaattttcttaaagatttatgatttagttacaatcttcaataaaagcacaagactatgaaaatatttaatgtgatgtatcttaaagaaaaaataagtattaatgtacccccagaatcaatttatatccttttgagtataggatatttaactaaagagctatctgtgctattggttatccatttacacaaattaggttttcaattcacctgtgctacagataaaattaacaggctaatctctggcatacaattgctactaattcataataataacagctttaacaacaacaacaacaaaaagcagtacttataccaactaaaacatccagagtcaaacagaagattaagtttcctgttatattttatactacgttaatgtctaacctcaaacaataccctgcaaaaataaccaaaggcagtatcaactacaattctgttagaaataagtaaacaattagacgttccttattaaatgtaaactctgaaagttgtcactgacgtctaataattgtcaaggctatttttaaaactttgaagaatgacttgaagctacaaaccacacaaccacagaacgatcaatcaatctaaacacaagagattttcctttaaaaatccaaaaatttctattaaaatgtcaaaatatacattagactgtagagaaacagacgctttaaacgagtatctgtgcaataccaaaagcctacttttactagtacaaaaaaaaaatcctaaaacatggtgatagggtttggaaagtcatctagctcattgctactccaagtatagtccacagaccagcaacatggaaattatttgttaaaaatgcagaatcttggccaggtatggtggctcacacctgtgatcccaacatttttgggaagccaaggcaggaggatcacttgaggccaggagttcaacactagcccaggcaacacaacgagaccccatctctacaaaaaaataaaataattagccagatgtggtggcatgtgcctgtagtcccagctactcaggaggctgagatgggagaatcacttgaggccaggagttctaggccagcctgggtaatagtgagacctggtctctacaaaaaatattaaaaattagccaggtgtgttggcacgtacctgtagtcttagcaactcaggacattcaggtgggaagatcacttcagcccaggagttcgaagttacagtgagctatgactgtgccactgcactctagcctgggtgacagagcaagaccctgtctctaaaaaaaaacaaaagaaacaaggctgggcgcagtggctcacgcttgtaatcccagcactttgggaggtcgaggcgggcggatcacaagatcaggagttcgagaccagcctggccaacatagtgaaaccctgtctctactaaaagtacaaaaattagccgggcatggtggcgcatgcctgtagtcccagctgctcgggaggctgaggtggaagaactggttgaacccgggaggcagaggttgcagtgaactgtgacactgcaccccagcctgggtgacagagtgagactccgtctcaaaaaaaagaaaaagaaacagaaatgcagaaactcaggccccagactagacttactcagaatattctgtacattaaagtttaggaagccctgatctagtacctaacaatttatacaccaatttcaataatttctgatataataacaacccctcaaaaaatccatattaagagacagaatactcagggaataatttatttgttgtgcccaaagtccacggcctatcttttgcttattcatctaagtctcattcatatggactactgatttaaaatttgtggtaatatgaggaataagagggcagaaataatatgtttctataaactattggaaaaaaatacatataaaaaacaagaatttacactcagcaaaattttaaattgattcagcagaggaggcctttcttcaaataaaatatgtgaagaagcccagtatgtgctcacactgagattacaggctcacacctgtaatcccaactcttgggagaccaacgtgggaggatacattgacgccaggagtttgtgaccagcctgggcaacacagcaagaccccatctctacaaaaattttaaaaaattagccaggtattaaaaaaataaataaaataaaattagccaggcatggtggtgcgcgcctgttgtcgcagctactcagcaggctaaggtgggaggatcgcttgagccgggaagtcaaggctgcagtgagctgtgatcatgtcactacactcgagcctgggcaacagagcgcaaccccatctcaaaaacaaaacaacaaacaaacccagaatagcagaaaataaagagctgctttttggggtagaggaggtacctagcagctgccaagatatttcaatagaaccaattcacatggttctgcaggggacactctgacctgagaaaaggggattacttaagagtctaaaaacaagtggaaaagttgttacactaatcacaaagttcactatttatcaaagcaagtcctcaagtttattctgtagtattttaaactaagaacactggattaaaattacataatttttttgtaagtaaaattgatattttcctaaataaatccaatcggcgaagttagaagtaactaaggttatctttaattaaattattttaattagtagtaggcctgtcatttacaaggcattatgttaaatgctagtaatatagatgaatggacaaagtactctatttatcgtcttggaagaataaaataaatacatggtagtcccagctactcaggaaactgaggcaggaggagttcttgagcccaggagttccagaccagccagagcaatatagagagaccctgtctctaaaataaagataaatacatggaacatactaccatttataccgtaagagtggtataaataaagtactctgagagcaaaattaactgaggatgtcagaaaaaaggtttacgaaaaaatgacatctgaagtaggctttggaaagcagtgtaggaatttgaataacaaaggtgggtaggtggaggaactaggaaaagaggcatcccaaggggaaggacaacataagctaaggatcaaaagctgaaaagcactggatatattctgagaatagctaaggtggcttccaagctccctaataacaggaatcatgagttgttccttttatagcagtagcacctataacacgcaagagttaatatacaggttgaatatccagaatttgaaaagctccaagatctgaaactttttgagcatcaacatgatgccacaggtgaaaaattccatacctgaccttatgtgacgtgttgcacattatttaaaatatcatatataattgccttcagtttatgtgtataaggtgtagatgaaactaataaattcagtgtttagacctgggtatctcccctccccaagatatctcattatatatatggaaatattccaaagtctgaaaaaatctgaaatcccaaaagcttctagacccaaccatttcagataaggaatactcaacctgtacctgggcagcataagagcttgttatgtatatactgtttgaatgactcaatcaatcagtaaagtaatatagtctggctagtacaaaggacatatgtaaaaaaaatagtgggagagatatttatttggctgaaaacgtactttaagaccttattggagatgaccttaaataccacactaagtgtttgattttaatgctgcaaacaatggtaaactacctgcttagaaatattgatctagcagctttaaggaggatgaattgaagcaggaagaagtttacaataaggatattgcaatagttggtctcctgagataatttaggcaaaagtgaggttttgtactaaggtgtggcagaagagtgacaaatgaggggatggataaatataaaagttattcatatatagaagtagggataatttttttttacttcctagctggttaaactagagaaagaaatgtaaaaattgtattgtagaagtaaaatttattggacttcaaagcagcctttatatgcagaaagtaggaatacaaaaattaagcaaatgccaaaaaagtagagcagaaatcttttatgcattgatcacataaactggtacaattatatagaaagaaattaggcaacatatagtaaagtcaaagcagcatgtagaccgtaatacagtaattctagatatctcacccagaaaagttcccatacatgcacataaaaagtcatgtatacgaatgtaaattgcagttctacttgtagagtaaaaccttggaaatattggaaaatgaaaaaatgaaaatatcacggtatgtttttataatgaaatactatatggtagttaaaatgaatgacatagagctacttatattaacatagatatatatctttaatatgctaacacaaacacttgagggaagtgaaggtttaaggttttgtttgcacttctgtttatcactttatttcatgccaggacaatcctttggataacaatgaaataaaccagtcatgagggagaaaaatgaatgtcttttggcagatcatgaaacaagcctctagagaaggcagaaatgaataaaaataaaaaagcatgaagttttaggtttagtaaggaggtgaaacacttcatttctcagatatgggtagggaggtagaaggaaaaaaacctaatagttttttgtttttttgcttttgagacagggtctcattctatcacccatgctggagtgcagtggaatctctgctcactagcttatatagtaagtgtgtgtttcttcctttttttttttttgaaactgcaaactatttttcagagtggttgtaccattttacattcccactggtaatgtatgagagtctgatttcttcatatctttgccagcaattcatattgtcgctatttttaattttaatttttttagacagggtcttgctgtgttgtgcaggctggtcttaaactcctgggttcaagcaagagttcaactgttctaataggtgtgtggtaatatgtcatttttcaatttctctgacggctagtgatgctgaacatcttttcatgtgttcagctgacatccgtataacctttttggcgaaatgaatatcttttgcccattttctaattggactgtttgcctttttactattgagtttttagtttttatatatcctagataagagtcctttgtcagataagcagttttcaagtatttcctcccagtatgtagtttgttttttcatcatcttaacagggcattttgcaaagcaaatgtttttaattttgataaagtccaatttacagatttctttcttctatggatcatgtttttgcatcacatggagaaactcttcaccaagttttgtcttgtaggttttcacctatgttttcttctaaaagctttatatttctacatttaaatgtatgatccaaacaggttctgagctacaggagaagaagaactgaacaatcttttcatcaggacttcaactactttgtctagttaatttcaacatttactgggtatccacttaaagtggatactacttaaagtagtaggcacttagcacagttacaaagtatcagtatcagatacacacaggagaaaaaacacaaatatatatttttatttcactattttcagtgttttgataagagttatacatgagtgcacctgacttacccaggaagagcttgagagtgtttctgtagactacatttgctctaaacttggaagccttctcacaggggaaggctatgtcaggaagggataacagcactcagtaaaggcaaaaggactatatacacacctcttgctttaaggaagtataaatcatttaacatttggagactaagtatgggagattgaggcattacttttagatgtaagcaggagacaggctgtggaagatttcatataccctgtaaatgagattaaattttattctgtagtggttggaagctaataaggagtttaagtaggtaaataacctagtttgatttgtgatgtcaattatatcatcattgagaggatgatgaacttggacacagcaagactaggggcagagacactagttagggggttactgtgacagcccaggtgagacatgatgcaaatctacattaagatttaagcatcatgaacagagaaggaaagatggatttgagaaatatttagggggaaaaaaagaaatgtagtctttgttaaaaacaggccgagaacagtagagaaggccaggtgcagtggctcatgcctataatcccagcactttgggaggccaaggcggttggatcacctgaggtcaagagtttgagaccagcctggccaacatggtgaaaccccatttctactaaaaatagaaaaattagccaggtgtggtggtgagtgcctgtaatcccagctacttagtaggctgaggcaggagaatcacttgaacctgggaggcggaggttgcagtaagccaagctcgcgccactgtactccagcctgggtgacaagcgaaactctgtctcaaaaaaaaaaaaaaaagaatagtagagaagttatgaaacagcaatcgattgtagaaaatccttttattaacctctagttaacctgtaggattgtctaatacagcacttaccaaagcatgaaaaacactagtcccataagatgttctttgaaggaagggtcaaataagttggaggttcacaaaacacattaacacattttaaaaggctcagaaaaagttgttaaataaaacaaaaccctttggatacaggaaggggaacatcacacaccagggcctgttgtgggggggtgggggtggggggagggatagcattaggagatatacctaatgtaaatgacgagttaatgggtgcagcacaccaacatggcacatgtatacatatgtaacaaacctgcacgttgtgcacatgtaccctagaacttaaagtataataagtaaaaaaataaaaatatacataaaaaaataaataaaacaaaaccttttaacattaaccctatgtcttccaaacttacttgaccatggaaccttttttcatgaaatactccatacaaccaatgctctaccaaaactactttgggtaccactggtttggcaacaatgtgggctttggttaagcttcaatcttctctttaaaaaaaaaaaaagacatatgcttaaatgttcatttatgtgaaatctctctggcttcctttgtaactctctctcattgctcaccaactctagccatcctgatttccctattattcttggaatatgcaaagcacaatctctctcagtatcgtggcatttactgttttctttggaacagttctcacccaggtatctacatggctcaactccctcacttccttaagatctctgcaaaactgtcatcttattggagaggtcttcagtagccaatctgtaacaaatactaattcatacccctggctaattcatactcatgactcttaatttgctttacctttctcctaagtgttagttgccatctaatatactacatacaacttatttatctctttcaccaatagaatgaaaagctccatgagtgcagagtcgctgttgtttagtaccttatccttagcacatgcaagtaactaggcacttaatagttgttgaagaatttagtgatcatcatataacctctgattgtatttattttatattaaagtagataataggtaaaatacctacatatcaacatattcattgataaaaacagtattttcacttatgattttgtttttcatatttttcatgtccacattcaatatgaaagatctcaccagttttatcctttaaaaaaagtgaggattttggaagctttcaactctaacttttcaaacttttctcttcatcaaaaacaaatctaaaattgctacataattatatctttagaaaatgcacagtcattttagtataacttcttaaatttctctttagcacttccttagacactggcctgcaaaggactacctataatattgaaagtagtaaccttcaccctctaaaacagagtcactttcttttgtgatgtacagtgatttctttctataacttttgcaattgttaagtgctttcataggttttaggtgtgtaatgcctctacttttaattttaaccatgacttattactcttcagtatagatcaactgtccagctgaacgtatttcacataatactctcatagtgacatatattccccttaaaacggaaagaaatgctcactgataaatgcagcaatttttcaaaatatctcagtatatctataaataatctataaaacccttaaatattttaatataaaatgcaatatttctacaagaaaggactttaaaaaatacccaaataagttaacacaagatatatactttaattggttctgcttcatataaaatatttattgaggaataacaacagagttatgcatatataactttataatccagatataaactctccattcatcaaaatttttctatatagcaatatattaatagcaaagtaaggccgagtgcagtggctcacaccttaatcctagcactttgggaggccaaggttggtggatcacttgagatcaggagtttgagaccagcctggccaacatgatgaaaccctgtctctactaaaaatacaaaaattacccaggcatggtgccgcatgcctgtaatcccagctactcaggaggctgaggcaggagaatcacttgaacccaggaggcaaaggctgcagtgagccaagaatgcgccactgcactctagcctgggcaacagagactccgtctcaaaacaaacaaacaaacaaacaaaaagcaaattaaaatgaaaattctgaattccttccagtaaaaatacctgcaattgaaaaataaataaaagtctctgaaattattattatcattatgcatctgtcatgaataattaggtgtattctgtgggtattatgttttatttaaagagagttttacctgtaactaaagatattttataacaagtcataatttaagagtcataaactagctaagtagtcttagttaagtcacactctctgacccttactttcctcatctggaaaatgagtggactggtccagggtttttagcacactgttaggctttaatattctgtgattctaaaaaaaatttttttcgatcaatttttttgattgaaaaacttctatgagatgtttttacttttgcaaaccaactgagaaatatttctgatactagaaatgcacattctcttaaaagcttatttctttaaaaagtagacaataaaatatatttatgtttctttataatgaaacacctcaatttgtactgaaatgtgatgacaactatttatctactttaggtgaataaaagctgagaacaatttattagaccatggaaaagactcctgaatactagaaggtcacagcctatatgctgagctgctagcaaaacatctatgtgctccaaagctgccatttttcttccttgacaaagactccatctgccaccgagccatttacagcctccaagtcagaatatcaatgatttccaaccattctgcaagcctgctttcaccttgacatcacctttgtaatacatctacagcagatgatacatatatccccaactacaagcatgaagcccatgctttattcacctgagaggtatttaagctgctctctaaagtaccatttttattcatgctaacttgcaaaagaattttaaagtgtatatattcaattatctatacacttacatatactttcctataattccttttgctttatgtacctgaaatcaaatatattcctaaaactttaaaacctaaaatgactttagtttgacatagttttcaatggcttagaaactaagacaacagaagtacattgtatttccatttaacaatctgccacaaaattattttttataaaatattttatttccttagaaattgaaaacactaaaacaatgaagaaatattgataacatttctagttttgtactctaatcaatgttttttaacattttaaacaagtgaaacccatttacatagtaataaaataaaaccagagaatttttcaattatattttgtagaatgctaactaccaagaactattaaaaacacttcttccatccttttaaacaaaagcagtaaaatccttggctataatatccgtacaaatgaaaataaagtcttacacttttatctgaaagtaaatgttctctaccaaataaataaaaaatgaattaaggcctattatgtgcaaaatattacggggagaacaaaaaagtttaaaacaagactcatggcctcaaactgcggaaataataaatgcactcatgaacaagcatctaaaaagacaatgcactgtacagtgataggaagtgtgttacataagaaggaattttggaattagaagttagggacttaagtttacttgcatctctgccctgaaatctctaagtacttatgttaatcatttaactccagaaaaaccactaactcacctgtagttaagtgaccattataagtgatatctaaggtctttttctgctctggcactctctgataaaaggattctgtgtcaagatgtcaaatgattacacatgctacctggccccagattttacaagtcacactcgttttaggtagacatggccagtacggagaaggaaatgagattttagttgagtctccaagaatgtgcaacattaaaatatacatggagagacagaaaaagtatctcccagaaaaaggaaataccataaacaaaggtgcgaaaaacaaaatcatgacttcagatgtgtttatgtggcattgttatccacaaaaagtaagaataggagacatgatactggagacagagaaactagaaagtaaattaatatggcaatctaagcatgacctgatagggtggtggtgggagtgaaaggaaaacaaaggatgcaaaagatattgaagatagatcacaggcacttttaagttttgattatttgaagctagagaaaacagcaatctaaagtggtatcaagagttgttatcttgttgtgggaaatggtgaaaccattaacagtaataggcctgatacataatcctttttctaaaacaatacggaaagaagaatagaatacattaaagaggattgaagaaagtcacttaattttcagaaaaagaacactggactaggaattcgacaccaataccagagtctcaccgtaaactagctgtgcaatatagatcaagtcactctgaggtttggttttccaaaatgaaagtgctaaacttatgatcattttcatcattattttcagctttatatataacacattatcttaatttccccacaaacttcaagttgtagaagcaggcaatctttcaaaatcccttcttaatcttgactgatttaacattttttacacatatgaaaggctgaaaagtacaaagtactttataaacaaaaaagaagaagaaagattttcaccaaacaagtataactaataacacaactgccacaaaactaaaagcagaatcagagatttcagaattaacccggcatttctgatcctgcttcagccactagctggtcattcattaaatatcctttatgagcaactaagagtaaaccaaaagatatacagtttccatgtttaagcatatcataactttattggtgagataaaaatgaatgtatgtgaaacaaaaatggacttttaatgtagactaagccacatactaagaaaatcattacttaacatttctaacgaaagctaaaactgaactgtaatctgaaaactgtggttaacagaataaatattgtaagttttcctttaacgagaggccgtaatcaaattaaaattctataaatatttcatactgttattttttgcacaatgattcctcataatttcaagtaaaaaccttgtatctattcctatgttatgattccaaatacatgggggacttataaagtgtgtttctgaagggatgtgtaaagcaaatagagtaaaacaattttatttactaaacagaatttacagtcatgcatcacttatccacaggtatatgttctgagaaacgtgttgttaggtgattttgttgtatgaacatcacagagtgtacttacgtgaacctagatggtaaagactactacatacctaggttatattgtatagcctgttatttctaggctacaaacctgtacagcatgatactgtatggaatactgtaggcaactgtaacacaatggtgtttctaatagaaataggcctgaaatgtgaatatgaaaagtatttgtataggtaaacatatctaaacatagaaaagaaaaagtaaaattatggtattataatcttatgggacaactgtcatatatacagtctgtccttgaccaaaacatcattatgcctcctgtgacattgtattctgaaataatttgtactccaaacataatttcttcttttttttttttttctgagacggagtctcgctctgtcgccaggctggagggcagtggcgcccacctctcaggttcaagcaattcttctgcttcagcctcccgcgtagctgggactacaggcatgcacctctgcacccagctaatttttgtatttttagtagataaggggtttcaccatgctagccaggttggtctcgaattcctgacttcaggcgatccacctgcctcggcctcccaaagtgctgggcttacaggtgtgagccaccacacctggcctccaaacataagttctaaatcaataaacaatttttatagggaagtaaatttaacaaacgtaaaaaagggaaaagttaacttctagaaacttgtcttatttcttccattaaaataagtatgccaataataaataattaaaatcatataccagagcttattactcttaatttttcagtacttactattaacatatacacaactaaagatataattaaattggcaagtgctacatatgttccagtgaggtaaatttttgctctttgggaaaaatatttctatatactcatggactttgatctccaagatgacttcttgcttatgaaaaatacacctggctgggcgcggtggctcacgcctgtgattccagcactgtgggagactgaggtgggcggatcacttgaggtcaggagttcaagaccagcctggtcaatatggtgaaaccccgtctccactaaaaatgcaaaaattagctgggcatggtggcatgtgcctgtaatcccagctactggggagtctgaggcaaaagaactgcttgaactcggcaggtggaggttgcaatgagccaagattgcgccattgcacttcagcctgggtgacagaacagtgagactctgtctcaaaaagaaaagaaaaatacacctttattttatttgaagaatattatgactcaataaactttctctattttgctttaaaagctcattatcagtatgtaaaaatgatcacagtatagtacttaaaataagacaaacaaaattaattagaaatgttctgagtgttacctataaaaatacaacttcagataataatgaaccccagctctctttaaagacattaatattctctcttcattattaacattttactaaaataaaatcaattctttttccactcctcaaagcaaaatccatgttagaaaatggtctgcagctaccaggtcacttctgcaattgtctgtctgaatctttagccagtgctaaacatatctgtgtggcaaaggtttgtgatttattgctgctgtagtgatttggtaattggtccccaagttctcatacattaatgctttatttttaaatggcacattagaaaagaataattaatagaaagtaactgatccacagtatgtgtgaaattatatacagatttgctgaacacatgagcaactaactacaaatatacattaaaaacctgtttagtccagtgaatatttattgtaaacaagtttgaggggttaagttccaacactgaacagacatatgtgaataaggtagttttgaccacaaggagctcacaatcaaatatttattgattgattgatttttatttatttactttttttaaggctagtcaagcaaagtagtgggagtggagaaaaaaacaaagaaatctgtcactggttgtgaacaattaggtgtaaacaccagggctctcagatcagccacaatcaaatactttaaatggaaaattttctaagtgttcatatttttaatgaaataatagcgtatttaaatttgtatttctaataataaataaaataagagtatttctcagtaacccagaaagaacaggctgagaaatttaaatgcataccatgtgtgttagtgagtggcaatcagatcagagtgttcaatccctgtgtcacacggagatagctaccacgatggttctgaattttttgcattttaaaatttgttgaaagaatagaagcatgaggtgaactaataggaaaatgaaagccaatgaaggaagaagatcttcgctaaattcttcagttgcgtgtaactgctcaaagtttttacatggcacatcaagatgtcttttttatttcaaaaaccaatgttaagaaaaaaagtaatgataattacttttatataataaccaaagtggatacaattatgttttctgaattacgacaaaaattacaaaaacaaaccagtttatttgttgacattgaaagaacttcaaacatcagcaaacgaaagcaatctttaatatttacatgtggtacagcaaaatttaatctatgtttaataaacaaaataaaaatatcactttaaaatgtcgatatcacgatagtgaagaggcaaaagcaacccaagagtccatccacagatgaatgagtaaataaaatatggcatacacacacacacaggagtatcattcagccttaaaacgaaaggacattctggcacatgctacaacatgcatgaaacttcaaggacatgatactaagtgaaacaatccagtaacaaaaagacaaatactgtatgatctcacatatacgaggtacttacagtagtcaaaatcatagagacaggaagtaaaatggtgggtcaccaagggccaggggaaagtggtcatgaggcattattgtttaatgtgcatagacttttagttttgaaagatgaaaagaattctggagatggatggtggtgatgaccgtacaccaatgtgattgaactgtacatccccaaaggtctgactttcagtcttcttctggataaagggataaatgaggcactgttacctgtctgtgttaagtggaggagactgaggaatctaactaattgaacagactttgtatgtttaatgaatgtttaataaacatttcccattttcatatagtttttatatgtagagcttcgcctgtacctataactataaccttcttcttccctcctgcccattctagagatacacacaactgctaattgctgagcctttcggagtttcaaatgtgtaaactgttttttctaggctttcttcactgtcatctgataattcagttattcggttctctcaatctgataaatcagttactatttatctattgctctccagcttccagaattttgttggtattcattcttctcctgtttctttgcttatgcctttttgaaaatttttttttcctatataattaatggggcttcaacagttagctgaagtaagtgtgtatgttaatctaccatctttttttaggagcctattgtcctcttcctcagtctcatgaaatcctttctatgttagaaattgtcttctgtaggaagaggctggtttcatgagtaaatactatgtgcaattaacttttttgtttgtttgtttgtttaggaggagtctcactctgttgctcaggctgcagtgcagtggcccgatcttggctcaccgcaacctctgtctcctgggttcaagggatcctcccacctcagcctctctggttgctgagactacaggtacgcaccaccatgtctggctaatttttgtatttttagtagaaacagggctttcaccatgttgcccaggctggactcgaactcctgtatgtgcaattaactttaaaggtcaattttatagaaaggcttctgatcttcacctgaaattctgctatgtctgctgtttttatcatttcttttaatactcactgtatatatgaaatatttgcacaacaccacagtcttttttgatttaatccttgcatgtggtactctgcatttatttgtaactgcattttcattttaggaatctgactagatttaactttctaagagccttcctcctgcttcttggcaaacacacttaaaaatcacatcattttctctatggtcatgttgcccattccagttgtacaggcattctcatgtaccactctggtgtgtcttacttatgaaagtgtctgcttaatattatggcaaaaaagcattgtatatctatacctagggttttgaattggggaaagatctaggcacccagttgaggaccaacagaggacattatcacatgatcagagataaatcaattcctttgtttataatcatacagcccaatactcaaaaaacatagtggcaaaatttgctatgaagcctgccttcaaaacttttaacattttatcttctcaccttatgtaaacttacaaatacaaaagaaaagggatgagggaaaaaggaaggggaagaggacaacagtaacaaaatgcaacataacgctttttcactctctacttccaagagaattcaacttttccatgtgtcttaagacagatactactttattttcctataaagttggaaaacataaactgtttttacatattttttgcagcatcagcatcactgttcaaatagtgatacctatactctgcttcaaaacgcagggggcggaaatctccatagagtgaatatttttgatgtggcctttcccacccataaggatcatatcatgctttctatagtcaaaaaacattaaacatacacctctactgtgccatctaccacagctataatgaccagtttatgtgtctgtctctccagtagaagataagctcctaatgaagaaaagaagaacagtgcattttctacttttataaatttagtaagtaactcaaaaagaacataatgcttattaaatcaaggaataaatcataaccatgaatttctcttcaagataatggaagtttcttaaatatgccagcaagggcaaataatttaggggcaacacagaagaatgcaaccaaaaatataaattcatacacagcataaagaatttataataatgctttaataccatttatgtactagtgtcctccataaaaatctccactaggagaaaagctgaatatgaaacagtctcaaattaaacatggtggtggagggattattaaaatcaaccaaccaaaaaaatcttccaggctagccatggtggctcatgcctgtaatcccagcacttggagtcaaaggctgagataagaggactgcttgagcccaggagttcaagaccagcctcagcaacatactgagaccctgtctgtatttaatttaaaaaactaaaatcaaatgaaacatcttccagtggcttctcttcacattagaaagaagcttaaactttttttttaaatgatatctgcctacctttattcccacagctcactacattccagcctcactggcactgtgatcactataacctctgattttcacaacacgacacctggctctttctggtgattcatttctcaacacaagtgttacctcatcagggagaccttccctgactgttatatgtatgttgccctcaattctacctgactacctgtatatgctatcacattttccttcctccatccctgtttggagctcttatcaataattgagaatattttacttatatatttgtttacttctccccagtagaaagtaaacttaatgacagaagaaacttcatcttattgaccacagtaaccccaatatctagacagtggaaacacacaagcagcactccataaattatttgtagaatgaataaatgagtgaatgagtgacagtatgtgaagcatacaatataatgactaaatgaataaatggctaaaaattcctacctaggaatgtgctgtcaggcagaatctttgagaccaaacaactttccatctgatagctttcttcatgtctctttccttactgaatatcaatactacaactgaggtacacaaaaataaagataattaaatgagagagattggcagtatataagtgggttgaagaatgtgtctcataagatcacctcagggcacacactagctgattctagaattcttttctttcataatcctgtttctgtcattcaatcaactagcaagtatgcactgaggatgatgttttctatttctaaatatccatactaaggtctcttgaacacaagttagttttatatcctttgagagtattgtagtaaaaacagcatggtcttcagttagtgaaatatgaatttgaatcttagttacaaccagtactagttatgtcaactaggagcagttacttaatttcactaagtctaagacaaaacgatacttggaaactatctggtatataagtaccttcattgttagttctcccttagagagcaggaactgaaaagtagaagaaatcataagaatagatcaaacctatctttattctaatgttcactgttgaaaactgtggttcacctgtttactgagaagcaacaagtcacaagcagagctaacaaaattaatgtaaatgtgactacatttgcaaagggtaaaatcacatctctcaacatagtaggcattcatctgctgaaataataataacatcaggtcacagaaacttcagcctttaaattttttacacatttcctagatttgtatttctaagaaatggggtgatacagatgttagatccaaacattcctggattatgacctttgttttactgcttaatcactgtatgaccttgagagagttatttaacttctataagcctcaattaaaatcgggttgttgataatttaaacatacttcaaacatttcccattgctctagggtaaacaaacaaaagcccttattattattattattattattattattattgttttgagatggagtctcgctccgttgcccaggctggagtgtagtggcatgatctcagctcactgcaacctctgtctcttgtgtcaagtgattctcctgcctcagactccagagtagctgggatttcaggtgcccaccaccatccctggctaattttttgtatttttagtagagacggggtttcaccatgttggccaggctggtctcaaactcctgacctcaggcgatctgcccacctcagcctcccaaagtgctgtgattacaggtgtgagccactgcggccagccaaaagtccttgttattaaacaaacagaagttctcattatggtctactatgtcctgtattttctggttgcttatctcaaactgcaatccttgctctctgtactccagtcatactggcttttagttctttccttcaaagtgctacgttcccttcctatttatctgagtagtaacctttactggagttctttttttcttcatatgcctttaagttactgtccaggttcctctcatttcagcctgaagatctcccattagggcatttcttataggcaggtttactagcaacaaattccctatctaaaatatgctcaaagagcaaaaggaaacccatagacaaaagaatgaaaggaaaccaggaaaacaatgtatgaacaaaatgagaatatcaataaagaaacagaaattttaaaaaggaaccaaatagaaattacagagctaaaagttatgatagctaaaatgaaaaattcactagagggattaacagcagatatgagtaggcagaagaaaagaaccagtaaacttgaagataggtcaactgagattattcagtctaaggaacaggaagaaaacagaatgaacaaaagtgaacagagcctatggaacctgtaagacaacattaagtggaccaatatgcattatggatatgccaaaaggagaagaaagagagaaaggagtagaaacaatgtttgaaaaaatagtggatggaaacttcccaaatttgaagaaagacatgaatctacatatccatatccacaagctaaatgaacttcaagtaggataaattcaaagagatccacacaaagacacattataatcagctattgaaagccacagagaaaatcttgaaggcagcaagagaaaggcaacttgttatgttcttatgtacaaggaatcttcaataagattaataagccaggtgtgccggtacatgcctgtagtcctagctattcaggaggctgaggtgggaggattgcttgaacccaggagttcatggctgccatgagctatgatcataccactgcaatccagcccaggcaagagagtaagatcctgtctctaaaaataaaaataaaaataaagaagtatgagtaagattaacagctgatttgtcatctgaaagcataaaggcaagaaggcagtagaaaaacaaatctgaagtgcttaaaaataaaaaaatccaaagaactattaaccaagaattctataatatatccagcaaaactatattttgaaaataaaacagaaattaagaccttcccaggaaaatgaaataaataagattaatattaaaagcacctagcatcatagtaaaaagagaagaagtgcagcataacaataaagacacaggctccatgtcaaatgcctgggtttgaatcctaaacttcactgattgccatgtaactctgggaaaattccttaacttccccatagctcagttttcccacctgtaaagtaagaataataatgatacctccccctcacaaagttgttcggaggatgaaataaattaaagctataaactcatgacagggtgcctggcacatattaatcactgaaatgttgactattacttattattatcattatcattttatagaggttctaaaaattttagttcttatttccttgaatttcccatatttctgtgaaacaaacactgactattgaggaggtatgatacaataataatctttttgtttgcagaagtatgaattggtaaaataataaaaatttattttaggtatgataatgctattaggctaaatgttctatcacctcctttagcaaatcctttattatcagagacactgagtaaaataagtgataatgaatatactttttttttctctctcaagctttgcctctgagatgcttatccttttgtggtatggacttatgctttttatataaacaaatagccccacattattatcatacctaaaatcttaacaattctttttttttttttttttttgagatggagtctcgctcttttgccaggctggagtgcagtggtgtgatcaaggctcattgcaacctctgcctcctgggttcaagggattctcctgccttagcctcctgagtagctgcaactacaggcacacgccaccacacccagctaatttttgtatttttagtagagacgaggttttgccatgttggccaggctggtcttgatcccttgacctcatgatccacctaccttggcctcccaaagtgctgggattacaggcatgcgccaccgcgcctggccaacaattctttcatatcaaacactcagtcgatgtacacatttctttgtcttatatttttaaattgcctgtttgtttgaatctggactcaaataaaatccatatattggatctggctgatatgactcaagtctcttttaatctctaaatgctctagccaatcttttctttttccttccttattatttttagctaaagaaactaggtccttttccttttagagttttccacagtctggattttcctgactctgtccccctggtgtaatttaacatgtccttctctcctttttatttcctgtaaattaggcttgatcatatttagttttttttttcctttggctggacagcctcataggggaggtacatacttttgttagcaagtacataatttctttcttatgtaaaacagtgataataatggtgtctaactcttagagttaagaggattaatttactacaggtcaaaagtttagattagtacctggcgcacagtgagcactccactaacattagctcttattgttacaatgcatatagagaatcaataggatttgataccagcttagatgtgaatttgtgaagaagctgaagataactaatatttctaccttgagcggctaagtagatgttgatatcattgactaatacagggaatatataaagaggagaaggtttctggaaaattagaagaaaatgagttcaagtttgaacaggttgaattacatgtctgtgggataaccaggtaccaatcctatatagagagctgcaaatggaggttctgcaatttaaaagagaggtctggggagctacagataaagatcaaatgttgggcggaaagggaacttaatgaaggtcacatttatcactaaagactacaagacctctttgaagaatggattggcattgggtaaggagaggtagtggcacttcgagaaaaggaaatatgtggaaaaaaacattccgacaaaatcgtcagtatatttgtcgctaaaggagtgctttgactataaaagaatgtgtgttggaaacagagggaaattaatttatgtagatagggacaaggctacatttaaatggctttgaaattcaggaataggtaattcaatttaagtaggaaataagacactgaaaaagttagcaagacagctgaattctgctgtggcaacattatacaaaaagctatcataacagaatctgaaaagtaaaatgtacttgctatattattcgagaggattttaatttatgccagttttatttccactgaagttaaaaggaatgttgtctaggcactgtaactttaggcaatagcccaaaggtggaagatgttatctttagtaccttcccatatcacttcccagtcccttctcctgcctctccacttccctgatgaaccagtgttctcaatctgctctaatataaaaaactacatttttgcaatgatgcaatgtcttgttccctgaagcactctggttacatctccttgcttagttctaccctgccaggaaatcattcattctctgtcgccactctacagatctcagctaagaaaaagacaaaaactgattatctaattaaggtagtgcatacaacactgtaagtgatcaaaatcctaggagatatttaatttcaaaaagaggaatctattaacacctatgaatttcaagttgttaaaatatatactatctctctgttttctatactatacattccagttacacactaaaaggcaaaaaatgtcactaattttccttatattacactttgcacaccagcaaagccaagtttgttgcatagatatttactgggtcactactaggaaaaagtactgagacagactctaatgaaactgcaaggatgaataaaatataatctatgcctttactagattataaggagtttacagtctaataggtaaaacaactgaacacataatcatcacgtaaggatctaaggactctgtaacgtttctgaaacttaacctatgtataaaccccttatgaagacagaaaaaaggttttgtgaaacaccctccaccgactgacttattatattgttactgaaatatagaaaaatacaactacggataaggataaactattcctcttgcttccagatcttatttcaaatacaataccaaaacaatttccaaatatgcacataaaagctatgaatagcacatttcaagttagtatcatacaatgtttttgtgaaaatgaatcattatagtcaacataaaaatggtactgactgctatttctccattatttttcagttacattttggtttgacatgcctatagtctagtgatatggtttggctgcgtccctgtccaaatctcatcttgaattgtacctcacacaattcccacgtcatgggaggaacccagtgggaggtgactgaattacgggggcgggtccttcgtgcgatgttcttgtgatagtgaatgagtcttatgatatctgatggttttaaaaacgggagtttccttgcacaagctttctctctctgcctgccaccatccatgtgagacgtgactccttcaccatgattctgaggtctccccagccacgtggaactgtaagtccaataaacctctttcttttgtaaattgcccagtctcgggtaatcagcagcgtgaaaatggactaatacatctagtatgccctaaatggtttaatatcatttgtttctactcaaatgactgcaaaacttttagttcactctgatgtcatcaggctttcacttaatacaagtgaaccatttacaatattaaatctatttttgttcttttctcattagactaacataattaaacataatcatagccctgaaaatacatggtagtaactggttgtaaggtaggcatggcataccacatgatctaagaatatgctcatactgatttattttatattaacattgaaattttagccctctttctccctgtggagaatatatttgcacactcaggtccatgtacccctgtgttgaagtaaattgccataacagaaataacaaatctgaaaggcagaaatgatagggagattaattccaaatgaaaaggatccaaaggttttatggaggaggtaacatttgaaatgaactgtgacatttgagtttagtgccaagtgtctacgttttctgaaatttcctttccataaagatgacactgaaaatataaagctactagagtttagaaaaaaagacacacaggaaatattcagtggtaaggggagtgaggagacaaaaatcgtaaattttatgaacaaaagttgaggggtttctcttgaggagaaagaaaatcagagaataaaattgcaagcatgagatgtgctatttgcaaaataaacagcatactttgcatgttgtaaagtttacacatactatcttacattctgatgcaaatgtagctatggatgtaatgttttaaaaatgcatttaaaaatgcattcacataaggacagcttcaggaatatttgtattagttaaacttttttaacattcatgactcgcaaacttttgatgctatacaacaaaaaaaattttccatttttgtcaaaattctttctcctccatggttttttctgtgtatatttatataaaaagaacaaagaggtcaaatatcataaacccataactcagtgtacaacacccattttctcatctctagtttctgcagactacagttatattttatccactccctgactagcatttcttatatctcacagcagaagtgtgcattggtgttctacaaagtgtgagtggaagaaaacaatttactagccatattaaatttcaagtcaccttaattcaggaaatatttacctagtctatatgctagacactgctgattacaataagaaaacatcaaaccacagcagaaaactggtttttattttatattctctgatgtttccataattattcctagatctgtaaaagtttctttttttaagacagatttattaaacagtagctcatttagaattttctgataaatcagaatctatctttaaatcaagggattgtgtaacattacacattttgacttgttcaaaagaagctaaacttatatctgtgcagcatggtgttatttatatatgcagccactcatacagagaacatcatgcatgcttttagctccattaattgttaaatgttaaaacagtacaacttctgagaaaatgcagtagaggtaaagagagggtttctttcatccaaatatacatttaggaatagcaatgggaaatagatttacatgaagtaactgaaatggctgctacatactaattttgaagatactgttcaaaatattcagactctagaaaacaaaatgtttaggatgtattttataacgttactgtactacattttaaaattttaacacctttagatttgtcacttgctataaaatatggaaattcttaaaaagattttcacttccagttttatcactgttattatattttactaaagatattttaaaattgactataactctacttttggtattagaaaagtgaaaaataaaggtcagatagtacatagtaaacttgttctggaaatgactattttttgcacttttcagataatgacttaactatcacttacaacacactaggaaagatatttgacctttccaagtctcagtttgggcatctgtagaatgtaatgatatatcttttaaaattgttaaagtttcaaataagtacctagcatcttaaaaaatcagtggataaataaatattagctttgttcttcattcctcaacacatgtatcaaaatatattatcaaaattaaaaatatttaatgatagtcaagtacagtggctcacacctgtaacttccatgctttgggaggcctaggtggaaggattgcttgaggccaggagtttgaggttccagtgagctatgattgtgccactgtagtccagcctgggtgactgagcaagaccctgtttctaaaaataaaaacataaccaaagaaaaaccccactaaaatttaatggaaaagcaataaataatattaaatttacattaaaataactcatcactaggtatctagcacttaccaaagtttttagtttataaattcctataagagctgaacattaggctcatttacttcctcaaatgttatatttcaacaacgttaaactaaggccgggcgcggtggctcacgcctgtaatcccagcacttatgggaggccgaggcaggcagattagttgaggtcaagagttcgagaccagcctaagcaacatggcgaaacctcatctctactaaaaatagaaaaattagccaggcatggtggcatgtgcctgaaaccccagctactcaggaggctgaggcaggagaactgcttgaacctgggaggcggaggctgcagtgagccgagattgcaccactgcactccagcctgggcaacagaacgagactctgtctcaaaaacaaacaaacaaacaaacaactaaaactaaaacatttacatgtctctgaacatatgttctttcaagtctatatgcctatttcctctttctagactctcttctacattatacttcaaagtctagaccacgtgtctcactcctctgcaaacgtttcttgatcccctgtgctagacagaatgaatcatttccctttccattcttctcctaaaacttccagagctgtctcatcttttggcttccccgggctacactggatgaagagggattgtgttgaaccacacataaaatacagtaacacgaacgatagctgatgagctaaaaaacaaaaatcacaaaaaaaatctcataatgttttgataaagtttccaaatttgtgttaggatgcactgatagctgtcctgggctgcatgtggcccacaggccacaggttggacaagcttgacttaaaccatggagacagtagagttcaaataaaacaagtgagatgtttaaaaaaaaaaaaaaaagacattttcacactggcataaacttttttctttctttttttttttttttttgatacagagtcttgctgtgtagcccaggctggagtgcagtggtgcaatctcagctcactgcaacctccgcctcccgagttcaagcaattctcctgcctcagcctcctgagtagctggaactacaggcatgtgccaccacgcctggcgaatttttgtatttttagtagagatggggttttgccatgtcggccaagctggtctcaaaactccagacaagtgatctgcccacctctgcctgatccacccacctcagcctcccaaagtcctgggattaaaaaaggcgtgagccaccgcatccggccacaatggcataaacattcttcatcaagctagcttggtgtatcaggattagttttggccaggagtgacagaaagcccaaaagtgaatggctcatacaatacagaattttatctctgtcatgtcaaagaaatccagggataggcaggccagtagggacagtgtaacatcatgttagtaaggattttctttcttactgctgctttacccattctcagtatagggtttccactcacagtccaattatgctcacaattcagccagcaaggaggaagggggcgaaaaagaggatgtgcacccattcctttaaggatacatcctgaaagttgcacacactacttctgcctatatatctcttgccaaaatttagccagattactatacctagctgcaagggagactggggaaatgatgtttttattctaggtagtgatataccggaaaaaaaattagaagagggggaaaaccagtattagggacaactatcaatcatgccatacttggttatatcttctctgtggtaggtacctgacattttaaatttactagctaacaccagtatttctgacagtatgtacactataaagttatacagcaattccttctacatctcaattattaagtattactattgggagaggtgtatctctacaaaatttaagtaatattcataataaaattaccaaagagaaaaatagaaaaaaaaatttttttgaggcaaggtcttcctctgtagcctaggctggagtacaatggtacaatcttggcttactgcagccttgaactcctggactcaagcaatccttccacctcagcttcccgagtagctgggactacaggcttgagccaccatgcctagctgattttgtttattattttgtagagacaaagtctcactatattgcccaggttggtctttaactccagggctcaagcaatcccccctgttgggctcccaaagtgctggtattacaggagtgagagccactgtgcccaggcaagaaattttaataaaaacagaaaaagccactttatttaaaaggttgccggccgggcacggtggctcacgcctataatcccagcactttgggaggccgaggtgggcggatcacgaagtcaggagatcaaaaccatcctggctaacatggtgaaaccccgtctctactaaaaatacaaaaaattagctgggcgtggtggcggaaacctgtagtcccacctactcaggaggctgaggcaggagaatggtgtgaacccgggaggtgaacctggcagtgggccaagactacaccactgcactccagcctgggtgacagtgagactcagactcaaaaaaaaaaaaaaaaaaaaaaaagttgccttaggacagattattaaatatacagtaaaatattaaataagaatatctgaagataaaatatagccactataataatgaaattacatataaacaagactgcatgtaaatgcaactgcaaaaatacgctcagagaagacagaggattaagggagatttaagaaaataacctctgaattattttattatactttctataaatgctatttagacacctttaatcaagtaagaactgatcacaaaacagaacagtaaaaattctaacaggataaagcaaagtcaggttagtccaagttctcaaatcatgtaattttagacaagtaactttacagatattgatgagtatgatgagggtaagaaaagtgtagtatgtgccatcttttgtgctaagtgctttatgagcaatgtttatttaatattccagacataataatattatccctactctagaaaagaaaaaattgggtcttagactaagaaactgactcatgatcacatcagctacagaagtagcagaacacaaactaaaacaaaggtttttctaaccccaagtccatgtccttaactattatgtgcactactttcccacaaactctctagaccttggttttctcgcccattacctaaggggaatgcagagtactctaaactattctatagttcattttggttttttaagatgttgccattctagttctctgactcccttttcctcaaataaaagaacattatattaataggtccaattggcctccttgctgaaacttgctgaaagtcaataaagttatcactaatatacataatgtagaaatctatttattaaaacagacaaaatggccacaatttgtaagtaaggtaaatttgaatgtttaggatatatcactgaactttatagtagatttcacgcccattggtgttatctgtaaaggagtaagccataaaattctatcacgaagagggaggaaagctaataaaaattgaatttaaatttcataatccttttaaattcaaataatgcatcgttttataggtgaagatactgaggcacaaagaggctgacttgctagaagtcacatcgctagtacacagtgacgttagtacttgaactctataggttctaaaatctaagctcttttctatccaccctgcttcctgtggttaaattatattaatgtattaatatccttatttcaattttaatataagaacactaaagatactaattgatttagcactttctggtttattatgattgccaacaaacatttgctgagtatcgtaagatgtgtattaaaataagtaccctaaatacaattatgttatcagtaaccctggagtaataaaaattaagcattaccaaactattaggaacagagaacaaggatgattagggaaaacctcagggagatgattatatgtggatatggtattagagagacagtttgatttcaccagaagaaatttttttaagtgtgaaaagaaaaagaatattctaggtaaagggaatagcatgaatgtaagtgtggagccaaaatgtgtatccaaggtagggaatgtagtccacattaggtagagtgtacagttcttattcttgagtaatagaaaatatgctgaagacagcctgggcacagttgttcactcctataatccctgcactttgagaggccaaggcgggtagatcacttgaggtcaggagttcgaggccagcctggccaacatgataaaaccctgtctctactaaaaatacaaaaattagctgggcctggtggcacctgcttgtaatcccagctacttggaaggctgaggcaggagaatcacctgaacccaggaggcagaggctgcagtgagccaagattgcaccactgcactccagcctgggcaagagtgagactctgtctcaaaaaaaaaaaaaaaaaaaaaaaagaaaagaaagaaagaaaagaaaatatgctgaagacaaactgaggaaggatcttaaataccaagttagaaggtctggatttgatcacataggaaatgagaagccaccacacattttcaagtagagaaataaaaggaaccgagcaatgctttaatcagatcaaactgggagttgtgtacaagtttcagtggaattgataatggccaggaagaagggagatcagttaaaaggttttgacatttatatggattgtgacatcaaagaaaaaaacagcaattctcctgacttctgaaaattttgattaaaacatatataaagtatatattacataatatataaatagctactacacttcagctctgaaacaacccataatataatctccctctctaaccataacattttacttttagttcttactatgtcatctcattataccagtttatggatctatgactagtctcctgatctctctacttcctttggataaatcagccctttcctggcctcattttattccagccacacggtaaacatatatttgaactactctctcactagcactctgaacctgaatcaatgttgaaatctaccctcttttcttaactcaaagggccagcaaaagcctcacaacagtgtcataacaaacttaaggtttctaatatcagtcacttatgaacctctcaaatgaacacttcttactctttaactgatatttaacatctaataatattaaatatcacctctcttcctgaaattcttggatttagatcagttgcaattaattactctcttaatgttaccctaaaaataaactgtgggaaaaaaaatttaaataaaaataagctgtgggagtcagcatttttaaattttaaaaaaggtttcatttaatgctaatgttaacttccttgattgtaaagcactagatgctaaacagaaggtttctatagaaatatgtcaatattttattataaaatattcagttagggcaataaagttctaattaagaaaaaataaacaaggaaagagctacaaatcaaagaaagctaaaatgctgcctcaggaaaatgaataaaatatgctataagcattagtagacaaaattatgatgataaagcctttaaaaataaataaaatttctctctagtctctgcaaaatgttaaacttaacaaatgaaccagttttcaaaaaaaaaagattgaacataaataaaaacattattgatatgtgaatttatacttctaataattaatgcttctggatttaatgagttaaattaaaacagttgaagaagcaggatcatggagtaaataatttggtagaaatttatttatctgttatttaagagaatttttcaaaaatgatataaagttcatgattgtaattcagattttatcacttagaattttctaatgtggataaaggccctggaaaagtttttctttaggtaatatatgtccttacacacaacagaaattaacacttaaaataaaattaaaaagtatcagttacttaagagaaccatccttttatcaaaaaactctccatatctggaagactctataaatcctataaatatcaataaaaaatttaagcaagatgcctaaaaactctaccaaggctatatatatgtggtatgtggtgtatgtggggggtgtgtgtgtgtgtgtgtgtattttttttttttttttttttagagatggagtctctctattgcccaggttggagggcagtggcacaatctcagctcactgcaacctccacctcccgggttcaagtgattctcctgcttcagcctcccgagtagctgggattacaggtgtgtgccaccatgcccagctatttttgtatttttagtagagtcggggttttaccatgttggccaggctagtctcgaactcctgacctcagctgatccacccacctcggcctcccaaagtgctgggattacaggcgtgagccaccgcgcccagcctaccaaggctacattttcataatctttccttaataattcattacaatctcaagtaatttacttttatatatatttcctaatgtggaatcaccttaacctttctgtcattttctggtaaaaataaaaactcaaaaaagatgacgttcagaatttaagtcacactgaaataatttagtatatttaggcctgtaatttcagttgtaaattaaaagtaattttcattttaaatgttttttaaatcctttaaagtaatattttaaaagtatttaaataactagctagaagtataagatatgattcatttaaaatgttaacattcaactggctagcaaaagaaataataatttcaaattatatatgttttctaagtcaattctcattctcagagaaaaccaaacttccttaaaagcttaactatcattttggtcttactgtgatcaatgtggtcaatcttgtgacatcactgttgggaaacctgcaataggaaaacaagaattagcaatcagctgaagcatacttaagaaatttcagaaactaaaaagtttgtttaaaatttgtgtctttcttcatgctgtaagtcatattgaaattaacctacggtatcagggtccatataatcagtatgacaaaaataagcataaaaggactggagtttatttatagatcattatttattatagtatggcagatcatgtttttgtttataatcaccaacaccctagggtgaacataacatattaaaaaacaagctgtaggacatttgggttacaagttttatttgtcttcaaattacgtactcagaagagaaaaacaatgtcttaaatacgtcacaaactgaagacaattaggtattatttataaatacttttctgtctatgattatcagtacagattagaaccaaaatgtcatctacttaatactggagacattaccacatgctaatatttatgaatagcgacaaaattatcaaaagattgaaaatatcactgggaagaatttagaacaggaaaaaactatttcctaaactgtaaatggcttcaagtttatccctgtgaaatcttaatttttggaattttttgttgttttttcgagacagagtctcaatctcacccaggctggagtgcagtggcgcgatcgtggctcactgcaacctctgcctcttgggttcaagcgatttttgtgcctcagcctcctgtgcagatgggactacaagtgtgcaccaccacacccagctaactttttgtattttttgtagagacagtgtttcgctatgttggccagcctgttctcaaactcctggcctcaagtgatccacctactttgacctcccaaagtgctgggattacaggcatgagccaccggacctagcctggaaatttctttattaacaaggtctaatttgagatgagcccttaaatgtttagtatcaaaaagtaacacatggttatggcattttaaggttcataatggactttcatgtattattttatcaggtcctcataacgaatccttcaaaggggcaggaaagagatattccttattatagactccaggaaaacagaatttagaaatgatacatgacttgtctaagcacaaagaactgaatttttcctggtttctcttttacctcagacctttcacctagtctgtcctaccaactactcttcgtcactctatccttaattttaccttactacttcatgattactggctctcctatgttaccattatagcctccctacttctattctttttttttttttttccctgcctcagcctcctgagtagctggggactacaggtgtgtgtcactacacctggctaattaattttttttttttttttttgagatacggggtctcaccatgttgcccaggctggtctcaaactcccggtctcaagtacctacctctgttcttaaagcaagttaatcagatcacatcattcccttactcaaaattgtacaatggctttagcagctcttagaataaaacccacaatacttattatcatgacctcttaggccctctgttacctggtgccctgactgcatttcctgcttctaccatgttccagtcacaatcacccttttgataatccccaaacatatcaaatttgttccacttcagggccttgacacttgctcttccctctgcctggagcaattgttctccatatcttcataggactggttttctcacttcaatcgggtctcataacaaacgccacctccttagagaggccttcctttaccaccagaggctgctgttagctttaactccatgaaggaagatcactggagcacaagtttagtacctggaacccaatagctaattagctactgaatgaatgagtgaacaagtatttatcaagttcctactgcatccagcattatgtcaagagctacaaaggatccaaaagaaagtttaaataaaaactcttcaagaattactatctatttaaagaaaatatgccataacaacttggtatacgtttttaagtcactgcaagaagcatttgggaagcttaaaaaaaaaagcaaggcagggggtgatgggaaagcgcgggtagtgaattaaaggtgtatgataatgagggtctggatagtgaagaagaggaaatgcagagggaatgggaaacccaaatcttaaatggtgaaaccagaaggcttcatgctaaactaagtattaggaacaaggatagcaaaaaagtgaaagattacttcaaagattctcactcacataatgaaagaaatctgaagtggcagggtggggtgacttttatttagaacaataggacaggccagtgtcaccataggccattcaaatgaagacgcttcccaccagcaggtagaaatttatttatttatttatttattttttgagatggaattttgctcttgttgcccaggctggagtgcaatggcgcgatctcagctcaccgcaacctccacctcccaggttcaagcaattctcccgcctcagccttccgagtagctgggattacaggcatgcgccaccatgcctggctaattttttttgtatttttagtagagacggggtttctccctgttggtcaggctggtcttgaactcctgacctcaggtgatccgcctacctcggcctcccaaagtgctgagattacaggcgtgagccactgtgcccggctccagcaggtagaaatttagaagagttcaagatttgaaaatcagttatataaaagtacagttcaagccaagactgtgggcaagttcaccaagggaatatgaagaaaaaaacagaacagccagcataatttggcagagacctataagtagggcccatgggaaataagagaagtggaattgcagggttttttgttttgtttaagttcaagaagtagagacatagaaaatacaatgaataaaggcacatgaagaaagatttccaaagaggaaaacatgttgaacagttttagaggggtaaaagtgttaagatgggtaaaagaagataagacaggaaacattctctctaaactaaccttctctaccccatcataccaaattagatcagaaggtagctacataggccaggcgcgggtggttcatgcctgtaatcccagcactttgggaggctgaggcaagcagattgcttgagcccatgagttcaaaaccagcctgggcaacatggtgaaaccctatctctacaaaaaatagaaaaattggcaagacatggtggcacacgcctgtagtcccgccaagctactcatgaggctgaggtaggaggatcacctgagcccaaggaggtcaaggctgcagtgagctctgatcgtactactgcactctatcttgggtgaaggagtaaccctgttaaaaaaaaaaaagaaggtggccacggagataaaacacattactctctctgtatccaaaaaactgctttcaaggacctacctgcctaacattaagctctcaactttaatcaatgcaaaaatagtcttttgatggtaacagagtcaatacaagaagtcttgtgaaggaaaaaactacttctataaaaccctgtgatacaaaacaggtattaaaactattgtaaatagtcacattctaactatgcatatctgaataaaagataaattccattttacttttgattttttggaaaaattataagttaaggatagatctacagttaaaaatatacagtttacttaaagcactaaagctcataggataaaaaaactagtaaaggcattccttcctcatggtagcaatttttatacatgacttaataggtacttgcaattgcatgaggaaaaaaatatgtgaaattaaaatgacactagaggataaagccagactaatcttaaagctgctcataaaaatcctaagtggcttttacaagcaaaaggtaattctttcaaatcatttcaaagctaagaaatgtattcaaattacacatataaaaagtaatgttacattttatgaaaacataattcaactaatgtattggttatatgctatttctctgcaagtcactgttttagtaaatatgcacagacaaaaatctcaataatattaacccccagaaaacatctacaaatgttacctaactaccaatgtgggaaaagaattttaagtcatgatatgcaatcctatgagtattttttcagcaatcagcacgtactatctttatttttcctcatgctctgccccaaaacaaagtctttctttatgtactcaattttaacatactcatgtcttaacctttccttgactatactacatacctacaaactaaagatatttatccatacctacttcaataaaaagagtcaatgaaataaatgaatagaatacctatctgctttttctcactttgctcaatcttaacacagaagtaatgctgattaatcctgaaatttgtctgtaatcatcacaaaatatttaatcattcatttatatatcagtttgattttgtgtgtgctctatgctcttttcaaggtatggttatacaataaaaaaattattttcaaaatttacatgtgaaaaataatctcacaaatcatgtgctatttgtagactgtatcagtgttgttatcttggattatggaccatggacatggagaagttaaggactgtcattctctttttaaagtgtcaactgtacatattttggcatttatttttaaggtttataaagcaacttttttttttttttcgagacagagtcttgctctgtcacccaggctagagtgcagtggtgcgatctctgcctcagcctcctgagtagctaggactacaggcgcccaccaccacgcccagctaatttttgtacttttagtagagacgggatttcaccatcttggccaaagctggtctcgaactcctgacctcatgatccacccgccttggcctcccaaagtgctgagattacaggcatgagccaccgcacccggctaaaaccctaacttgctaatcatttcaaatactgacttcttaaatttgaagattattattcagtatggaaaaaaaatcacagacttaggatataagcaatacttttttggcaggaggggaggatacttgaaaataatagaaaactatatactgggaaactggtgacaatgtgatctatccagtgttgtgcaacagaactttctacaatgatgggaatgttcagtgtctatgctgtccaatatatacctgctatgatttggatatggtttgtttgtacccaccaaatctcatgttgaaattttatccccagtgtgatattgcaggaaagtgggacataaggtagggtgtttgggtcatgggggtggatccctcatgaatggcctggtgctgttctggtagtaatgagtgagttcttgctcaaagacttgattggttctctagggaatggattagttcctgtgagaatgagttgttataaagccaagacacctttgggtttggtccctctcacccatgccagctttccctttgaccttctccaccatattttgatgcagccctcaccagaagctgagctgatgacagcaccatgcctcttgtacagcctgcagaactgttagcttaataaacctcttttctttataaactacacagctttaagtattcctttagagcaacacaaaatagactaagacagtagcctataaccaaatgtggttactgagcacttgtaatatggctggtgttactaaggaaccaacttgtaaatattatttagttttaattactcaaatgtaaatagccacatgtggcttatggctaccatatcagatgctactactatgtatttcagaaaccatagctggactgaactgtaaatggtgttcctaaatatttgaaaaattattttctccattttttataactggaaaaagaaaacctcaattctatttggtaggatatgtacatttcaataaaactgctccaaattgggaggagaggaattcttatatcttcaaatgtctttcaagtttatgtttggggaaacaggtttattttaccatagaatctttaacgtataatagagcttaggaaacgaatcttggattttggagaactgagttttaaacctcttcagattgcatcattatggcttggtatttaaaagctgcaatttgctttactttggtcagctgggcagaattgctttactttgttttctcatgtactattatgactaaaactaaatttacatttccataaattactaagaggtatcaataattacaccatcctttctggaaaaattggcattctatcaaaatgcattacattcttcatttgcatcacttgtctttattgttctgtgtgactgaaacttctctaaaaaaaggtataattcccataggttgaatcacaaaattttcagacagctaacaaaagccttattacatgaagtttagcgagacctgagatgacaacttcattgttttgcttgtgataaaaaaccatggaaacaaagcataactggctattagacttggtaaatttaaaaaacacacacacacataagctgcctgtttttccacactttaccactctattctttcaacactgcttagcacttcgcaacatctttactcattccctcttaagtttccattttagagccataaatgggcttccagtagaggaaggaggtagtagcactgccaactgctattgaaacattcttgaggttaatgtatatacacaatatccaaaagtgaaccaatcacttgggtgaagtaatacaatgaagtttcatttgagaaaaattatgtgttgttttagttatatatacttttatttatctaactacaagtttttagggaattcaattcaaattgtagcaacccacagtgagctttgggttaaacctttaggaattaagttaaagcacattgcctgattatagaaatttttagttttttataccaaaattagagtccattttggtcctgtccacaaatgccaaattgacagataatttgaccctcgcaagattgctttttttaaaaaaatcactcaaataagccagcaatcaagacaaacataaggtaacagtttcataaagttttcaagcaccatagctaaagaacagacatgatgctattccaacccacaccttcaaaaatcaatttcagactatggctgtgaagactggaaaaataatcatgcaatctaataatacagcggtcaaagaaatatttagttaggtcaaataactaaagttatcattactaataaatacaaagtttcagaaaatttgtattttactgtttttattcaaagaacattgctatgaatatttagagaaattaaatgattactgctcttggtttttcctagaacatagaataatttcatcacaaacaaaaaatttggtctaatgttttcaacagggactacataatcctggtccttactcagaattttggcatatattcattatgtaccttaggcaatctatcagtatttcttcagtttgcaataccataattatcgacttcacaagggatattgtgaagtttagttaattatgtttataacattttttgagggtcacagatgaaagaggagtgtaaggcatacatacaattaatttatagtacttggtgaaaaaatgccacttaaaaatatttaacagcaacaacatggatgaaccttaaagacattatatgttaagtaaaataagccagtcacaaaaggacaaatacaatatgattctacacatatgtggtacccagaatagtcaaattcatagagacagaaagtaaaatgataattgccagggactaggggaaggaggagtggaagttcttatttaatgggtacagagtttcggatttggaagatgaaaaaaagtaatggttgtacaacaatatgaatgaatatacttaatgccactgaatacactttaaaatggctaaaatggtaaatttaatgttatatatattttaccacaataaaatcacaagtgtgaaaatcagaatatgaatcacaagccaattttaacattctctgattcactcattaagacatgaatcgaataattcttttgttcattcagtaaatatttatcaaatgatttctatgtggcaggtactgtgttagacctgggagtatagcactgaacaagacaaagtctccgcttcatagaatttacattttagcagtagagacctacaaaatcatttttgcaaactatccttcttatagtgataagtactacactgaagggtaaagagatgaaatgacagcaaggaggtatctctgagaagataattaccctgagaatgaagtaaaaaggaacattccagatagaacagaagtgccaaggccctgagttgagaaggcctggtgttttcaaaaaatgacaagaatgcccagggctagtgcagagtaagatagggggtaggagagcaaggcagagaccacagagggcctggaaagcaacagtaaatactctagatgttattctacatgtgctgaaagccatatgggatgttatgactaagtgaatgatgtgatttgatttaaaaaaacaacaacactctagccactgtatatggaatgatcttggggatatgggagagaaaggagaatcaaaacacagtgaccagttgagcaactgtagtaactcaggtagaaataagaagactatcacggtagccatattggtggtgaaaaaagtgattatttttgatatttgattgctgatgactaaacaagaaaaaaaacagaataattaaggatgattccaaggttttggtcagatcaactgggtaaatgacattgccaaattttgagataaagaacaatgggataggaataggattgctggtggtggtagtggtaatagtagtaaggaaccaagagtgtgatcttgacaaagttaagtactcaagtaaagagtttcaggaaagataacatgacaaactgtgacaaatgctgccgggaaaacaacatgaggactgagaaatgaccactggatttagcaagataaattactttattttttgaggcagagtctcactctgtcacccaggctggagtgaagtggtacgatcttggctcactgcaaccttcacctcatgggttcaagtgattctcccacctcagcctcccaagtagctgggattagaagtgtgcgccaccacaatcagctaatttttgtaattttagtagagacagggtttcaccatgttggccaggctggtctcgaactcctgacctcagatgatccgcctgccttggcctcccaaagtgctgggattacaggcgtgagccaccatgccggcctcaagacaaatttcactggtgtccgtgacaagaatgttgtcagtgaagtggtaaggacaaaagaatgaatacagtaaaaagaagagaaagtgagatgaggatatgaaagcagcatatgtggacaactctgacggagtattgctctgaagggtggtaaagaaatggtactatacctagagggggagtggagtcttcaaagttatttttgtattaaaatgggagacagtataacacacatgctgatgacatgatctagagagagaaaaaatgatggcaaaaattgcagaagcaaaatcagtgattactaagcatctaataaatgcttaaggccaggcgtggtggctcacacctgtaatcccagcactttgggtggccaaggcggggggatcacgaggtcaggagttcaagaccagcctgactaatatggtgaaaccctgtctttacaaaaaatacaaaaattagccaggtgttgttgcgcgcccctgtagtaccagctacttcggaggctgaggcaagagaatcgcttgaatccgggagggcgagtttgcagcaagctgagattgtgccactgcattccagcctgggcaacagagtgagactcccatctcaaaaaaaaaaaaaaaggaaaaaaaaaaaagaagaagaaagaaagcttgtatctgtccttgctgctggaaatacaaaggtaataaatataagacatgaaactaatggaaggattatatggaaactatactgaaaatcatgaagggaaatacaacaaatagacaattagaaaatcatttagaaacaatactatttggtaataggctgccatgttaaaaatattacataaagcaatgttgacttttttgtttttcagaaggagtttcgctcttgttgcccaggctggagtgcaatggctcaatctgggctcacagcaacctccgcctcccaggttcaagcgattctcctgcctcagcctcccgagtagttgagattacaggcatgcaccaccacgtctggctaattttgtatttttagtagagatggggtttctccatgttggtcaggctggtttcgaactcctgacctcaggttatccacccgcctcagcctcccaaagtgctgggattacaggtgtgacccaccgcgcctggcaatgttgacatatcttatgatgtgacagcaatgtccttctaagctatatacatgcagttgcatagtgtaaaaacgtcatgtacagcctttgatttgattaatcacagttagatttagactgaatcaaccttagacaaaaagcaaagccagcaatttaagaaaacatctccactgcgcttccccttctccctttgcagtattgacccatttctgtttttgaattttcagtatccctgaattctataattcaccaccttacaacaggaggccattcacatatcaatcatttacataaattttcatcatctccagagttcccttccctttgcttatttaactatttgccatttgttctcttgcctccttaaaaaagttaagaattttaaagttataaagactactaattacgtatttgtgtaaattaatctagataagttactcaaacacacatttgcatttttaacttttcccgctctaattataagatccttttaaaccttttgtaattttatatcctttactgttctaaaataagatgtgagaggttatatactaaggtacataatatacaggttaaatgcaaactaaggaaacggagaaagaaaaataagatgaggttaaagataagggtggaattaaaaatgcattcaggggccgggcgtggtggctcacacctataatcccagcactttgggaagctgaggcgagtgatcacctgaggtcaggagtttcagaccatcctggccaacatgatgagaccttgtttctactaaaaatacaaaaattagccaggcatggtggtgtgcacccgtagtcccagctactcaggaggctgacgcaggagaatcgcttgaacccgggaagcagaggttgtagtgagccgagatcacaccactgcactccagcctgggcaacaggctcaaagaaaaaaagaaaaaaattcattcaacaagaccctgtaacctttgttactggggggaacctataaatacatggcttttagtttcctgttcatcagtgcagagaagaaatggctgtcatatacagcttttatttgtttatatcacttacagtattcataaggtaaaaataaatcattttcttgaaagaagcacagttttttttactgagacctaaggtaaatcattttactgaattgtcaaagatactgcagcaataaattcaatgtgttttgtaggactacttctttaacatctttcagagttcgtcaatggcatattgcttgggcattttagctaaaataagagggtttgagaatgttgcacattattttaattccaggatgagtttgcaatatccagagtagcagtattccacatgtttcaggtattcctccctaaaatattacaatttaaaaatcaggctgggtgtggtggctcacgcctgtaatcatagcacttcaggaggctgcagcgggcagctcacgaggtcaagagatcgagaccatcctgaccaacatggtgaaaccccatctctactaaaaatacaaaaattagctgggcatggtggcacgcatctgtagtcccagctactcgggaggctgaggcaggagaatcgcttgaacctgggaggcggaggttgccgtgagccaagattgtgccactgcactccagcctggggaaagagtgagattccgtctcaaaaaactaaaaataaataaacataaaaatcacaataaatttttttgagataaaactcaccattttaatctctggaaagtgcacaattcagtggtttcagtacattcacaatgttgtggaaccataaccactatctaattccggaacattttatcattcccaaaagaaacaacatatcaattaagcagtcactctccattccttggtctgtctctggtgaattctcttcctcctcacccatcagatgtattgcctagctaatgaacagctgatgtccatagaaaatcatattgttaacattcaacaaaaacttgaaattgtcaaataatcagaaaaaggtagatattaaagcagcatgcagcctttcaacaaaaactatgaaaatcaatagattatagcttgaaaaagaaaaagcatgtaattttttcatcatgactggattaaggcatgcaacaaaaaaattatcagatgaatcaactgctgaaaatgattaaatttgtacttatatgtaatttaactataaattatttaaatgagttcttaagttctcattcatgagaaaggagttcatgcagactgaaaagttaaaaaaaaaaaagctcttttattttggaactttaaaagtaatactagttttattctctttcaacagtgttagctaagatggttgcctggattgacagtgcctgaattactctggactgaacgggcaatatgtttctttaaagttatgggaatagaagatactgatacatgctcaaactaattaatcagattcaattagtagctaaagtgaaaataacacttctgagtttcctaattgtgattcttaagagctgaattttcaacaataatactgggagaagaggacaaggtcatgaaaagttgtcaaacttatatcacctgaatatctaaatttgattaggcataaattgtaattcactactatcttagtacatgagttttattatactatttacaagttttccctcatattagggttttcgtgacactagattacttgaaatgatcttttttttctacttattgatgcactggcagcatttactaaataacagttaatagatgtgatccattccataacaaattatgccttgacttacaatttcaacatatatctctattataaatgaaacataagcattacatatttacactactcagcgatgttctcaaaacaaccaaaaaagatttaaatgaaaaatagattattgttctcaaactgctagtgaatgaaacaagcataaaagatagaattaatcaaagagaatggctacccacagtctctgaaaaaattatgacatgagctattcaagatgaaacaatgattgtttggggagcaattcaaagaatatcaacttttgcaacacgtgcagattctgttcttcctttccttatatctaggcaagacaggcaaaaaatttttaataaaaataagaaacaaatttaatgctaaacttctgtaattacccaactccccagcaagttttctaatattaagcagaaaaagtataaaaagatacaaatataatatttgcatttttttgagagttggtagatttaggattttacaaagtaacatataataaaagatatttaaactttaaaaatgtactttttagattcaaaactcaaaaatgatttcacttttctaacatttttcttgtcatagtgtttcaaaaatgtagccagatgcggtagcacacacctgtaatcccagcaccttaggaggctgaggtgataggaatgcttgagcccaggagtttgagacagcagtgagctatgaccaccccagtgcactccagcctgggtgacagagcaagagcctgtctcataaaaaaaaaagtacataaatgaaaattaggtaattttcagcagttaattcacctgtgagatcatttttattgttgtctaccttaattcaagtaagccaggtcaatagattaaaatacaaaaaaaatccatgatgaaataagtctgtgcacagtctctgatacatagtacgttttcaatatacatgtgttaaactaagttgtatatattatctatgcctcaccttcctctgaggtacaataccagtgtaaggagaataaagattcttatctatggtttaaaacttaaaacttagaatgttcttacttagaaaccaaattcactttagaaaacagaatttcattaaagtttttttttgttttttttgttttttttctggagacagactctcgctctgtggcccaggctggagtgcagtggcgcaatttcagctcactgcaatctccacctcctgggttcaagagattctcttgcctcagcctcccgagcagttgggactacaggcgcacgccaccatgcctggctaatttttgtatttttagtagagacaaggtttcactgttggccaggctggtctcaaactcctgacctcgtgatccgcccgcctcggcctcccaaagtgctgggattacaggcgtaagccactgcgcccggcctccttacagtattcttaatgggatttcacaatatagaagaagacaggatataaaaaatgtaagtaatactcaattagaaaatctttcctatatatcaccctgagaagatagtgacctcaccttgactgaccctttcctgtcatttatatcccagcacatttttcaccctttctctgtctctgtcttatttccacttgtcaagcaaaaagcaaccttctccagaaatactttttaacctctgacctctcccttccaactctagttgtgcttcatagcactccctgcaggttggataagtgtggtaatcctaatattccataagatgctgtgcatatctttatcattgaataatttatcccctattgttagcattttctttttttgtttttttgagatggagactcactctgctgcccaggctggagtgcagtggcacaatctcagctcactgcaacctcctcctcctgggttcaagagattttcctgcctcagactcccaagtagctggggttacaggtgcctgccaccatgcctggctaatttttgtatttttaatagaaacgaagttttgccatgttgaccaggctggtcttgaactcctgactgcaagtgaaccgcccgccttggcctaccaaagtgctgggattataggcacgagccaccacgctcagccaggattttctttttatcaatttgttttctgtcttcaaatttcataaaagccaggattatgtctgatactgatggggttcaggaaatgctctcccaaaaaacatgacactgtgacatactgaatattttaagctaaagaaatctgagaaacagcatgtgtgggaagcttagccatgaatctaggatgtgtagatatattttcttccctataatatatagtagatgctgtggtgtagtaataaatatttgatctttacccctagttactggtacagaaacctaaaaaccctggaatttactgtctcttatgctaaacagatgatttatggggtggggagagctagacagcatcatcatgggtctgctctgcagaaaaaccaaccacatgattagggagttagagctttcaggcctactccctgacatccagagaggggaaaggggctgaacactgagttcaattgctaatggccaattgtcttagtccctattctgctgctataacagaatggcacagaatgggtagtttataaataatagcagtttattttgctcacagttctggaggctgggaagtccaagagcatggcactggcatcttgtgacggcctccatgctccatcataacaggatggaagggcaagggagtgcccgagataaagagaggatatctgtcaaatccatctcttgatcaggagcctactcccaagataacaaacccacttcccaggtaagtgcattaatcccttcataagggtggagcccttgtggcctaatcacatcttcaaggctgcacctcttaatactgttacaatggcaacatcaagtttcaacatgatttttggaagggacattcaaaccacagcaccagttttcatcaagcatgcctatgtaattaaacccccataaaaaccactaaattacgggatttgtagagtttccaagttggtaaacagatccatgtgctgagagggtagcacactctgactccaaggggacagagactcctatgctcaggatcctattacacattgccttatataccttaccaactggatgctcatttgttatctgttataataaactgataagtatagcactttcctgagctcaatgagtctctagcaaataactgaaactgaagggggttgtgggaacctctgattagtttcagcctgtcagaactgtgagtaactgagagaccctactggtggctggcatctgaagtggggacagtattatgggactgagaccttaaactgtggggtctacaataactttgaacagttactgtcagaatggaattaaattgttgagacaaagttggtgctgaataattggagaatttgtttttggaaaagcacacacaatactcaatacatttattttggataaatcaataaataagtgaaagtgaacaataaatagaagatatattaaactactcatatattttattattattatgcataggcatgtttgtaacactttttagagctagatttttgctgttcttgcaattcatttgtattgaatttttccatatagatagtgcttgcttttatattttacaattattttaacataagtacatgcttttaaactattattttcaagtttaaaaacacttaagccaacatccattaccaaaaccaaaacaaaaacaaaaatcagattctcctttatgaaacacagagattagcatgaatgtacctgcctctctcttaatattatttatcctaagcaacatgagaatgaggattgtgtttaattggaattttcttttccagagattaacagggtgcttagaagatgagaagtgctcactacctgctggaaaataaaaagaaatattatgagggcaaaatatcaaaaagaggaccagaaagtgggaaacgagatagttttctagaaaactgaaaaaggactaaaaaattaggggtggggtataactgaattgggccaaagattataagtgaccttgaagaaagtaatttcagataaaatagcatgaaaagttaaattttggattattttggccaggattgccaaaataatcttgaaaaggaagaataaagttggaaggctcacactttctgatttcaatttactacaaagctatagtaatcaaagcagagtagcatggcttaatgctagacctttagatcaacagaatagaattgagattcaagaaacaaacccttgcttacatgtacagtcaaatgatatttgacaagggtgccaaaacaattcaatggggaaagaatatcttttcaacaaaaggtgctggaacaactgaatatccacatgtaaaagaaggaaactggacccctacctcacaccatacacaaaaaggaactaagaatgaatcaatgacccaaacgtaagaggtaaaaacgtaaaattcctggaagaaaataaaggcgtaaatcttcttgaccttggattaggcaatgtttacttagatatggcatcaaaagcacaagcaatcaaaggaaaaatagataacgtggacttttgtccttcaaaggacactatcaagaaagtgaaaagacaacctacagaatggaagaaaatatttgtatatcatatatctgaagacagttgtatccaaaatatatttttaaaaaacacttataactactcaataattaaaaacaacacagccaggcacaggtggctcacatccataatcctagcactttgggaggacaaggtaggtagatcgcttgagcccaagagttcaagaccagcctgggcaacatggcaaaatcccttacctacaaaaaaatataaaaattggctgggtgtgttggcatgtgcccatagtcccagctacttgggtggctgagggggaggatccctagagcctgggaggttgagcctacagtgagccatgatgtgccactgcactctacccaggatgacacagtgagacccagaccctgacagatggagagactgacagacacacacacacacacacacatacacacacacacacacacacacacacacacagcacaattttaaaatgggcaaagggtttgaatagatattttatcaaaagaagatacacaaatggccaataagcataagaaaagatgctcaatatcattagtcatcagagaaatgcaaatcaaaaccacgagatggcacttcacactcactagaatggctaaaaaacaaacaaacaaacaaaacaaaacaaaaaaaacctaataagtgtttgtaaggatgtggggaaactggaacccttacacaatgccagtgggattgcaaaacattgcagccactttagaaaacattttggcagtttctcaataagttaaacagagttatgtcacccagcaattccattcctagttatatgcacaagagaactacaaacatatgtccataaaaaaacctacacgtatgtaggttttgtacatgaatgttcacagcaacattattcataattattcaagtgttcatcaaataataaatggataaacaaaatatgacacactcatacaatgaaatattatttggtaagaaaatgaaatgaaggctgggcgcggtggctcacgcctgtaatcccggcactttgggaggctgaggcaggtggatgacgaggtcaaaaattcgagatcagcctaaccccatctctattaaaaatacaaaaattagctgggcatggtggcatgcgcctgtaatcccagctactcaagaagctgaggcaggagaatcgcttgaatccaggaggcggaggctgcagtgagccaagatcctaccactgcattccagcctgggtaacacagcaagactccatctcaaaaaaaaaagaaaagaaaagaaagaaaaaagaaaataaaatgaagttgtaatacatgctgcaacaaggatgaacttggaaagcattatgttacatgacagaagccagtcacaaaaaaccatatattgtataattccacttacatgcaatgtccagcgtaggcaaatccatagagagagaaagtaggatagtgggtaatgggagttgggggaacaggaaatggagaatgactccacagggagtcctatgcttctatgctcaggacccttttggaccttccctcattcataccagggttactccagcctgggcgacagagcaacactctgcctcccaaagaaaaaaaaccatgcagaaagggagagtagatagcctgaaagaggttaaaatatactggataaaaaatagaagtgaagtcaattcaacaggcatgtatcaagggcttaccatcttctagacacagagttataaagagttataatattagggatataaaggtaaatggaggaattcattaagttgagaaggcttaacaaacctttgcctccaaagaagtcaacacccaaatgatccaaatgaaattacaactgcttttaaggttggaccacagtatttgccactacttaattattgaacctctctaagattcctaacctgtaaagtgaggaatggagaccctagatcactcacttctaaaatttgaagagtcaaaacaatgttggtagactagaaattggaataataggtcaaaatccacaaaaagcatgattatatgtactccattaacatgattataaaactcttgaagtgatactagtatgtactcaagaatatcattttcaaaagaaaaaaattttaacatgattgaatatgaaatctccaaaaatacattcttagaaaatctaagaatctatatgttttccttcattcattttagactacatgaagtttggaggacagaaagctcaattctacaaacagcagcctaaaatgctaggaccaaaattcacatacattagtaaaatatctttcctttaagatttagaaacttaaagaatttctgagaaacaaacagcttcacaacattactaagaatataaattagctccacaatgttatttaaaaggtcaactaaacctagctgctcttactaagaatcagtaagggaaatctgaatttgattcctagatttactatacactagctttgtaatcttgggcaagttactgagtcacatctcagtttcctcaactgtaagtagaacaaatatacccacctaaaagaattcttgtgaggattacacaaataaatatatggaaagctctaacagcataacatcgatgtggtcaaaagatgttgacagataatttacagaaaaaaataaaagagatcagtctggtcaacaaagtgagaccccgtctttacaaaaaataaaaacgaacaaataaataagaaagaaataaagctgaccaatacatgaaaataaactaaatcttgcagagaaatgcaaatttgaacaaatttgagttatcatcatgcaccaatcagattatcaaaggtttaaaaaaaaaaaaaaaagaacccagaattggtagttttagagtgagtgtaaattgataccaccactctgaaaggcagttcagtaacaagtataaaagttttggccaggcacggtggctcacacctgtaatcccagtactttgggaggctgaggcaggtggatcacgaggtcgggagttcgagaccagcctggctaacatggtgaaaccccgtctctactaaaaatacaaaaaattagccgggcatggtggcaaatgcctgtagtcccagctacttgggaggctgaggcaggagaatcgcttgaacccaggaggcagaggttgcggtgagccgagatcacgccactgcactccagcctgggctacagagtgagactgtgtctcaaaaaaaaaaaaaaaaaaaaaaggaaagtgtggccaggcacggtggctcacacctgtattctcagccctttgggagaacaaggttggaagactacttgagcccaggagttcaagagcagcctaggcaacacagtgagaccctcatttttccaaaaaattttaaaaattagttgggtgcagtggtgtatgcctctagtcccagctactcggaaggctgaggcaggaggatcacttgagcccagggggtcaaggctgcagtgagccatgatggcaccactgcactccatcctaggtgacagagtgagatcctatctctaaaacaaatttacttaaaaaataacatgttccaaaacatattattgattaaaaaggaaaattacaaaccagtagagtatgaccttatttttataaatgtgtgtgtatatttacagggaagagcatttaccacgttaaagaggttagctccaaatagtagaattttaagtgacttaactgtctttaaaaaattatttctgcattagttacactttctgtaagtatgcattacctttataatcagaaaaaaactattttgatttctttaaataaatttgaaaaacaaagaactaaaagaggataccagttcttggtccaatgattgttttcactacacaaaatgatctgcttgatccaagcaaatgttcagttagggaggaaaaatactttaaatgtgccctaagattagagaaacctgacagcctagggaaagatgaaaaataataacaattatgtgacaagactcaagaatatctctatcttaaaacgtatctgcttcagtttagattgaccaaagtccttttatacaccacaagaaataaaagtaggtaccttaatgggaaggagaaaggctaaagaaatagctaagaaacttactaaacacactgaaacttataatactgcttttcaagctattcttaaagtaattaaaagaattattcaacatgagaaaagaactagttcatttatgttagaggacttaagtaatttaaagaaagctacatcaaattgtctgaaacctcacttgttttcacttgtcattaattacctaccaagatatcacctgctgacaaaaagaaaaacctaaagacatagaaactttaactttccctagtatgaacacatgaaaactgttcttttcccttataaaaactctagtgcttagctttcttatttgaattcaggaaagagtactaaatgaagacaaaaattcaaagcaaaaggaacaacactgaacaacagagtcaagaaacagactgtggtttcaattttctactaactcttaattttataagtaaaacaagaagattgacaagagcttcaaatacttttaatggaggatcagtgatacaatacactctttgaaaaattcacagttcataaaaaaaagaaaagttctatggtaaaataagttcagaaaattgtgcacaccctttgccctttttggagatccataatgcagaacagaaaatacttctgtataacccaatgtttcccaaaatgagagacaaacaaaatgtccctcaacaaaggaatgatttaaaaatgcttacattagacagatcaacgagacaaaaagttaacaaggatatccaggaattgaactcagctctgcaccaagcagacctaatagacatctacagaactctccaccccaaatcaacagaatatacattcttctcagcaacacatcgcacttattccaaaattgaccacacagttggaagtaaagcactcctcagcaaatgtaaaagaacagaaattttaacaactgtctctaggaccacagtgcaatcaaactaggaatcaggattaagaaactcactcaaaaccgcttaactacatggaaaccgaacaacctgctcctcaatgactactgggtacataacgagatgaaggcagaaataaagatgttctttgaaaccaatgagaacaaagacacaacataccaccacctctgggacacatttaaagcagtgtgtagagggaaatttatagcactaaatgcccatgagaaagcaggaaagatctaaaattgacaccctaacgtcacaattaaaagaactacataagcaacagcaaacaaattcaaaagctagcagaagacaacaaataactaagatcagagcagaactgaaggagacagagacacaaaaaaacccttcaaaaaatcaatgaatccagcagctggttttttgaaaacatcaacaaaactgatagatcgctagcaagactaataaagaagaaaagagagaagaatcaaatagacgcaataaaaaaatgacaaacggggtatcaccaccgatcccccagaaatacaaactaccatcagagaatactataaacacctctacgcaaataaacaagaaaatctagaagaaatggataaattcctggacacatacaccctcccaagactaaaccaggaagaagttgaatccctgaatagatcaataacaagctctgaaattgaggcaataattaatagcctaccaacgaaaacaagtccaggaccagatggattcacagccgaattctaccagcggtacaaagaggagctggtaccattccttctgaaactattccaatcaatagaaaaagagggaatcctccctaactcattttaatgccaacatcatcctgataccaaagcctggcagagacacaacaaaaaaaagataattttagaccaatatccctgatgaacatcgatgcaaaaatcctcaataaaatactggcaaactgaatccagcagcaaaagcttatccaacacgatcacattggcttcatccctgggatgcaaggctggttcaacatacacaaatcaataaatgtaatacaccatataaacagaaccaaagacaaaaaccacatcattatctcaatagatgcagaaaaggccttcaacaaaatttaacagcccttcatgctaaaacctctcaataaactaggtattgatgggatgtatctcaaaataataagagatatttatgacaaacccacagccaatatcatactgaatgggcaaaaactggaagcattccctttgaaaactggcacaaggcagggatgccctctctcaccactcctattcaacatagtgttggaagttctggccagggcaatcaggcaggagaaagaaataaagggtattgaataaggaaaagaggaagtcaaattgtccctgtttgcagatgacatgattttttatttagaaaaccccatcgtctcagcccaaaatctccttaagctgataagcaacttcagtaaagtctcaggatacaaaatcaatgtgcaaaaatcacaagcattcctatataccaataatagagaaacagccaaatcatgagtgaactcccattcacaattgcttcaaagagaataaaatacctaggaatccaacttacaagggatgtgaaggacctcttcaaggagaactacaaaccacggctcaacaaaataaaggatgacacaaacaaatagaagaacattccatgctcatggataggaagaaccaatatcgtgaaaatggccatactgcccaaggtaatttatagattcaataccatccccatcaagctaccaatgactttcttcacagaactggaaaaaactactttaaagttcatatggaaccaaaaaagagctcgcgttgccaagacaatcctaagccaaaagaacaaagctggaggcatcacactatctgacttcaaactatactgcaaggctacagtaaccaaaacagcatggctacagtaaccaaaacagacatagagaccaatggaacagaacagaggcctcagaaataatactacacatctacaaccatctgatctttgacaaacctgagaaaaacaagcaatggggaaaggattccctatttaataaatggtgttgggaaaactggctagccatatgtagaaagctgaaactggatcccttcctcacaccttatacaaaaattaattcaagatggattaaagacttaaatgtcagacctaaaatcataaaaatcctagaagaaaacctagacaataccattcaggacataggcatgggcaaagacttcatgactaaaacaccaaaagcaatggcaacaaaagccacaattgacaaatgggatctaattaaactaaagagcttctgcacagcaaaagaaactaccatcagagtgaacaggcaacctacagaatgggagaaaatttttacgatctacccatctgacaaagggctaatatccagaatctacaaagaacttaaacaaatttacaagaaaaaaaaaatcaaaccaccacgtcaaaaagtggacaaaggatacgaacagacacttctcaaaagaagacatttatgcagccaacagacacatgaaaaaatgctcatcatcactggccatcagagaaatgcaaatcaaaaccactatgagataccatctcatgccagttagaatggcgatcattaaaaagtcaggaaacaacaggtgctggagaggatgtggagaaataggaacacttttacactgttggtgggactgtaaactagttcaaccattgtggaagacagtgtggtgattcctcaaggatctagaactagaaataccatttgacccagctgtcccattactaggtatacacccaaaggattataaatcatgctgctataaagacacatgcacatgtatgtttattgcagcactattcacaatagcaaagaattggaaacaacccaaatgtccatcaatgatagactggataaagaaaatgtggcacatatacaccatggaatactatgcagccataaaaaaggatgagttcatgtcatttgtagggatatggatgaagctggaaaccatcattctgagcaaactatcacaaggacagaaaaccaaacaccgcatgttctcactcataggtgcgaattgaacaatgagaacacttggacacagagtcaggaacatcacacactagggcctgtcgggtggggggaggggggagggatagcattaggagatatacctaatgtaaattacaagttaatgggtgcagcacactaacgtggcacatgtgtacatatgtaacaaacctgcacgttgtgcacatgtaccctagaacttaaagtataaaaaaaatgcttacacatcactgtataatccttttaaagaaaacgtatttatatatattcacatggcagacttctgttgcataggtagaatatataatcaaactgcagaatgcatatttaattagattttaaaaaataagtatatatattcatgtgcatattaaaaaggtctgaaagaatgtacagcaaaccattttaaagtagttctggaaactgccatcagcagggccaaagggaatatatttactttatgaatggacagatttgagtttctccggtaagaatatatcgctttgtaatacaaataagtagccaccagaaaacataaatgcactgggtaagttcacatactttttttttgagactctgtagctcacgctggagtggtgtgcgatcacggctcactgcagcttcagcctcccaggttcaagctcagcctccggagtagctgggacagcaggccagcactacaacgtctaaataatttttgtattttttttaagagatggggtcccactatgttgcccaggctggtcttgaactcctggactccagtgatcagcccacctcagcctcccaaagtgctgggattacaggtgtaagccactgggcctggatgttcatattatttaaaataaatcttttcacaacaaaaatctattggctcttttataaatatgaaatttaacacatttcttctaatacaatgtatctccaggttactgaattaaagacttcctaagatattcactgaagcgttacctataaaaatatacactgggaacacttaaatgcttataataatcaatagttaagtaaatgactaaatatcaacccaagagaatttttcaatttgcctattttgtttatgaattgcctacagttttataaggattttgaaagctaactcaacaaaaaataatgtgtataattatatagaatacatagcaatacaaaatacttatacatataagtaaaaaaaattccaatgcatatttgtgttattttacctgtaaaaaatatgaaatatattcttttttcttttcttttttttttttttttgttgagacggagtctcactcctgttgcccaggctggagtacagtggcgcgatctcagctcactgcaacctctgcctcccaggttcaagtgattcttctgcctaagcctcccaagtagctgggattacaggtgccagccagcacacccagctaatttttgtatttttagtagagacagggtttcgccatgttggccaggctgatctagagctcctgagctcaggtgatctgcctgcctcagcctcccaaagtgctgggattacaggtgtgagccaccacatccagctatgaaatatattctttcataaattgagcaaacatcatgcaagtcatgtatgtttaccgcttatgaaacagactgcaggagtcacagcacttgccaatcaagaagcttacagtcaagtggaacaaacataagtaaatcaattattatagtacaatggcattcattcattccataaaaacgtatgtagtgcctactgtgtaccagatattgtctagatgctactcatttgtgaacaaaaagaaaaaaaaattcttgccttcttcatggggagagacagataacaaaaatataaataaaaaaacatttatagcatatttgaaggccataagtatatggggtggaaataaagcagaaaaagagagagtacagggcagacggtttatttttgttagtgttaaggtaaagagtcatgtggaagtgtacatctgagcaatggtttgaaggatgttaagaacaagctataaggttatttgaaggaatagcaaatacaaatagcttgagggaagaatgtgtctgataagtatacaagaaacaacaagaaggttagtgtagctggcccagagtgaagaagaagtgtattaagaaataggggagaggtaaaatgctgcgaggaagatcatgtattgtagggtcttgtaaagactcttgcactgtaagatcattgtaaagtcatggtggggtgtgaacacaggagggatgtaatctgatttagggtttttttttttttgagatggagtcttgctttattgccaggctggaatgcagcagcacgatctcgactcactgcatcctccatgtcccaggttcaagcgattctcctgccttagcctcccgagtagctgggactacaagcatgtgccaccacaccgggctaatttttgtatttttagcagagacgcggtttcaccatgttggccaagatggtctccatctcttgacctcatgatcctacccactcggccttccaaagtgctgggattacaggcgtgagccactgtgcccagcctgatttaggttttaagaggatcactttggttgctatgttgataatagactcttgggagtaggagcagaagccctagaaggctactacaaatatccaagaaatgattgtaacctgggccatagaacagtgaaggtgatgaaaagtggtgagaattcaaatatactttcaaagtagagtcaacacaatttgttgacgccttataagtgggatatgagaggagttaagatacagaaaagaagagtcaagaatgtagacaagaaaggagtcaaggatgacaggacatggtttagatctgtgtcctcaccaaatctcatgctgaaatgtaatctccagtattaaaagtggagcctggtgggaggtgattggatcataggggtggacttctcatgaatggcttagaaccatacccttggtattgttgttgcaatagtgagttcttgggagatctagtcatttaaaagtgtatagcacctggccctctctcgcttgctcctgcttttcactatgtgatgtgccttctccccctttgcctgctgtcatgattgggagcttcctgaaacctccccagaagcagatgccactatacttcctgtacagcctgcagaaccataagccacttaaacctcttttcttataaattacccagtctcaagtatttctttaaaacagtgcaagagcagactaataaaatagcgttttcttggtatgtgcagtaagaatgagttgtcactaagatggggaagactgttacagggatagacttggagtggtaaagtcaaacttttgacactgaacatgttaaatttaagatgcttcgtcagtgtgcaggtagagaagtcaagaagacaagaagacaattggctgtaagagtaaagtggcttgctccacttcaaagaatgtgataggaaacttctattttagggatatagttgcaaaaaatacaatgatttacaattaggggatccatcttcacagattaaatattgtctggccctcaacagacacataaaaaaatatggcaaatgaatgtgaaaactgtattaaatgtttacatttatatgcatatgtattttttataatttcctgttttgacctttttgattaaatgaatagctatcaaatccaactggattggataagaagtctgttgctgtacattttgcaaataatggttaaaagccatttttaaatatgttaagtattcatactagaaatattctaaatataatggttaacagacttctactttctccttaattgtctatttctgatacccagaattatttaataaaatcagttaggtatttcctatgtgttagttttataactgtaatatagtgatgccttcattcaatgactaggactttgtccctatgctaaatggtgccagccagactgctttcaagtttttcagtttcctctcttattagaaggcttgtcagctgtgacctgcttgctgcctaaatgcttacttaaagctaatcttttcaactttattggcttaaataaatgacttttttctttacatgtctacttatgccaaatttttggcaaaagtcacctttacattgctaactcagaaactttaagtatgagtaaggcagatttcatactcagaatctgaatgtacaagtcagtcattttatatgtgcttagaagtagattattgtttttacactaattattttacaacatcagctttaactttaaaatttcacgttaaacctaagaacccattgctatttactattaatttattgataatctatacgttgtggtaattatattacaattataattttttatatctgacacagcaaaaaagaatttgcgaggatctcaagactaaaagttattacttaacccttgaaaatgtctgttttattttgtgacccaaacagttttgttttgattttttgtagggaaagtgctaggctatagatacaaacctgctgaacaaaaataaataaatcatctacacagaattcagaatttttcttataaattactactaaccttgctaccaagctaccttaaaagtgttaccaattttcagttgaaccagtttatcaacttcaggcttctaagtttcctactgaagaaaaaaaaatttaaggaagaccaataattattacctttgttctgtatacactgatataaatgaattatttatcttgaacattaaaagacttaaatcctagcactttgggaggctgaggcaggaggactgcttgagactaggagttcaagaacaacctgagcaacaaaatgagatcctgtccctacttaaaaataatataaaacattttttaaaaactaaagaataactaaaaacatattgaaaaattaaaattattccatatagaatatacttaggcttgcataatataaactctaaaactaaaaaataaattgatgtataaaagctaaaatttagattttccacttacagtttgatcttacaagatcttacaagtctgaagagttcactacctaagaaataaaatttctctcctccctcaagtacatcttccagaatgccaatagacataccttcctaaaacctaaacctcactaaacctaatcatgtctcttcccctttttaacaacttaatgtaaaaatgggagaaaaaagctttaataatatcctatcacctgcaactttttttttttttttgagacggagtatggctctgtagcccaggctggagtgcagtggcgcaatctcggctcactgcaagctccacctcccgggttcacgccattctcctgcctcagcctcctgagtagctgggactacaggcgcctgccaccacgcctggctaattttttttgtatttttagtagagatggggtttcaccgtgttagccaggacggtctccatctcctgacctcgtgatccgcccacctcagcctcccaaagcgctgggattacaggcacgagccaccacgctcgacgcaactttcttaattgcctatctaaacctcaccttccaatgttatttgctagcacttcctgcaatacctgaactttaagcctgcctgtcctttcccactttttacatctggacatacttcaattcactcatcaaaaattcactgaaatctaaactttttaaccagctaatatttactgactaaattaccaagtttaaggcccagtgctgtgttgtaaatatgtaactcttaagatgcagtccttgccctcaaagtttaacaatctggtgaaattctccctaaaaccttacccctctcagggctaccttttacattaaatctaattctccggatgtacttatcatactatatagtaattatttacatgactgttttcccctactagtctgcgaacagaaagaaaagtaaccacgttattcatctctgtagttccagcacctagcaaaatgaattaccaatagtagttgctcaatgctgcaatgaattgtatacaatatatcaagagcaaaaacaaaaaataacaaaaaaaggccaggagcagtgggtaatgcctgttaataccaacactttgggaggccagtgtgagcgtaccgcttgagccctggagtgttaagatcagcctgggcaacatagttgagacccggtctctactaaaaattacacaaattggccgaacacggtggcatgtgtctgtagtcccagctactcgggaggctaaggcagaaggatagcttgagtctagagtttgaggctgcagtgagctacgattgtaccactgcacttcagcgattgtaccactgcacttcagcctgggtgacagaccaagaccctgcatcaaaaaaaaaaaaaaaaaacccctgcttgccaaatgaaacaaaatgtgacaacaccttaccattatataaccatatttaaatgagccttcattttcatctacaatataagatatatttatgaattaatggtgaatcatctcaaccaacaataactccaaaataggctgggtatagtggttcatgcctgtaatctcaacactttgggagatcaaggtgagagaatcacttgagcccaggagttggaggctgcagtgggctatgattggtcactgcactccagcctaggcaacagagtaagatctacacacacacacacccctcttaaatatgaccatagtccattatttccccaataaagacaattctttactggggagggtccatcccaaactttgcagatgtttagcactgctggccctgcagactcaatgtcaatagctcggtttagtcattatgacaaaccaaaacatacaacacattgaaaatgctccctaggtgaataagcagcccctgaggtgagaaccattgcttagctttgtggctctttttgactttatttacaaataaatcatatattccatagagaatgctcgccatgcatctctaaaacaaaaacaaaatgtaagtaaaattaaaattgtagtatgaaattatttcctcaaatactgggaacacattttatatagtcagccactctaccttagggagatatacataagcaaaaagactaaaggcaggctgaagcagtaaggacgagaaagaaaatatggcatctaaagtctacatgcagatgccagaattaaacaaactaatttcttcaaaagtaggatattcaagatgatcttttaaaatgtgggaagaaatcataaagaatctaacttttattaagagaacgagaaaaatttgctaactactaatatttaacacatggatgaagactgctgccactcataggattgaatattaggctttttatggcaagctacctggcaggaagagtgtgaattccacattgtagaggagctcacagtggtatccttactcacactgctcagaatcataatttatgggtctacaatgaagtagatttataaattataccattctaagccaactttcataaaaaatgagggggctttaaaaagattccttccaaaaaaaaaacatagattaaacataatactagttaacagaatcacaagaaataacacaaaatgccaaagctgatgcttttgctgctagttatcagccacactgtgaggaaaaaatgatgatctcagccaaaaaaataactataaatttaagaagaaactatttgagttacagtatttattattgttaacaatcgccttagtttctaattcactttgagaaactggctaataagaatataaagcattcacaattagcaaaatatcttaagacactgtttatataatctttatctcatcctatttcatttatatttattagtgtatatctgacataaaatactaggatattagtaaatgtatataatccataaacaaatatacatatactggtgatccatgctccaaaacatttttactgattggaaacacaaaatagttctaagaccatcaacatataagacaggagtctaaaataatgtagtctaagaagaatttcccaaacctttaagtcaaccagatttaaggatacccagcaaggccgggcccgatggttcacgcctgtgatcccagcactttggcaggccgaggcaggcagatcatttgagatcaggagtttgagaccagcctggccaatgtggtgaaaccccatctctactgaaaatacaaaaattagccagccatgctggcaggcgcctgtaatcccagcaacttgggaggctaaggcaggagaatcgcttgaacctgggaggcagaggctgcagtgagccaagatcatgccactgtattccagcctgggaaacaagagcaagactccatctcaaaaaaaaaaaaaaaaaaaaaaaaaaaaaaaaaaaaaaaaaaaacaacccagcaagaactggctattgttaatcttccactcaaaaaaaaaaaaaaaaaagtaaaaatgcctcaaaaataggccaggtacagtggctcacgcctgtaatcctagcactttgggaggccaaggtgggtggatcacctgaggtcaagagttcaaggccagcctggccagcatggtgaaaccctgtctctactaaaaatacaaaaaattagccaggcgtgatagtgggcgcctataatctcagctactagagaggctgaggtaggagaattgcttgaacccgggggggtggaggttgcagtgagccaagatcgtgccacttcactccagcctaggagaaagaacaaaactccgactcaaaataaataaataaataaatagatagatagatagcttggatataagaattaaaaaattttaaggcaacaatcagtgaaaagacgctttaactcagggtcctaaagcaaaataattccaaaaaggtgtgctagtccctaattgcaaagatgggggtgggcacggtagaatggaaagaagcaaatttttagcaatctctagtagttcttctatttacagtctggactttatcagatttatttacatttcaagaggaaaataagaagtgtaaaacagcacttttaaaaggcttctaactagcctttaggaatcatttttacatttaaaatttttattttttaaacatttcttgagttgataaacatataacattaaatatgcttacatttaatagtattttaaagcattcttatcagagtataagatctacatctctgtttctaggttcacttaagtagtatctgtgaaaacattttgtccacagtgggctgacatgaaataatatcaaatctcattgcctaaaacttttgtagatgttactacctatgaataaaaatcacattataaacatttaaaagtataaccattacacagaaatgaacagttcttttccaactattaagaaagctctttcctaaaagctttctaggcaaatgaacaactctgaagcaaatgaaaattaagttccagactctttttttctgatcaacaggcttccattacacacttacttccattaaaacaggagttgtaatgggacatggtaactacaggtgaagagttatctcattcatttcagttgctgggtttcttgccagttccccagtctacttctgtttctatggcaacaaaggtaggataaggaaaacagaaggaacactttaagataacagctaagtggggaaagtcaaagtattgaatggcatatacagtaatttaattttaagaaaataatctaaaatataaaaagaaggaaattgcagttcatacaaccttaaaaatactcaaagggaggaccttgccattccaatattttttccttgattgttttcatgaaaacatatttaacttttactgataacttttctagaaatttgattccactcctactatgggtggcccaaaactcaaaaaaacagaaaccagaaatcaccaaatgtccagattcattttccagcaaaaatcacagtactttaagtaatgcttttttaaaaatattctatcacattttgtgatcctagttaggaatttactttaaactctttctttaaaataattgattctaacatggccctttaagctaagcaaagcagctacattcaagctttagacgaggctgggcagcaaggcaagacgctatctctacaaaaatttttaaaagcagccaggcatgatggtgggtgcctgtattcccagctactcaagaggttgaggcgtgaggatctgttgagcctgggaggttgaggctgcagtgagtcatgggtgcaccaccaaactccagcctgggcaacagagtgagacctgtctcaaacaaacaaaaaaacaaagaaaaagaaaaaaaaaagaaataaacccatctgttaatatgaatctttcatatagatatactgcatatcaataaattacatataacgtgtctagaatagaagtttcttccgtagatttactaagtaattctgggatcatgttaagtctgtaaatattcagtatcatgaattttatttatttatttatttatttttagagacagggtcttgctatattgcccaggctggtcttgaactcctaggctcaagccattctcctgcctcagcttcccagtgctgggattacaggcgtgagccactgcacgtggcccaatatcatgactttaacagatcttttaaactgcttgttctttttcaagttgctctatgttcaaattatcttctttcctctttcacaacattctcattctaaaaagagactctgtctctctctcaactctcacccactcactttggtggaagcaagctgccatgtcagacacagcaccatggaaatgaccatgtgatcaagaactaagtcctcccaccaacagaacagggacaaggaaaaaaggcgtgccaagaactatatgagcttggaagcagatcttctagccccagttgagccttgcaatgactgctgccccaactgacagcgtgacagccacctcttgagagatcttaagccaaaaccacctaactaagccactacgagattcctgaactacagaaactccaataacaaatatgttttaccctgttaagttttgaaatatttactaaacagaattagataaattgataaagtatcttattcatctctttattccctctcaccccaacactgagttccttgcctggagaagatacttagcaaataaatgatgaagcaaagccttaagatttgtgatgcagtttggccaaaactcatgccaaatgggcttactctactgctaagggaaacaaaaatttaagcccccaactccatatgaaaactaaagtaataaaaagaaaatacatgttcacttaataaaacatatgatatgctaatctgtaccatcagagaacaaagagtatgtccaaaatctatatttccacctttaaatctatcattattttcctcagtgatcatgcaaactttgaccaaatctctgtattttatctttgtagaatctggaatgtacttctatgtattccatcagttgaaatcttacccctcttaggataatgttcctgcgaggaaaaattatggaagactttaacaaagggaaaaaaaagattatgtcctatctagggcatcataccaagttatctgtccctttcactatcctttttgttttgggggttgttttttgtggtaaaatacacataccagtagtccccacttatccacattttcactgtgaggcttcagttacgagcagttggccaacgtccaaaaatattaaaatgaaaattttaggaatcaacaattcacaagttttaaattgtgtgccattttgagtggcatgatgaaatttcatgccttccccctcaaacctgcctgggacacaaatcatccctttgtccagcatatctactctataaacgctacctgcctgttagtcacctaatagttgtctagttattagattgacaaaacatagtcatccactgggggttaggcagcatccactgagtgtcttggaacgtatctcctcggggacaaggcagggactactgtaatataaaatttgccatttttgccagttttttaaaaagcctacattctcctatccaagtactaaccaggcctgtccctgctttgttttagaaattagagatcgagcacatactttaaccatttttaagtgtacaattagctggcattaagttcattcacaatactgtgcaacctccaccactatccatttccaggcctttcaattctctttgaactaaattctcagacaataaaaacactgaacttctaatattctgcatgtgcattaaaaaacaaaaagtcggccgggcgcggtggctcactcctgtaatcccagcactttgggaggccgaggcgggcggcctaccttgtggtcaggggatcgagaccatactggctaacacggtgaaaccccgtctctactaaaaatacaaaaaaatcagccaggcgtggtagcgggagcctgtagtcccagctactccggaggctaaggcaggagaatggcatgaacccgggaggcggagcttgcagtgagctgagatcgcgccaccgcgctccagcctgggcaacagagcgagactccgtctcaaaaaaaaaaagtaattagaaaaactaagtattttagtttttaatcttaagaacccaagtttacaaaagaaaggtaaatctttggcaaatgggactaatttaatacattctaattttaaaaatttatggctttaaccaatcggacaagctagcattaatccttaaagtttacaacatgaaacagataaattctcatgttcaagtaaattgagtcattattttgacagtttttttttttttcttgacatgtaatcttgttttgttgcccaggatggagtgcagtggcgtgattatggcttgctgcagcctccgcctcacaggctccagggatcctcccagctcagtctcccaagcggctgggactacaggcgcgtgccaacatacccagtgaattttttgtagtttttgtagagacagggcttcaccatgttgcccaggctggtctcaaactcctaagctcaagctgtttgcctgccttagcctcccaaagtgctgggattacaggcccaagccaccgggcatggcccaacaaatttttatttcaacagtaagtatattttgcagcatggcagcttgaagataattttcaaatctttaggtagcctaaaaccttggactgatattaaataattattcaatgcgtaataacttctaagcaaaatactgaaacattgattactatgcatccttttaaacatatacttttttttttttaaacggagttttgctcttgttgcccaggctggagtgcaatggcatgacctcggctcaccgcaacctccgcctcctgggttcaagcgattctcctgcctcatcctcctgagtagctgggatcacaggcatgcaccaccacacctggctaattttgtatttttagtagagatggggtttctccatgttggtcaggctggtctcaaactcctgatctcaggtgatctgcccacctcggcctcccaaagtgctgggattacaggctaaacatacacttttgtttcttgtttttatatactaatgacaagctgttttaggtcatgttagtggaaatgtcaatttttgccactttaagaggcgaaaaagaggtatgcgtgctgtaaaaagtggtgttgtgtgtgctcatgaattctactagtctgctaaaatgctggtatatgacacagttctcaattattcacctccaacttttctctgtaaaacagaaattagtcacttcgactaaaagttacaattaatatgattcattgaaatctgttatgtaagtttagcctaaagctgcctctttacatattttaaattcaacctagaggcttctctgtacattctgaactatatctaacaagcggaggtactatcagtccatagcccactcttgtgccaatcacccagttttggcatatcaaatgtggccaactgttccaactgtgtttaactaaggcaaataccaagctgtaaccaatccagctatttctgtacctcacttatgttttctgtatgtcacttcctttttctgtccataaatcttcttccaccacttggctacgctggagtctctgagcttactctggcttgggaggctgcttgattcgtgaattttctttgctcaattaaacactttaaataaatttggctgaagtctttcttttaacagactataccaggagcaacaatgacatggaatcacagctcggtatgtgcatttattttaaaggaaaaggagtagtattgtcctaaagaacggattcttgtgcattttggtctcctggcctctttacactcttaggacttgttgaagactccaaaagagttttcattgtacataggttgtaagtcttgatgtttaccatattggaaattaagactcagaactattttaagcgcttatttactgtttcatttgaagacaacaatgattaatatattgcattttagcaaattttagtatttttataaaaatatgcgtgacaccacagatcctgttagaagcacggccctaaagtttgttcaagaatataaaagacaatgaaggacctaacctagaaagtaaatttgtcttgatttatagcagctaacatagaaaagaagctaccaaacattttatttttgttttttctccatttatttatttttttctatcttttaattttttatttccatagggcattggggaacaggtgaggtttggttacaagagtggtgatctgtgagattttggtgcacccaacacctgagcagtatacactgcatacaatttgtaatcttttatccctcagccccacttcctaccctttccccctgaatccccaaagtccactgtgtcattcttatgcctttgcatcctcgtatcataacttagctcccacttatgagtgagaacatacgatgtttggtttcccattcctcggttacttcacttagaataatagtctccaatcttatccaagttgctgcaaatgccattaattcatatctttttcatataatgacttcttttcctctgggcagatactcagaagtgggactgctggatcaaatggttgttctacttttagatctttaaggaatctccacactgttttccatagtggttgtactagtttacattcctaccaacagtgtagaagtgttcactgttcaccgcatccatgccaacatctattattttttggctttttgattatggccattcttgcataagtaaggtggtattgcattgtggttttgatttgcatttccctgatcaatagtgatgttgagcattttttcatgtttgttggccacttgtatatcttcttttgagaattgtctactcatgtccttagcccactttttgatgggattgtttttttcttgcaaatttgagtatttaaaatgttcgaaacattttaaagtttagaaaatttcactcaacattgatggacttgcttccttagaatactagttaattccttcatcttcaatgtgaaaggctattctataccttctgtgtaaagtgactaaatagcagaaattctgtatcctaacagaataactttctgtgcttatgttgagttcattatgtccttgatcatctaaagaaacaaaaatgaatagcttcctcctcaggtatgaaacaggtaaggtcttactttttaaaatttttttttggtggagtcttgctccgttgcccaggctggagtgcagtgacgcgatgtcagctcactgcgaccttcgccttctaggttcaagcgattctcctgcctcagcatcccaagtagctgggatttcaggcatgtgccaccacaccctcaggtgatctgcccgccttggcctcccaaagtgatgggattacaggagtgagccacctcctccagccaggttttcccttctatgtgtatgtttattgttactttgattaaataagtaaccaaagcttgtttctcaggcagccacgactctatctcaatcaaaccccaaatatcctaacaactctctatttgcattcccccaatcagatcctaaatacagaaaaataaaactttcacaatacactaaatacactaaactatctttcagatttcccagagtgcctcaataagaccacatagacgtattctttttttttttttttctgagacggagtctcgctctgtcacctaggctggatgcagtggcacgatctctgctcactgcaatctctgcctcccgggctcaagcgattctcctgcctcagcctcccgagtagctagtactataggcgcctgccaccacgcccagctcatttttgtatttttagtagagacagggtttcaccatattggccaggctggtcttgaactcctgatcttgtgatccacccacctcagcctcccaaagtgctaggactacaggcgtgagccactacgcctggctgacttattctttcacctcataaaaaaagagctgctggaaagaattgggtttacttgatatgttactctcataagaattgcatgggaacagtgtcaaatcaaaagagatatttagcttttcctaggttaagattatatagataacacattattagtacaaatatttcagaaaacttatgttttatgagaaatccctgggaatgtgtcaatgtctttactgtccattataatttcactcttgggggaaatactgatcaaaaactcaagaaataattacagacgggtgtggtggctcacacctgtaatcccaacactttgggaagcccaggtgggtagattacaaggtcaggagtttgagaccagcccggccaaacagaccagcctggccaacatggtgaagccctgtctctactaaaaatacaaaaattagccaggcacctgtaatcccagctacttgggaggctgaaggagttgcttgaacccgggaggcagaggttgcagtgtgccaagattgagccactgcattccagccagggagacaagagtgagactctgtcacaaaaataagtaaataaataaataaaatatagctgttaactgggtgtggtggcaagagtgaaactctgtctcataaatacatacatacatacatacataaaatatagctgttaactgggtgtggtggctcatgcctgtaattctagcactttgggaggccagggagggaggatcacttgaggaccagcctggccaacatggcaaaaccccatctctactaaaaatacaaaaattacctgggcttgggggcacacgcctgtaatcccagctactcaacttattgagcaactgacgttttacctagagtgtcatatttgagaacgatgcttacttaaacaggtacaagttacttttaaggaactaatgttgactttacgagccctccctggaaaactagcctggtccctgtcttacagggactcagccttttaggtgataaggaagatcactttctggcaggccacacaaacttaagaaatctgagggactgccgagcgcggtggctcaagcctgtaatcccagcactttggaaggctgaggcaggcggattacctgaggctgggagtttgagaccagcctgaccaacatggagaaaccccgtctctactaaaaagacaaatttagccaggtgtggtggtgcatgcctgtgatcccagctactcaggaggctgagacaggagaatcgcttgaacctgggaggtggaggttgctgtgggccgacattgtgccactgcactccagcctgggcaacaagagggaaactctgtctcaaaaaaaaaaaagaaaaaagaaaaaaagaaatctggggcctggcatggtggctcacgcctgtaatcccagcagtttgtgaggctgaggcaggcggatcacaaggttaggagatcgaggccatcctggctaacacggtgaaaccccatctctactaaaaatacaaaaaattagccgggcgtggtagcggaagcctgtagtcccagctactcgggaggctgaggcaggagaatggcgtgaacccgtgaggtggagtttgcagtgagctcagatcgcgccactgcactccagcctgggcgacagagcgagactccttctcaaaaaaaaaaaaaaaaaagaaaagaaaaagaaagaaagaaagaaatctgagggataattgggggtactatagtaggtaaaatctcgtagaatgtcccaggcttgctttctagcctgaggagaggaaatatcagtaatttttaaatgtcctagctcagattccttagaaaaagttcaaaagttaattttgtagctttagtagttgtacatagtgcataggctcaaggatacgcacaagttaactcaaggaagcctgtgtagttaatatttttgcacacctatgtaaataagccatacctcatgagaccggccttttgggggtgatcaggaaaaatctttaagataattattgtatgatcacattgctacaaaatcttaccagaaccattcctgccaaacaattcagaaacaaatataattccctaacaaatttaggaatatatgattatccataaaaatcaagaatatacaaattaaaataataatattcccactgttaaaaaaaaacgaaaaaatattctcaacttccaattgcaagagtatacaaaatgatactaattcttctgagggggatttttgtggatatgtgaaaagagcctttaaaatctgaataacatacattcacatgatcttgtcccgaaatccaccaaacaggacaaaaaggaccaaaattagtgtgggaaccagggaaaataccagtactcttttaataagactgattctatatgcatatgccctaagagggcaaggttcacaatttagtaagtaagagaatattcagaaatgtcctaacccataactttcatagttgccgtttagaatcatggggggcctataaaaagaagtggggggaatcacagatcttgggacacatgtttgcagagcagaaaataatcgagctacttttttggcctcatcgtttttatttttctcaacctttcattagagttgaggagacagctttgaaggtgaggatcaaatctgactaagcagacaaaagctctgactcatcacacaaaactcataatccacaggattacagagagtcattctctccctcctcccactcacatcttcaggtgtgccaagttctccctaaagcagggaaactgctaaaatcgaagttccaccctcacatatagaacaacagcaaagatctcaagagactcagagaaaaagttctaggaaaaaatatatgtaaactatacttcctgttgcctagctcttcttgcctcttattccaaatatttaaaatgatcaacatctatacctgtagcacaaatcataaaacaaggaaccaaaaaaaccccttcaacaacactgaggtaaacaagcattaccagtttcccaagcatttaataaaattcaacttcctttcccgatttttaaaaagtctaaagaatcacttgcacctgggaggtcaaggctgcagtgagcctagattgtgccactgcactccagaatgggtgacagagtgataccctgtctcaaaagaaaaaaaaaaaaggctgggtgcggtggctcacgcctgtaatcccagcacttcgggaggccgaggcaggtggatcacaagttcaggagttcaagaccagcctggccaacatgcagaaaccccgcctctactaaaaatacaaaaattaggcaggtgtgatggcaggtgcctgtaattccagctactcgggaggctgaggcaggagaatcacttgaacctgggaggcagaggttgcagtgagccgagattgtgccattgtactccagcctgggcgacaggagcgaaactctgtctcaaaataaaaaaaaagatagaaatagatgcatgcttgcttaacatgatctttaaaaatacatataacaaaccaaaaggtaatatcataaaaaaagtttaagtactagaatcatttccaaagtcaggaaaagagtgcccaatgttaccaatacattgcaaatagtagtcagcttaatttcattctttatacaataaagttacaaatactaaaggtggcaaaattatctttgtttgtatatgattatatatctagaaaaccctagaaaatcaactgaaaaattattaaaaacaataagagtaattcaatcaacagtcggtaggatgttttggggaaaactggagtcttctggaagaaaaataagttgggaatctaaacttcacttctttcacttagactccaccatgcataaagatttcagtttaaagcaagataaacctaggagccataaatgaaaaaaatgatacactggtcttctatacccatatttctcgctatattggaaacaacagtctaggggtaaaaaaattccaccatacatatcagaaatgggagtaagaaacaggaagaggaaaggaggaaaaggagaactaaaatagataacctagcattggtatgctagagcttgctcatagtggctcacaagagtcaactgataattcttgggaattcttgaaatctagttgttaaaaacaatcattattaattaaattatataaacttacagtcaataaattataatagggtaataaacactcaaaacattacttcctaattattttgcattttattatttatgctgtaggaagttatttacatctatagtatggttatgatgaaaatactatacaatgattgtacaactacatttctcaactttgttcaatagcattaagttgtaggattgaaacaggccatggtggcagtttttacacaagcaaaagacactacaaatcaaggctctctttgccacatatacaaaccagttaatattttccagaataccataaaatattcatattctttgacccagcaattcaagctctaaaaatgaatcctacagaaataacttagaataaaaaaagctgagggatgtttgatgatatttcatcccatcatataataacataaagtgaggctaggcattgtggctcacacctataatcccaacactttggaaggctgaggagggtggactgcttcaggccgggagttcaagaccagccaggtcaatatagtgaaacccaatgtctaataaaaatacaaaaattagccgggcatggtggcatgtgccactagtcccagctacttgggaggctgaggcaggggaattgctcgaaaccagcaggcggaggttgcaatgagccgagatcgcaccactgcactccagcctaggcaacagagcgagactccgtctcaaaaaaacaaaaacaaaaacaaaaaacttaaatgccctaagattggataaattatgcagtcttttaaaatacttaatgacaagagaaaatgctcatgatataatccaaataattaagagctaataaacaacggagaatgcaaaaactacataacagctacttcgtaaaaatacatacattttaaaaatggaaattaaaacttgttttatttaaaatgccgtaaggaggcatttctgttagaagaaatgctaatatttggaactaggactctctgaaatttctttcctcaagctccaatttcaccactatgcattcccacattttttctttccctctagttacaatgaaagagtatccctcgttctagttcgtgattatcagtctaacatggatctggaacccatttcttcccatttcttacagaatctctgaattatatcctctgcccctgtatcttcattcaccctgttaaaaaaaaatcatcttcctatatttccttcccagaaactaccaaatttcttttcctcctccttacaaaaaaaaaaacaaaaccccaaaactatttaaacatgtttccatttctatagctttaatccaaaccactccactgaaactattaatgccaaggtcactaatgtccttgtcacttaatccagtggattattttagttctttcttaggtaataccacagacacatttcactctatggccactcctgtcattttcatcttttgcaggaataggttcatgacactaacctgctgtttcattaatgaacaccttcatttcagtaaatatttcatttcaacataaaacaaactaataatgcatatagtagcctgtgaataatagaattttgaacatttgaaatttttatcaatgcttttctgtatttttaaaaacttttattaatattttatagtgaagaaatacatttttaattttaaagaaaagtcaaaggacaatgaatatgattaactgtaagaaggaataagtaactggcaagttgtacagctgcatatacccttttaacataaacaggcaaatgacacaaatatgatatgggaatttattttttttaattccaagttatattctcaaatagtttttttccctttcttatacatgtattttatattttattttatttttagaggtaggagtcttactatgttgctctggctggtctcacactcctggcctccagcgatgttcccacctcagcctctcgagtagctgggattacaggtgtgaatcatcatgcccagctatttttaattgacacataataattgtacatatttgtagagtacaatattttgatactcaaatagttttaatttaggcatctaaaatgtaatagaattacttaccagtatgataagcctgccttatcaaagaagcatagtttgaatactctcaatatatttaataaaattagtattttttcaaaagattcctgtcacaagaggttgaaacaaaattacaaccaaaacatgacaatgctttaaaaaattgacctttagttatctagctcaacattccttataatagaaattttagagaatacaatatcacatgaaaatatggtatagataaatgttgatgggaagttgggccttaacataggcataaaaggacagttttactagcagaaaggaatgcagaatcattaaatgtcaaaaaattaaaaatatgagaaataactataaaaagtttggtgaggagggcatttttcagcttaaaagtaggaaaattattgttaaatctaaagaactgaaaagttaatatattttgtgtgtgtgtgtgtgtgtgcgcgtgtgtgcgcgcgctaggagagagagagagccaggatcacactctgttacccaggctggagtgtgtgcatgcacaggagagagaaagagagagagacagagacaggatctcactctgttacacaggctggagtgcaataatagctcattgcagccttgagctcctgggttcgagcaatccttccacttcagcctcccaagtagccaggcctacgggtgcatgccaccacacccagctgatttttttttttaaattttgtgtagagaccaagatcttgctatgttgaccaggctgatcttgaactcctagcctcaagtgatcctcccattttgggcctcccaaagtgctgggattacaggtgtgaggcactgcacctggcttgataagtgatttttatttatttccatgggtagctgtaggattatttttagctcacttttaaagtgctgagattataaatatagaaataaacatgtatttttacccatgtacatgtaattaatttagttggtacctgcagtatattaaatgctacttggaacaaataaaatatttgcaaaaataatctatttcacaaaaggtggctcatattaaaatgcaaaaggtcaaattcaaggtactacgtcacagaacacttcattataaaaaaaaaacagctgggcccagtggtgcatgcctgtagtcccagctactcaggaggctaagatgggaggatctcttgtgcccagttcagtccagtctgggcaacagagcaagaccctgtctctaaaaaattaataataataaaaatttaaaaacagtaaacttctggtcacattcaatttagcttttcttcccaggcatgccttattcctaccttcccatttcacacacagtacaaaaacattttcacgttctttaaaacaattcttctcttttgtgagttttggcaagtgtacctacaaacaggcttcctgcagcgggaagggcaaagagagcttttatctaactgtctaaagttattacatgttctcttcctggaccaagtgtttactattcacactgcccttccctaacccttcaacttttacttcaaatccccaaggcatgattacagataagagttatttacccaacaagctgcagaaaatattaatgacaaggcacagaaatttaatgctaaaatacttacactactatggacaaaatcttgatatgttccaaaaggacttgattacataacaatgctccactctgactgcatttagaaaccttatttaaaattgtctccttttttgttgtttctgcccaaaccctaagaacacttaactttggctccaaagtaacccctcttttaaaataaagagatttgacccacaactctgtcagttaatgttgccttgcagagcctgtttttctcagcatgctgcactaacaacccagaaacgaagaaaaggtcattttgtgacttatacacggctcctgattttttcaaatgttgaagataggttttggtgcttcctatgtcatcacaatggtttatgttaacagtaatacattacccaaagatcagaagcatgtttcaacaaccatgtcatcatagaaaccagaaaagatagtaagcatggctttgaactaaacttagacactagataactttttatttccactgttttccatctttaatttacctcaaaacttatccttgtacaagataaaaaatggttacataaaagttttaaggttttcttatgacaaatctcttgcaagtaaatgttcatcacaatactgcaaataaaacatttaatatgcaataataataaatttcattattattatgatgtagtaataatgaagttaggaaaagactaactactaaaatttattgtccttggccaagacattatgtaaaagatctttcatacatttgtgttttgaaaattttttaaatctttcctttttcatactcttttttagtgggatttctatttttttttttttttgagacggagtctcactctgtcacccaagctggagtgcagtggtactatctcagctcactgcaacctccgcctcaaaaaaaataatttttatatttttagtagagacagggtttcaccatgttgaccaggctggtctcaaactcctggcctcaagtgatctgcctgtctcggcctcccaaagtgctgggattacaggcatgagccaccacgcctggccctcctttttgtccttatggatatgcccgttactggcagtccagcagtctgcttgtcttctgcattcatccgaaggaactaaaagaagtaaaagtgttttttgagccagagccatcatcatggagaaaagggatacacatatatcaccctctgctctctactcaatgttcttagcaggggggatcatgcattagatttccagaaaaactgttcacaaaagcataggaaaagaaccaaggaaaagggaggggttctggttaatctcaaaacagaagatttgaatacctctaaccagaaagggtagttttgtcagttttaacccggccttcacaaataagcctatcactgaaatggaggattgaaactgattaacccatcttctccagaaaaagccaagcagtcaattttgaaaggaaggatcccatgacattttcttttccttctagtggaagaggtatgggttggggtgaccttgaaaaggcagaaccatcccagatgtcaaatggattggctctaatatagagctctagctctatatttgttctataataggcttatgcagtccttcttttcttggatcttttcttcctgatctgtgaatattcaaaatttaattgttcttgatctagttcaatgctacctaaaccgaagggccttttctaattattccaatgagaagccatctctctcctactatgaacttccataaattgttatccatagctctcccagagcatgcttggagatagcattcaataaaagcttaaagaatgaaggtagatgcctcctccttttcctattattaatactagaataatacaaatgtatcaaatatgtgcaattctgtggtggatgtcactgagtcactttactttttcaaacaacgtctaaattttctgttttgctgggttactaatacagtatagaaaaattcagtcaggccaggcgtggtggctcatgcctgtaatcccagcactttgagaggccaaggtgcgcagattgtttgagtccaggagttcaagagtaacctgggaaacatgctaaaaccccgtctctacaaaaatacaaaaattagccaggcatggcagcgtaagcctgtagtcccagctacttggcggactgaggcggtggggatcccttgagctcaggaggttgaagctgcagtaaactgggatcgtgccactgcactccagcctggacaacagagtgagaccctgtctccaaaaaaataaaaagtaaaaataaaaatccagtccattaactcacccttcttcttttctaaatataattatgtaatgagaaccagaaaaggcagacaaataaaatcccaaacctgcattttagtcaaaaactaagaacccctcttcatcaagaagtggggaaggcagggaaaaccagatttgtttgaattttccttcctttattctgtgatgagatgctaaagagcagagaaataaatgaaaggacaatagtcaaaagggagtgaagaagacataaaataatttacaaaatgcctgatataatctcaaataatggaaagttaactaattatagttatgatcctatgcaactcaaaactaaaacacaatgcatcatcctttaataacctttggatttgttgtttaaaaaaaagtacagcctactatcagctggattaaatttggccatatattctgttatattacaaacctatccagccatttctgaagccaagaaagagtaaaatgcactcttaggactggtactcaaccttgaagtgctgagagctacttcatcatctagtgtggggacaaacacatacatgcacatgtgagcctaacaccatgtgtggaaacgcatcattgtaaatcactcaggtattcacttattttaatatacacaaatcaaagcacagctccctgtgattcctaaaaggagagctgaaatagcatttaacattttctcctcccacccttctcactaaaagcttgagacacaaaggtgttctcctctttccttacagttattactgacaacatgcaggaaactattatagctggcctaacttaccaataccacctaaatactgtaagagcatacctgtgcttaatactccagaagtgactcaaaaagcaaaagagactccttattagatttcttctaaaaaactagagtaactctatagttttaggattagcattattctaatccagttataaagtcatgccaattttcccttctatcttgctttacaccaccactcataagctaaaagtattatactacttttctacatattagatgacattgttttagactaattaatcacaatctactgttaatgttgtttcccaaaactatgtataactagtaaaatattattagcaatatttccaaatccaggataattctgttattgatctatggacaaaatcataaaacacatattccaaaaattacaatagttgtataatctaggtttgtttggttgattctggccgtgacaggtaggacatgaccttttacacttgtttccttcaaagcttcttcattttattcagcattaagtttaaattaaatatttaaaattgaacctgttctgtgttgcaaacacagctaaaataaagagcttctgtagcagcagtgaccagattttaaatgcaggtagatcaataaaaaaaaaaaaaaatcaccaagcacaggctccatgtgagtggaatggtttataatagcttgcaaatgactatgtgcttgctgtaaccagctgttcttaaattatgaatatgcaaccaattcatgttaaagccaaatcccagcactatttctacagagaaatcccagtagttttgcttgttctacatgttagctgtgttaaggatacaaatagcagtaagcttctgaacaaataggaccgaactattggcatttcatgcactaggtccattatcacagcaggcaatgtcaatcattggtacattcctataacagctcaggcaatatgacaatgatctcataggaaaaaaaatcaaaatctctgcagcatactcaaagtccttctgacaacctaatgctttcttactacagccaatcagattgtcagacctgacctactagaagactttcaccaagcttgaaacatttaaaaacatcaatcataaaaacaaagacaggacactgaattatacagtattaacctctagggtttgcatacaaagaccttagatttatttatgtcctagcgagttaagagcttcagtacaccgttctttacaccaaactgactgccaatttgatgaacctctctgccctcagcaggagtgcaccgtctttgattaatgagtgcatgtttgtggaaaagtgttaagaggagaaaacaggaaaaaacacccaattatgtctacacatagctgaagtactaatccaagaattatcttcaaaccaaatgctcctttttcttatataccatgcacacatgtgcacaacacaaaattagtaaaggttcttatctatgttgccatcattattattatccccaatatgcaatagtttttatttgaatgaaaggcattcaaaagccaaagtacaagttgaattttataaattataaaaactatttttaaagcgttatcttttaaaacaaattgaaatactcttaccttatatagtaaaaatttaagtatgtggaataaaaactatattttcacctcatattcttataaaaccctattaaggttaaaaactcaatgtttaactgtaaatatccatacttttaaatattttatatttcaaactctattatgactgccacaaatcaaatagcactcaaaatacatttaaaagtcatatatattcatttacttttcctgttttcaataaacatgtggccaatattttataactcaatatgcagttgaaaatgaattaaatatatttattacccataatttcatacttaatacggtcaacagaaaaaactgtaaatcaaagtttgaacttttaaaatgacctttctattgagaattaccttccttctagaaatctgatgcctgaaaattcctacttaaactacaggatgtttatgtgtagtacaattaagactatattatctctaaagataaactaagcatcaggagtcctttaaaaaaaagttcacatttcatacacaattcaatgttccttaatttgatttatatgaatatctacctcaacaaaaatatgttatgagtaaatacatttcttaaatattgagtcatagtcaaaggtaacagaatgattttctttttaaggagttgtatggctactatgtaaaaagggttgagaaagcataatgtctgaatataaatcttagctttagtcagtaatgtacaacctatttaaaaggaaagggtccctataaactttgatttcaggaaatcataattctggaatcaatggcataagtgttaaaaatttatattgtagaggaagttttgagcaaattatatattctaatcaatttcatattttaagtatttatttttgtaatggcaaattattttaagtgttacaaattttatgctctttgaagaattatttaaatgcctaatacacctaaagacctacaaattaaaagtcaataaatattgggactagaaaaattctcttaacatagtaataaataaactatattatatccttaaatcttatttacatgaattttttaatggatgtttctgtgttgggattatcacttttcattcttcctcttttctccctcccatttcctctaccaccaaaaaacaccatgcaaataattagaaaaagtagaatatatgtaggcaccaatgggatgacaccattttagtatcacatatttagtatgacaccattttagtatcacatatttagtatcacacattttagtatgatagctgaaactatcaataaaagttataacaataaaaatataatttcattttttaaaaatcattaaatgtctactagtaagttattttagatcatagtttgtatgaatttttaaataacattttagcctcattataaagaaaaattaaatacaaaactgcctctttccccaataattatttcttttcttttgtgattacttcctagaacaaaagtttaaagaaacagccaaatggattaacatttattaaaaaggcaacagtatttttaaaacttcatggtaaaaaatacttaattttatgtaaccaaaaaaactcttaaaatacctaactaggtaacttaattaatcccccaggaaatcaaatatattaataatcactaaaacttgatgacgtaattcctcttaagggtcaaaatcaccatattaatttgtgctaaatcatatctcttcttttggtagttctactcagaaactacaacttaagatcccttctctgagaaacctttaaacctaaaagtaatcaagttccaaaatatactttcactaattcaaggagataagacagaaatcctgaactttcatgcaactgtgatatcctacatcttgtatagtaacacaaaagtagcaacaaagacattaacaattgcagttcaagctgggaatgactgttctgtttcaattcaatgacaccactaatggcttcttagcagctccatgaaatcaaccagctgtcaagttgatgcatcagaaggaacagttatgcactcccataagaaaaagcaacacatcaggatgtttggcaaaacatctgctcctttacactgcagttctataataaacatgcaaacaaagaaatgggagaaagggcaacagaattaaaattctaaggtttccattacagtcttatgtgcattttaaatgaatggcttataaaaaataaaaacaaatttctaccaagttgaatactttaagctattcccaattttttgaaaatgctaaatataattactcagagactgttctagaaagaaaaaacctgcataagaatccatctattctaaaaattgtaaataaacaatattcaagtaaaatcagtatcataatgttatgtataaaactcaaaaattaaaactaaaatatatccttccttcatttaataagtatttcataaatgatgccagcagtattccaataaatgcatttccaagactgaagagtttagaagtattttttcattagtgtttgtaagagtaaatggtactacaattcggcactagtttaacatgtgagaacagtgaagctactattatctggattttaaaatatgtacccattcctgtttctctccaaccattataagaacacaatattaagttctcataaataactttgtatttttaaagcatacaatctgattttctaaaaaaaaaaaaaaaaaagactcttcatcatcgtaggcttaaaataattttaaattcaaccacttgtttcaaatacttgtaaaaattacttttttctatctgaaccatacgagtgtcttaatgttgtccaaattactgattatgcagcagagtgacaataatatgtacagtgtttacaataggtgtgagacatcaaatgtacttaactaccattttcttaaactgcttatcctctgttgcttgccatttataatctgccaaatcttctagtcctttgttgcatgtataatttagaaccatctgttctatgtgcttttaactatttaaacatttttcacctacctacaattcacataaatggcagacactcaactcagtcaagctttctatatagcatattacatgaagcaaattcctggataaatagataacaccaaagaagactgctacagaaataaaaacttaccatatagaacataaatttctgtgtgttacacaaaccttttcaatgtattcagaattgtttctattagctttttttaagttaattgtagtcagtgtttttccctcaacccagaagacaaagagaatgcaaattaaatacagacagtttcatgtccttgttagaagagatgtaaatatgctgactgaaaatgactacaggagacagaattccactttcccattcaatatacagtgcctcttatttatatactagtcagtgtatcattaagcttggtcatgtgaccaaaccaacttttgtgaggcgaaaaactatgttagacaagcaaattaaaacagtgctagtttttgtttatctgttcataatggctgacaaagagtttatagctagcgattataaaataacttttaaaatcaattctgcctcttaaatactcaataattgtttgacttaatatctgctactaaattttaaagtatccattatcttaaggtattttccatagtcatttcttttcaaaatgtaaataaataatagaaaaagaaaaccccagaacattttattagaaacggggagccagataatctaaaataaccatacataaatattaaccaagctaattttcaaaaaatccataagggagagtggagcaaataagaaagggaatatactgactacagataacagttgaaacctttaaattaaaaaaaaaagtacacaaaaaccagataaataacaaatgacgcacaagttttttaccattttttgcatataatcttccacctgttaccaaaacatacaatacgcagacttcgtatactgattttgagagcaaaacacaaaaataagccacacaacttatcagtaacctgtaagttacacaatcctataaaacaggagaaaaattaagcaaaaaatttactcttgggaaaatttctccgtaaagtttacatgacgtcactgggccccctgaacattccctaaactttgagacttatccagacacacttcctaatacttctttcctttcctcaaaaataaaaaagagagagacttgggaataaaattgcccaagatggcgaaacgcttgttgtttagagggcaggaaaaaaaatggaggatattgtaatatacacaaagggataaatttcaacaactcggccaaggactgcagctgcttccctctttataaggaagcaacagacaaaagataaatacagagggagaaagaaaagaagagaaaatctcccaaacaacagagccagctctgactcttcaaacacttccttccccttctcaaatcccaattctggggttcgtgaaactacttaaaggggagggagccgcgaaagagaacgggggctggggggaggggtagcgacaagaagattaaaagagggaagcagaggagttgggagctggcggtcgttcccggggaagaactgctaaaacatgagaccaaggcacagaccttactgtatgagaagcaatgctcctcaaaccttctgcgtgctgacatagaccttcccaggtatccagatcttttcccaatcccacctgccccacccccacccccgctcatcttcagtaaactcagagcctccagctacacacgggagagctagaggcccaagccggggagtgggggtggcagacgcagctcgtcagtccgacagggaagagggggcggaggcaaaaaagggcagcaggaggcggacgggggtggggggtgatccagaaactaccccggcagggagtgggggagcagcggatattccggggtaggaacggccatcgcaacgctgacagaggttgttttttaagaagcaaaactgttggcggcgacctgagcgctggaagccgaaggggaagaggaaggagacgcgaagccagggcggccggcacaaaggcggcggactcgcggcggcagcgcctgcccggccgggagcacaacccacggccctactccagcgaagtcccgcaccggcttctaggaataaagtttacgttctcctgaggccgcaccccccacctcccacccaggacggcacatctccgtgtcctcctcccccaaactccactcgggaccccgagaaccaccccagccttccggccaccacaacaaagagccgcaccgaccggcgaggataaacagcggcggagggcgagagggcggcggggcgagcgcctccacgcagcaactccggagtcccccgcttgcccgagcgcagtttctccgctgctgtttccaccggctttgtaacactgggaatttacatcctcacccgcacccctcacgcccgaggattttaaactcacctttactctcgaactgagagttgcggtagatgggatttttgccttttccccagatggttgaaggttaagatttttggaaaccccaccacctccttatttctattattatttctgcaagaaaagtataaagagagttgtagtggaggtgagatttgtgatcgggaaagccttcgactccctccttctccgtcttccgcctctctctctctgattagttcctatccagcagcagattgaagcaggagatgattcttctcaaggtttgttcagcagcttcacttctaggcgaaggcttcatgaaccaagt

SEQ ID NO: 1545 - DNA, 3148 bp, Homo sapiens
ttttccactagaaactatatttacttataaagggaaggcaaagacaagaaaagatggctgcagattaaactttactcgtgtcaacaagtttactgtaggaaggatattttaagcaatttttttcaattataaacttactttcaaaataggtatttttcatgccataaatttgaatgaaattaacacaagtaattttatgctgctacagtttttattgttcattttccaacctgtattccaagtcttggggtcccctttaatttgccttattgacaaagctacttcccgctgcccacccttttctaaagtatgttcttccaaaaccatgtagcttctgattgctagcttaggtacaacctgactacagttcaggaggacgttgttttaattctatatgaaaaacactttctatttcaagagtgggagcctgtccatcattggtattagacaaatctttaaggacagaattgatttttgaaacctcttcaaattttgcttcaccttccaaaacaaccgatcctaattttactgctggaattcctgccacctgcggtgactgaaattctgtagacacattctctaccagagcctcatcttcaggggtttgttcagatggtggaggtgaaacttcagcagaggcctctcctataggaaactcctcagtcagaagcaaatcagctggtggggaatgtttgtcaacggaggcctcttctgcagggacatcatcagctgggggagagtgtactgcagcaagggtctcttctataggagtctcctcagctggtagagactgaacttcagcaggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcgggggcctcctcagctggtggaggctgaacttcagcaggagcctcttctgcagaagcctctgtagctgctagaagctgaattgcagcagaggcctcttctgcagtggtctcttcacctgatggaggctgaagctcaagaggggcctcttctatagaaactcccttagctgatggagactgaacttcagcaggagcctcttctgcagaagtctcctcagatagtggagactgagcttcagcaggagtttcatctgcaggagcctctatagctgctagaagctgaatttcagcagaggcctcttctgcagtggtctcttcagctaatggagattgaacttcagcatgagcctcttctgcagaagtctcctcagatagtggagaccgagcttcggcaggagtttcatctgcaggaggctccgtagctgctagaagctgaatttcagcagaggcctcttctgcagtggtctctttaggtaatggagactgaaattcagtaggagcctcttctgcaggggtctccatagctgttgaaagctgaagttctcgagcctcttctctaggagcctcttcaggtaatagaggctgaacatcagcaagggtctcttcaacagtgggaggctctactttagctggggcctcttcaagggcgccctcagctggtaaaggctgtacttcaatgggagccttttgtgctgagggagaccgaatttcaccaagaagctctactgaaggagacttttcagctggtggaggcagaatttcagcaggaggctcttctgaaggggactcttcagctgatggaggcagaatttcagccagaagctctacagaaggagactcttcagctgatggaggctgaatttcagcaggaaactccactaaaggggcctcttcagcaggtggaggctgaactttaacagaattctccgcaactgcagtggctgcctcagcatcaggagtctcttcagttgatggctgtacttggacatgggtctcttcagcaggtctgggctccgctttagcagtggcctcttcaactaatggaggctgtattttagctgggaatttttctgttgatggaggctctatttcagcagaagccacttttttaacagcagaaccttcttgtacaacaggtacagttacttcttccctaagctcatcttctaaaagtaccgggggaccttttttagtctcctgagtaaatgaagttctgctgatatttttctgcccaatttcttcattgctgtttgttgctggttgaaattcagggtgttcactagcaaaaatctttcccgacgatttatgtttcagggcatcttcctttgactttgtagaagaactatctggcctggaaataaccactatttctgattcactaaagtatgtctgttgttccttgtccactttttctacaggggggatgttcatcatggtccagtatcctgtacggctggtctgctgagatctgtccatttttagttgaactgaaggtatgtttggtggaatttctacatcctgaacactctctggcaattcaatagcagcttctctaacatcagctgacttttcttcaggtaccacggtttcctcaactaacttgacttcttttttctcttctacaatggtgtctgtctggagagacttactagtcatttcctgtccatgctttctctttgtccaagtttgctgaagctcagaagatactctaatagactcataggctttggcagagtagctgcctttgcttccagaagtattaccaatacgatgggtagctttggggctagatgattttggtatggccatgtgtttctttttctctattacatcagtttgctgggatttgcctaccattggtttgctgggtcatcttctctttcgaatttcttgcctacacgctgagataggctgattagagtcatcactttcttccatttctaagagtagtgatttcaaacttattaattttcaagtaatgaccaaaaatcacaaacgtaccaagtgtcaaagactttccctttcttaggtgtcattctgttgagctccctcagaaaaaaagtaattcataagctattgcattccatactacactcttgttggatcccaccttattcagtaagcgtctttcttctttagtctctgttataactaaatatcactttt

SEQ ID NO: 1546 - DNA, 123950 bp, Homo sapiens
ttgtttgaaaaggacccattcatttattcttccaacacatctgtattataaaactactatccataaggcactgtgttaggtgctgtgttcctgaccctacagatcccattccaccatagcaaaaggtaaaagtgactctacagtgagcttggtagacatagacccatgcttatatactcagggacacctggaagagatataaaaacagaaacatctcacataggaagttttcaatgcatcgtgatcaggactcaaataatccccttctctttttcttcagtgtactaaagggagcacattgttgagaaggaccggttgcaaatttccaaaaaggagagtaaaataattaatgagtcaaggtctcaggagagacagaaggtaaggggagtccttcagtaagtggggaaattgatttgttttgtgtcctcatctctccagggccatgagcatgtcctttgctggccataagtcaatgctgatgacctcagttatagtgtaatcttcaaggctaatttacgcaaaacttcagaaatggtaaacatcctcatgaagactaatgatgacatattttaggagtgcataatagtaggtatagagaaaaaactgcagggtaaaatgttattgctgttcttattgctaaagggcatactccttaagaaccaaagttaattatcagtcctttgacctaagaggaaaacaaatttcagggactcccctaaagattcctatgtagtacaaataaaatgccaaaatattttggaacacattttggagcactggataggtcaataaaataatgtgtaaattgccaaatgtgatctaggaactccctgcaaacatcagattaggctctattctctatctgaatactgactttgctttgctttgtaactcctatcttcactaataatgccttttcccccctcttgtgtgcatcctagcctatattctctttcatcattctacagtggtcaatgtggttattgtacagcttcactttcaatgaaagctgagggaaaagaagcctcataccctgccccccacccgcccccgccaatacgtaaaagaagccatttaaaaaataaaagcagcaagctactaaatttgactcattcaaatcttggcaattagcatgtatagtatgttatgagagagagagagagaaaattagcagaaatggaggaaaacatattacatcctaaataccaccaaattgccaaaatacacatttgggtagtaatctccagagaactctctggaggcacagcatctatcatgctgatttccctgaacaatattacagaatagccctgtgtactttctcttggggggggaggtgtaaagaattatcatatggaacctcacaagtctctaaaacctttctgcaattatccctcataggattaccacactgatgagtttgttcaacaggcgctgttgtgacttcctaatttaactcctatagagatgatttgtgtggaagataaaacactatatttgaactcaattcccaccttatccctgagcttatgctaccaagcaattcttacaatgtttggagttctattagactacagagaagaatctagggtttcagctaaaccctttaatccacaggcctaggtaaaggactgtctcaaggtagtcgctagcccatgggttctcaaagtatggtctgaagacccctggaggagtccctgagacccttttcgtgggtctgcagattaaaaattattttgtataataacaccaagatgagttacattcaattaggcatttttcttttgaaattaagcagacttttggaaactaagatgtgcatagccctgtagtaggctaagtggaagttacaaaggcagtagtagctttttttccccctctcgttatctcatgaggatacagaggacttttccagaggctacatgacatatggttatgtcatctctctcatagctgagggatgtgtgcttctgtgttcttcttgagctttaaatatttctcagtcttaatacctaaaataattagtatcaatagatagaacccacacccaagaactccttggggccttcaataacttttaagagtgttaaggtgtcctaagaccaaacattttgcaaattgttgctttatcaggatttttgttatttctagaatgcatttctttctaactgatctacttgggaaaaaaatcgttacctcatggcaattattgctttcctatcaatatggagattatatttctgaaggagactgaccaaaattatattaaaaggtttaaatcaaacaagtggatccatgttataacatgaggaagagagctgccccactagatgtctgacattagataactcagagtcccgcctctccaacaagtctcccttactagagaaacggacagattctgttttgtgggatgggataaggagacaatctgaagtagagtttgacacaatattattctgcccatatgaaattctggtagccagggtgccaggtgtattcataatccagatgctgtcaattttaagcctgaagccccaagaggcgagcagtgtttaatacatcatctcttgttaaatagcagccacacagttggcggtagccagtgaagcattccctgccatgtaggacacgccagttgtctataaataggacctgtgaatgggccaaaaaaaaaaaaaaaagagagagaaaacactgtcagaagaaggacagaccaaaggaaccctaagtcagaagagatcatttaaaagataacctttaggttgttttctggttgcattaaatgagatatttttcttttgaaattaaacaaacttttggaaactaagatgtgtatagccctgtagtaggctaaatggaagttacagaggcaacagtaggtaatgggccctgcactggaggagcttctgtttctcaagtaattgttctcttatcaaagtaaatcagataattggtttgtttctttttctttttctttaattcttattctaccctttctcaaagggttaaattatctcatgacattttatgctaagctgaaggtatttttcatccagaggaaataccaaaaataaaaactatggaatcatgaagctggaaggacccttgggggtcatctagttaaaccccttcatcatacaaatagagtcactgatgccttagagatgggatgaggcttgcttccagagcattcagtgagtgggcggcaggaccataaacaaaaccaaggactcttttctctttttcctttgcaacatcgtgactcacatattaagtaagtacccgttcttcactgcttcagtattacaagcttgcttgacatctttagagattaggacccaccctgccaggctttagtttgacccaaaactcattctcaggtctcctcaactctatcgttagagtccggtgtgctgtataccagcgatggacgacatcataaggaacggtattgatgacagcccggtcatagttgttgtacctaacatggaatcatgagaagaaagatctcaaacacatgttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 1547 - DNA, 120427 bp, Homo sapiens
ttaaagacatcttttgtttattgaacaattttatataaggcttcccctatgttcaatacttgtcccagagacgaagtgacgataagtcaatattctctcaggaatatcacattggagtgaggagttccactgcctgttgaccgtgttttgtttttctttgaataatctaaggatacgggatagaagttaagttccaactgtttctctcatcttatgatatgatattttaagtctttactggccaaaggtcatggaagcactggggaaagcgctgagctttctcctcaccaagctgaggtggggtggacaagagaggttgtactaacaaagctttccttttaacaggatgacttacaacttaagtgtctccctttgtgggaggaatcccagctatagcctagtggaccattcacccagggatcttcaatcattcgttcaaccctaacatttatatgcgcaccagctacatgctaggcagtgcgtcaggcattaaagatacaaggacgaatacagcagacacgacctcagtctttggacagagtttaccttctattgaggaagatagatgataaacaagtaataaatacataaacaaagtaatttcagctagctataaatgctatgaaaaaataatagtgttatataataaagagcgactgggaaatctatttcacatggagtgttaagtgaaggactttttgaagaagcgacatttgagctgttacctgtatgatacgagaccaacaatgtaacaagctgaggggagagcattccaggcaaagggaaaagcaaaaacacagccttggagtggaatggagttttattctgtttgccgaccagtaagaaggtcacgtggctggagctgagtaagcaaggggaataatggtgggagaaattacgtggaggaggtagtcaggggctagatcatgtatatattgccatgcaggccatggtaaggactttggattttattctgagtaccatgggaagccactgaaaaaccttgcctaagataatgggtttctgttttgcctaaggcaaattaactttttactgaagtatactatacattacggaaaaagtacacaaatcgtaagcttgatgaattttcatgatgtaatcgcatccatatcactagcacccaggtcaataaacagatcattaccagaaccccagaaccctcccttatgcccctttccagtaacgcccatcccccaacccacgggtaactaccatcctgacttctatcaccaaagattagttttgcctgtttatataaaactttatataattgcaatcacaatatgtattcattttgtgtctggcttctttcatttaatattatgtttaggagtttcatcattgcttagcaatagtttattggtgctatatggaagttgagtgcgtgatcacaccacagtttatccattctactgttgatggacatatgagtaatttccggtttggaactactacaaacagtgctgttatgaacattctattacatgtcttttggtgaacaaatatattcactcctatttgaaataaacttaagaatggaacttatggatcataaggtatgtgtatgctcagatttactagatactgccaaagatattctttccaaagataaattaacatccaatggtgccatttttggatatctcaggcaatattccttagtgttagatagtacatggcacaatcagagccaacattcttagttttgttgcatataaaatgagcataataacatctgcttagctgatctcacagggctactgcaagaatcaaatgcaaaaataggccgggcgcgatggctcacgcctgtaatcccagcactttgggaggccaaagcggtcagatcacctgaggccaggagttcaagaccagcctggccaacatggcgaaaccccatctctactaaaaatacaaacaaaacaaaacaacaaaaaaattagccaggcgcggtggcacgcgcctgtagtcccagctacttgggagactgaggcaggagaatcacttgaacctgggtggcggacgctgcagtgagccaagatcgcgccactgcactccagcctgggcgacagagcgagactctgtctcaaagaaaaaaaaaaaaagaaagaaagaaagaaagaaaaagaatataatagtccatcctcccaggcttcaaggagccatgcctggagggagaatggagtgaggaagcacagtcttcaccaggctgttgacacccattgtcatttccagaaacttctagtgctgggttaggcatttgtgaaaatattatttaatttacttatttcatcatcccagaaggaaaggtgttattaacctccttttacatttaaggcaactgaaacttagagacctgccacagagttcatacgtagcagagaggttttgaaatcaggtgtccttaattctttaactcattgtttataccagagaacagaaaaatgatcgtaattcctgtgtacgcttgttcatgagagcaacatttttacagatcacacttacaatcttttgacttcaaactgagatttgcagtttagaaatgtttccatatacactatctgattgaccctctgcatgataaccacgtgaggtaagtagtacagctgttattgtcttactttatagataaggaaaataatgataagaccttgtgatttgtccaagcttacatggaatttggtattcactatttatattagatggtggtgttttctaaagccaacagagaaagtagcaggaaaagtctattacacataagcaaaatggttgtgcaatactttggattagaataagactatttctggactttggcacaaagtgatgccatcatattattgtgcagtttttcctttttttcctgctttgatatgaagcaagagagacgtgggagtaggggaaagcaaataaagcaggcatttatctgacaagaaaagctaggaagatttaacaaagttatccttcttcttagttgacagacaagtatttcccaagagagctccataattgagcagacgatgcatttgatggatttgtgtattgtggtgtaagtgaaagctggtgggctttcagataggtagataaataggctttcagttagatcaccattacaatctcagttcaggtgtgtgaccttggaggagctatagaaattataaaaatgctagaagaaaacctcgggatgactctccaggataatgctctgggaaaagattttattccccaaaagcacaggaaacaaaacccagaaatagacaaatgagactggattaaactaaagagtttctgtgaggcaagggaaacaatcaacagagtgaagaaacaacccacagtatgggaatatggccattgtagaatggctgttattacaaagaccaaaaatgacagacgttggcaagtatgtggagagaaaagaactcttatacattcaataaacggtgctggggaaactggatgtccacatgcagaagaatgaaattagacccttttcttacaacatatacaaaaatcaactagaaatggattaaacgcttacatgtaagacctgacaccgtaaatctactagaagaaaacacatggtataactctatgatattggtctatacaattaccttttggatatgatccaaaagtataagcaacggaagaaaaactaggtaaatgaaattgcatcaaactgaaaagcttctgcacagcaaaggaaacaaaagaatgaagagacaacctgcagaatgggagaaagtatttgcaaactatacatctgataaggggttaatatctaaaatatttgaggaactcaaacaactcaatagtaagaaaacaaataacctgatttaaaaatgggcaaaggatctggatagacatttctcaaaagaagacatacaaatggccaagaggtatatgaaaaagtgctcaacatcactagtaatcagataaattcaaattaaaaccaccacgggatatcatctcatacgccttaggatggctattattaaaaagacaaaagataacaatgttgatgaggatgtggagataagtgaacccttgcacactgttggtgggaatgtgaattagtgcagccattatggaaaacaatacggaggtttctaaaaaaagctaaaagtagaactactacatcatccagcaatctcaccactgggtatatacccaaaggaaatgaaatcagtatgtccgagagatatcttccatgttctttgcagaaatattcacaatagccaagatataaaatcaatctaggcagaatacatgggagtgtatatagagaaaatgtggtatgcataaaaagtggaatactattcatccttgaaaaagaagaaagtcctgtcatttgtgacaacatggatgaacctggagaacattaagtgaaaataagccaggcacagaaatatcaatactgcatgatctcactcatatgtgtaatgtaaaaaaaaagttgatatcatagaaatagagagcagaatggtgggtactagaggctggtgggttgtggagtagtggttgggtggttggggatatgttgctcagaggatacataattttagatcagagaaataagttcaagtgatctatttttccatgtgatgactatagttaataacaatgtatcgtaatttgaaaatttctaagaaacagtcaatcaacggagtgaagagataactcacagaatgtgagaaaatgtttgcaaactatgcatctacaagagattaatacccggagtatataaggaactcaaactcaataaccaaaaaagacatattcccttaaaaatggacaaaagttctgaatagacatttctccaaagaaggcagacaaatggcaaatgggtatatttttaaatgctccacatcactaatcattagggaaatgcaaatcaaaaccacaatatcacctcaccccagttacaatggctatcattaaaaagacaaaaaataggctgaaagtaaggatggttagtatgtacaaacacagagagaatgaataagatctagtatttggcagcacaataaggcaactatagttaacaataacttattgtatatttaaaaataactaagagagtagaactggagtgttcctaacacaaagaaataataaaggcttgaaatgatagatacctcaattatcctgatttgatcattacatattgtatgcctgtatcaaaacatcacatgcactccataaatatatacaactattatttacccataataattaaaaaaatcaaaatttaatttaataacataaaatataataaagtgatcttaaaagaaatttgcccgtggttagatattacttgttacactttaattgatgatttctattataatttcatagtacttagaatatatatatatattagaaaatatcatctataggatttttgctttcatgagggtaatgatattttaagcctaaaatattagaattttcaataattttctctagtgtttggaaattattttaatcctctgtttagtgctcaaaaatgctgttcatttgtgactgattagttaaactttctaataaagtgattttacactctttatgttaaagaaacaacaaatgctggtgaagatgtgtagaaaggggaaatcttatacattgttgatgggaatgtaaactagtacaggcaatatggacaacagtactgaggttcctcaaaaaattaaaaatagaactagcatatgatccaaagaactcactactgggtattttaaaaggaaatgaaatcagtatgttggagagatacctgcactctcattgtgatggttcaatttacgagtcagcttgactggattgagggatgccaagacggctgttgaaacattgttccctgggtgtgtcggtgagagtgtttccaggggagcttggtgtgtgagacagtggactgcaacaggtaagatccactttcaatgcgggcgtgcactgtcctgttagctgggagcctggttgggacaaatagacagaagaggaggaattctctctctctgctcatcctatctcccttctgcagccagatttctttcctcctcctgtccttggacatcagactccagtttcttccacttttggactctgggacttgcatccacagcctccagtgggctcttaggcctttggcctcagactggggtctgtactctcagcttccctagttctgaggcttccagacttggagtgaatcgtgctaccagcttcttcggttctgcagcttgcagatggcctattgtgggacttctccatctctataatcatctgaaccaactacacctcataaatcctctctcatatatcctattggttctgtctctctggagaaccttgactaacacacccatgtttattgcagcactattcacaatagccaagatatggaatcaacataagtgtccatcaacagatgaatggataaagaaaatgtggtgcatattcacaatggagtactattcagccataaccaataatgagatcctgtcatgtgtgacaacatggataagcctgtaggacattacattaggtgaaataagccaggcacagaaagacaaactttgcatgtgctcacttatttgtgtgagctaaaaattaaataattgaaatgaagatagagagtagaagggaggctgggaaggttagtgggagggtgaggaggaagtggggaaagttagtgggtacaaaaaatagttagaaagaatgaataaagcctagtatttgctagcacaacagggagactgtagtaaaaaaataatttaatcatacttttaaaataaccaaaagagccaaatcatgagtgaactcccattcacatttgcttcaaagaggataaaatacctaggaatccaacttacaagggatatgaaggacctcttcaaggagaactacaaaccactgctcaatgaaataaaagaggacacaaacaaatggaagaacattccatgctcatgggtaggaagaatcaatatcgtgaaaatggccatactgcccaaggtaatttatagactcaatgccatccccatcaagctaccaatgactttcttcacagaattggaaaaaactactttaaagttcatatggaaccataaaagagcccacatcgccaagtcaatcctaagccaaaagaacaaacctggaggcatcacgctacctgacttcaaactatactacaaggctacagtaaccaaaacagcatggtactggtaccaaaacagagatatagaccaatggaacagaacagagccctcagaaacaatgccgcatatctacaactatctgatctttgacaaacctgacaaaaacaagcaatggggaaaggattccctatttaataaatggtgctgggagaactggctagccatatggagaaagctgaaactggatcccttccttacagcttatacaaaaattaattcaagatggattaaagacttaaatattagacctaaaaccataaaaatcctggaagaaaacctaggcaataccattcaggacataggcatgagcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaacctacttgtctgacaaagggctaatatccagaatctacaatgaactcaaacaaatttacaagaaaaaaacgaacaaccccatcaaaaagtgggcgaaagatatgaacagacacttcccaaaagaagacatttatgcagccaaaaaacacatgaaaaaatgctcatcatcactggccatcagagaaatgcaaatcaaaaccacaatgagataccgtctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaggacacatgcacacgtatgtttatagctgcactattcacaatagcaaagacttggaaccaacctaaatgtccaacaacgatagactggattaagaaaatgtggcacatatacaccatggaatactatgcggccataaaaaaggatgagttcatgtcctttgtagggacatggctgaaactggaaaccatcattctcagcaaactatcgcaaggacaaaaaaccaaacaccgcatgttctcactcataggtgggaattgaacaatgaaaacacatggacacaggaaggggaacatcacacaccggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaaaacttaaagtataataatcataaaacataaaataaagtaaaataaccaaaagagtataatttggttgtttgtaatacaaagataaatgcttgaggagatggatactccatttttaccctgatgtgattatgtactgcatacctatattagaacatctcatctaacccataaatatatacacctactatgtaaccacaaaaataataaataaaaataagataaatataaatttaaaagttgatgttatagaggtagagagtagaacagtggttaccagaggcaggggaggcgaggagggaaggagagatgggaagaggttggtcactgggtacaaagttacagttatggttagataggaggattaagttctggtgttctattgcacaatagggtgacaatagtcgacgataatatgttgtatagttcaaaatagctagaagagatgattttgaatgttctcactaaaagaataagagggggaatactacaatcaatctatgcctatatatttgataacttatatgaaccaatttcttaaacccacatggtaaaaaaaaacaaactaattcaaagaaaagtagataatctgaatagcctggcatgcattaaagaaactgaatctgtaatttaaaacttttcaagaaagagaactccgggccagacaatttcactcatgaattctatcaaacatttaagtaagatgtaatacaaattttacagtctctttcagaaaattaaggagagaaaatgaccccactcatattatgaggatagcatcatcctaataccaaactcagacagagatattacgagcaaaaaacaaaatagcaatatctcacataaacataggtacaaatattcttactaagatattagccaatcaactctagcaatgtataaaaaagataatgcatcaagatcaagtggagtttatcccaggtattcaaagttggttcaacattcaaaaatcaatcaatgtattttatcatattgtcatactaaatacgcaacatcgaatgatcatataaataaatgcagaaaaggcattcaacaaaattcaatattaattaatgataaaattcccaacaagttaggaatagaaggaaatttccttattctaataaaggctatccatggaaaacctacagtgaaccactgagtaattttcccctaaaatcagaaataagtcaaggatgtcctttctcaccactactattcactgttagtcctggaagtcccagctagtgcgataacacatgcacacacacacgcacacgcgcacacacacacacacacagagagagagagagagggagagagagagagaaatgaaaggcatacatattataaaggagaaaaatataccccattatgttgaaaaccccaaataatgtacaataaaactccaaaagactcttccagaagactcctagacttgataaagaacttcagtaaagtttcaggatacaaaatcaatgtacaaaacacagtagcatttctctacaccaatatcattcaagctaagaaccaaatgaagaacccatttacaatagccacaaaaaataaaacacctaggaatacatttaatcaaggaggtgaaagatctctacaagaggaactacaaaacactgatgaaaaaattgtgtatgacacaaataaatgaaaacacatcccatgctcatggatcaaaagaaccaatattattaaaaatgaccacactgctcaaagcaatttacagattcagtgcagtctctatcaaattaccaacacaatttttcacataattaaaaaaacttaaaattcatatgaaaccgaaagaagagtctgaatagccaaaccaatcctaagcaaaaagaacaaagcttgaagtattacattctgactttgaattatactacaaggctatagtaaccaaaacgtcatgatattggtataaaaatagacatatagaccaacggaacagaatagtgaacccagaaataaagtacctattaacaactgatcttctgcaatattgacaaaattaaacaatagagaaagaacaccctcttcaatatacggtgctaggaaaactggctagccatatgcggaagaatgaaactggacccctgtctctcaccatatacatgaattaactcgagatggattaaagatttatactttagacatgaaactgtaaaaatcctgtgagaaaatgtaggaaaaattcttctggacattggcctggcttaggcaaagaatttttgaccaggtcctcaaaagcaaatgcaacacaaacaaaaataaacagacgggactcagttaagctaaaaaccttccacacagcaaaagaaacaatcaacagagtaaacctacctaatgagaaaaaatatttgcaaattatgtatctaacaaaggctaatatccagaatctacaagaaactccaacaactcaacaacaacaacaacgacaaaaacaaaaacaaaaaacaagtaacgccattaaaaagtaggcaaagggcatgaatgggtgttttttgaaagacatacaagtggccaacaaacatatgaaagatgctcaatatcactaattatcagagaaatgcaaattaaaaccaaacaatactatcttacaccagtcagaatagctattatttaaaaatcaaaaaacaacagatgttggtgaggatgtggagaaaaaagtaatgcttatgcactgttagtgggaatgtaaattatcacatttatggaaaacagtatggagatttctcaaagaactaaaaatagatttctcaaagaactaaacatggtaaaaaatgaaataccatttgatccagcaatctcactactgggtatctacccatctgcattttacatatacgtggaatactatgcagccataaaaaaataatgaagtcgtgtgttttgcagtaacatgagtggaactggagtacgttatcttaagtaaaataattcagaaacagaaagtcaaatatcacatattctcacttgtaagtgagagcttaacaatgggtacacatggacatatagagtagcataatagatattggagactacaaaagggtgggaagttgacaagggttgaaaaattacctcttgggtacaatgttccctcttcaggtgatgggtacactaaaagcccagactccaccacgatgcgatatatgcatgtaagaaatctgcacttgtaccctctaaatccatttttaaaatcgaaaaatatcaccgtaagataccgcttcacagccactggaatgactattataagcaaacaaagcaaagagcaaacaagttttggtagggcctggtgggaggtgttttcatcatgggggcaggtccttcatgggtggcttggtaccactctcatagtaatgagtgagttctccctctgaattcattgcaagagttggtcgtttaaaagagtgtggcatgtccttggaacagctacaattcatacattgttgatgacagtgtaaaatggtacaagtactttggtaaaacttgttgcagttatttatgaaactaagcattcacctactctatgacccagcagttccactcctaggtatttaccttagtgaaatgaaaatgaaaacatattaaaaaaaacacttttacatgaatgttcacagcaactttattcataataacctgaaactggaaagagtccagatgtgtattcataaaagaagagataaacagaacaggcaaaaatctaatctatagtggtaaaagaaaatcaaactgtgggttcctctgagatgtatgtgcagaagtatgagagtacttcctgtagtgatagtaatattttatatcttgataagggtttgggttaaataggtatatgcattggtcaaaactcagtgagtgtatatttaatattttaaacatcattgcatatacattgtaactttaaaaagctgtaagcaaatattgaactctacttaatgatataaatgttgaagtattagggagatatgtactgatatctgcaatgtattatactttaaaattcactgaaaataagattaactgatgaatgaatagatgggaagataggtgataaagcaagtatagaaatatcttaatggtagaatctagatgtaagtctatggcttttctgtgttaaatgttttcaacttttctatatgtttagaaatgttcataataaaatgttgggaaaatagagttactactcattgttttaggcacttagatatatgagagataacagagggagagtttcccagaggaacttatccaagggaagtaaattaatatttacacagttcctcctacaagccaggggtaaaggtaaggataacaatttatttttaacttcacaacaagtgggcacagaaggtattattattgtaactggaaactcatgactagcaggttaagtaacttgtccaaggccaaaaatcaataaatggcagacaggatttcacactgaactccttctgattacaaagcctgtactctttgtagtatgtcaagttttgcagctatcttcaccctgcctcttcaccccatatctccttccctgcttttttgtttttccctagtacttatcacaatttgatatattatatatttgcttatttatttttaattactctgtcgtcactataatgagaattccaagatggccaggaatttttgtctattgtgcctacagtttcatctgcagtgtcaagaacagagcatgactcttggtagatgctcatgaaatatttgctgagtaaactgaattaatgcacagtaacagtttgcttggaataagcagaagcaggagcggtaatccatctgcaaaaatgcatagtaaaaagcttggctgcaagatgcaaaataatgggctccagaaacccaaagcagtttggaatagctagggaagaatgtatggaaaacatgaattacatgctagaagagtaagaagggatcagatcatacagaaccttaaaagccataaggaaggactctagtctttctctgaaagacactggggaggtttagaaggatcttaacatgggagcagaagataagactcagcatgaaaaattaatggaagagggctcacaatggaagcaaggacatcagttacaactttagccatgggaaagaaaagtgttctcactgcaagaagaggcattgtagatagaaagcaggggatagtttgagaaaaatataggagattgagttgataagactggttgtgtaatataagggagagggaaaaattaaatatgatgtttggtttatggcttgggaaacttagtggatggtggtaccattcaatgaaaatgggaaaacaagtggagaagtaggtttaaaatgagtagaagtgatgagttcacgtttgaatatgatatgttttatattctacaaaatatctaagttgtgatatcagtagtcaattgaatacacaggtcaagagctttgcataaatctgggctggatacataaatgttgttgggtaacctagctgtttggtcactgaggataatttaataactctttttcatttaataatgttttcatttaaaaaatactacctctaatatttgaccccacccctaaaataaacctagtattctttggttggtggctatttactattccatgggaattataagaagaatacaaactgtttgataataaaaagctatagaatagcaagattaaaatgtagcagatataagaatcttagggatttttgttacattagaaggctaatctttggcaaatatattacagttggggatagttctttgatactcacctgatcaaatacagctctttattccatgggtagatatttaagactggcccaatcccaatcatgtggttgtgacattctccaacatcttcaatatattcatgcttcaatggcactttactgaggagttcaaattcctcaggtgccttttgaagtacctgttctgctgcatagaatccatctactagcagtgtcctgccaccagttccttcatgtttaagacaatgaaacacttgaatgctaaagagagaaaagaaaattcttctgttcagtggaagagagaacatatcaaaattctagaaattatatataaaatgattactgaaactacttgtcattttcttttcatttcctaattggaaatctcatttcttaattgtttttctctcataggcagttgtacttttttgtgttttgaaatattaatgccactagaggtttcttctaaacatatctaacatatattgaagcttatatgtgctgggccctgggaatacaggcatgaataatatataacctatattttcaagaagctcatagtctagtaagaagaactaaagcaaataaataccaaataaaatatgataggtactataataaagttgcatacaagatatagtggggtcataaacaaaggaatgatctgttctagcggggtgttgtataaagaaatgttttggagaagaatgaaaattgttttgactaatcttaaagaatgagcaagaattggagtagaaggagattgagatgaggagaaggcattctaggcggagagaaagcatgaccaaagataccaatgtaaaacaacaaggagtaagaagttcctattggcatagcacagagaaccacaaaatgattttaaactgtgaaactctacggccatatcaatattttaaagagtccattatgttgatagtgtggaacatggactggtgagaagcaacgtgacaaaaaacttggaaaccaacttgaacaactgaaatagtaaagaaaaatattgagagcttgaactcagaaaggggcgttatagagaagaagacacacctgagagataccgagatagaagtagcagaatttgataactgaaggataggcaagaatctagaataactccaggtttctcacttgggcacctgaaaaatgataatgctatttactaagaccgagattacagacagatatgctgttgaatgataatgaggaagtatgagaggttgaggaaggagttcagtttagaggcatgttagaacagctaatcatatacagtttctgaatatgttaacagggaaaggtaaggtgactattaattgactggaaaactaaggtagaattttcaaacttatgagggaaaataaaattaatagtaatttaatcaaatatgcaaaactaagaaaaagtaaaaagcaaattaaaataagaaataaacaaaaatatggagtaaaatcaaggacaatctaatataatataaatacaattaaaaagagaaaggtaagcctggccatattgaaatttctgtgaaacttctaggtcagggttatttagttaccagttaaagatgtttaaggaagagaggtggattttgttacaagtgatagctaaagccaagagcatggaagaggtcgtttggagagatcatttcaagtaagaaaagagggataaggagaaaaccttgaggaagaataatatttaggaaatagacaaaagaagccagcaaaggaggctgaggaaaaatggtcagatatataggaagaaaactaggaaagaaggaatatttaagaaatttagtagtggttaatggtatgtctcagggatcaagtaagatgacagtacacactggatatgacaattagttgctggtgacgttagagagagtaactttaattgcggtgaggggtgggttgggaaaactagatgcctatgggtttgaggagtaaatgggaagtgagaatgaaaatatattgaatgtagctattattcttttaataatcttagccatgaagtggaagaaaaaaacatggctgtagctaaacggagatagagtccaaggaagtacaaaaatagagaattaagatatgggaggctgataagaaggagtcaataggtatggaaaggctgaagatagaggagagagaaatccccaaggaagctggaaaggatgagatccagagcaaagatagctttagagagagtaaagcatataacaatgaagatagtgattaaaatgaataaaatgatgaaaattatagctaatatttattgaacacttagtttgtgtcaggcagtatgatcatataatttaattccttagcaatgctaatggataggttagtttgtgtcaggcaatatgatcatataatttaattccttagcaatgctaatggataggttttatattactagtcccattttacagatgaggaaactgaagtacagagaaattaagttacttgtccaagatcacaaatctaatacatgttgaggctggaatgcaaatctgggtctggttgatgccatagcctgaactcttaagtgctattaccatactgctaatttacttggtccttgccattgattacaaacaattaaactaaagccacaaacagttgtttatctctggtgttggtcataaagggaagagctagtcagtatttgaacctcaacccctgtacagctgcttcttatctcatttcctcttttttccttctgtatccactagaatgaggatgcagggttgttgatctctccatatattgataacatttatcaggatatctaaaagctgctttgttcttccttccctgaatcaaacattcttaagttataaacccttaaaggaaatcagtgtaaccatgagcaattgcatattatcatcctctcatatagtctccataaatctatgtgcactcattttactcatatctttgtgtctcaggctcaccatctaaatgcagaagcaagatcaagaacacggaataaccacagaggtgcctctactgaagagcaaatggtaggaaaattgagtatagtatgtatcatctttggttcaaaagcatcttattccgtgtgaagaagttattcttccatcattcctcctctccaacttcttgtaaatcagattcaaattcttcttaatgccatactcaaagcagctgtgtttgcatgacgacccttttgcaatatgttaataactaaatgcaagaaatctgtacaaattccaaaactaatggttaggcaatacttttttgggggataatttataattactttgaaaaatgtaaaattacattttaataattaacaaaattaggactccatttatatagtaagatgagttttctttttattttattttattttattttattttattatactttaagttttagggtacatgtgcacaatgtgcaggtttgttacatatgtatacatgtgccatgctggtgtgctgcacccactaactcatcatctagcattaggtatatctcccgatgctatccctcccccctccccccaccccacaacagtccccagagtgtgatgttccccttcctgtgtccatgtgttctcattgttcaattcccacctatgagtgagaacatgcggtgtttggtttgttgttcttgtgatagtttgctgagaatgatggtttccagctccatccatgtccctacaaaggacatgaactcatcattttttatggctgcatagtattccatggtgtatatgtgccacattttctttatccagtctatcgttgttggacatttgggttggttccaagtctttgctattgtgaatagtgccacagtaaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtaatgatgagcattttctcatgtgttttttggctgcataaatgtcttcttttgagaacttaaaaatattttattcctaggagtctgatatagtttggatatttatccccaccaaaatctcatgttgaattgtaatctccagtgctggaggtagggcctggtggaagtgtttagctcatggaggtggataactgatggcttggtgctgtcttcagatagtgagtgagttcctgtgacagctagctgtttaaaagtgtgtggcacctcctccctgactctctctcacttgctcctgtttttgccatgtgaactgtttgctccccgctcaccttccaccatgattggaagctccctgaggcctccccagaagaagatgctgctatgctttctgtatagcctgcagaaccatgagacaattaaatctctcttttttttttttataaattacccagtctcaggtatttatttatagcaatgcaagaatggcctaatacagaatctaaaaactgagttaaggtatttcaaaatgatcatgtttctaggggaagagaaagtcatacaaatctgcaggagcagatatgatcttggttcgaacagaatggaaaataattaagaaaccactcaagactatcacatataaagactttacactgtaaaagtctaatccacctacccacagggctcttgaaaataggtagtgtcagtgtgccgatccagagctagcttggtgtacgcagtgtcacctctggagaagtctgaagtgaaataccacatcctcccataaatggtttctctgttagttgaaataaagaaagacctgttagctatttgaaatgttcattcttgtctttcaaaactccttccaataccttctttagttactcacaaataacagtagatttttttggttccagaatttaatccataaggtgaaaatgacagttgaacatgctagtcttgacaattctgtcacttattaacattctagaaagttggggagaaaactgtggaagtataatattgtattatgaaagcttggagaatcatcccactctgattatgtgcccagttttcatagccttcataaattcaaggttcttttctatgctcacctttctttcacagaaaaagatatagctgcttctggaagtgatttttttattttattttattaattattattatactttaagttttagggtacatgtgcacaatgtgcaggtttgttacatatgtatacatgtgccatgctggtgcgctgcacccactaactcatcatctagcattaggtatatctcccaatgctatccctccccccttccccccaccccacaacagtccccagagtgtgatgttccccttcctgtgtccatgtgttctcattgttcaattcccacctatgagtgagaatatgcggtgtttggttttttgtccttgcgatagtttactgagaatgaggatttccaatttcatccatgtccctacaaaggacatgaactcatcattttttatggctgcatagtattccatggtgtatatgtgccacattttcttaatccagtctatcattgttggacatttgggttggttccaagtctaactttatttactatttttatagctgttgtcttttattagtaccattttttcaataatggtggtcatttcctaatattttggataatccaatttgcaaggatgactgaagagttctcatattatttataagacacagaagtgattaatgtagatcctcactcatcttttggacatggaggaataaagaaaagagaaaaggatagtttgtgttagcaagtatttagtgagacttgctgtaccattgttgttgtgtctctccttgaagtatacatcatatattttgattttgtaattattttcctgttcggctcaaatctgactaaaggtcactttaattctttagctttcaaagttcatcttattttctgaacccttgaagttcaaataggaaatgctcttccttttgaactatcatccctaaaactgtctcaatttatcacttaccagcacagtttctttcacttgaaagttctcaaactgtgattcaaactgaatggctcacagatgctgttgattatgctctaccagcacagggaagaagacccagcatactatctactacaaaatgagctatatctggatcttattaagtaaaaggaaagtactaattataataaagtaggttgacatcacacttaatactatagaagatcaatctatataccacccaaaagtgcgtaatggtaatgaaaaaaacaatgtatttaggattaggaaacctgggctatttgaattcaagttctattgtttactagtagagcactcctgggcaagacacttggtatatttgagtgtcagtgcctcagcagtaaaacggggacaaaacacacactgatcagggttcctataataattaaaagaaaataatgggtgggaatgtgctggctgaatgctatatagccttttaaggcagtgttattaacaatcagtctctgaatcaagccacaggaatcacagaaggtcaaattgaacagatgggaaaatagaggacagtgggggtcgagggggtgtgtgtgtgtgtgtgtgtgtgtaatggacatgcctatggtcacacaactacttgatggtagaactcagactactatccagttctccttacagtcagtgtttttttccagtgtacaataatacctgtcacttgggatcactgggctagaaacatattaccaatgactctgcagtcatcattatattttacacataagtgtatttagagattagaaatccagacctcaaataaagtactgcaagtgagagtcccttattcatgctacaaaatattctggattgaaaacgagggtgaccatacctgttacatttatttattggtgttcatgctctggaaattaattataatactgtggattttaggaaacaaatgaattacctgattaagctgatcctttctgccaacttctctgtgtgctcttgagtgggagggacattttctacgaatgcaattccatagagcagaaagttttgcagaaacttcttcagtccctcgttggtttctaagaagctctggcaatctaccgatggaacttgggcttgctggtagatttcagcattccatagtattctaggctggatgactttttgtttctgcccttcatagctgtttttcaccagccaattcaaatcatatttagtcacatgaccatctggcccttttaaggggaaaaataaaaggcactataataattacaaataatgtcaatatttgtaattggttacaactagttaagaatctttttcctagcaatcagttatccagtactgtattgtttatgaaaccaaattaaaatgaatgcctagaatgtttctgagaaagaaatatgtgtggtttgagtggtatgcatgaataaatgaatgaacaaataaatcttcccagaggctaaataagtttacagaattatagttatatagtaaaagatcttctggaaaattcatcaagtcatcaaagaatgataatccaagtaggcttttacaagcctacttggcactctctccccttgcccccatccctgtcttccatctatataggaactcagaatgtttgagctagaaggggctaatctttattttacagatggagaaaaagtcagtgactcactcaagatcacacaactaagtactataggtggaactagaaccccaccttcttgctgctacaagttcagtactattcaatgctgccttcctcttctacatgatgtaggacattgctgtctaattatatgacatcaacacaatacaataaaattactttgtaagtggcttcacctgctgtgcacaccccacccaaaaaaagttgaaaaccaaccctgaaatgctttagaaaatcttcaggataagcaaaggaagcagcagaaggagtgaaagactatgttgacaacttgtctctcctttttacttctctctcttttcctccctccccttggtaaaaaagtatcacactttggataatttggaaagcataaaaaagtatgaggaaattaaaagtcaccatgtttatcattctatcacccagatgaaactatgattgacagcctggcatcattccttccagtttttctgtacattctcttattttatgtaatttatgtatataaatatagtttatgtaatttatatatataaaatttgggactctgccattgtcacttaacattttaacaatttttaaaattaaattttatcattttaaaaattcaaccttcattaaaattaatttttaaagcttacaaaatatacattaccaagatttacctaacccatctgttattctgggtatgtacatttatttttaaaaaatttcctattatttattagtgatcatctttaaccatatttctataatttagaaatagaatgtatattacatttcttaaaagttcgtatctttgtatttagaaatttcaaagatataaacttttaagagttctgatatacataatcaaattactttttagaaagtctacttatcttcattccctccaacagtacatatgtgtccatcaaaatggagtattcttatttttaaaatatatttttttctaatttggtaactaaagtggaactgctatcttgtaataattttaacttatttgcttactaaggctaataagaatactttctatatttgttagacatctatgtttctttaatgcagggactaccaaactatggttgatgagtcaaatctggtgcttggttttgtaatgcctgtttcagaacacatgctgtccatgttgttacatattgtctatagctccattcactcatatagcccacaaagtttgaaaatatttaccatctggctctttatagaaaatgtttgctgactcctgctttaatgatttgtctgttcagtcctttctcacatttttctattggaacaattgtacttttcttcttttttttttttttttattatactctaagttttagggtacatgtgcacattgtgcaggttagttacctatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagccctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtcctttgcccactttttgatggggttgtttgtttttttcttgtaaatttgttggagttcattgtagattctggatattagccctttgtcagatgagtaggttgcgaaaattttctcccatgttgtaggttgcctgttcactctgatggtagtttcttttgctgtgcagaagctctttagttgaattagatcccatttgtcaattttggctttggttgccattgcttttggtgttttggacatgaagtccttgcccatgcctatgtcctgaatggtaatgcctaggttttcttctagggtttttatggttttaggtctaacatttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcggtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgctcatggtggaaaagctttttgatgtgctgctggattcggtttgccagtattttattgaggatttttgcatcaatgttcatcaaggatattggtctaaaattctcttttttggttgtgtctctgcccggctttggtatcaggatgatgctggcttcataaaatgagttagggaggactccctctttttctattgattggaatagtttcagaaggaatggtaccagttcctccttgtacctctggtagaattctgctgtgaatccatctggtcctggactcttttcggttggtaagctattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggattggtggtgatatcccctttatcattttttattgtgtctatttgattcttctctctttttttctttattagtcttgctagcggtctatcaattttgttgatcttttcaaaaaaccagctcctggattcattgattttttgaagggttttttgtgtctctatttccttgagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtgatgtctttgttctcgttggtttcaaagaacatctttatttctgccttcatttcgttatgtacccagtagtcattcaggagcaggttgttcagtttccatgtagttgagcggctttgagtgagattcttaatcctgcgttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatgtaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgttgagcacttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgacagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctggttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtacaccggagctgttcctattcggccatcttggctcctccccccaacaattgtacttttcttacaatttagcaaaagcaccttacatattaaggatatttagtcttcggcatacattttgctaatattttgcctgtttttaaataaacctttctatggcattttttttctattgtagagaaattagtagtcaatgtatgcatcataagcatgttttttcctccaatgctttttcttttaacttttttatttggagataatagattcacaggatgttgaaaagaaatgtgtaggaaagtcccatgagctcttccccttccttgatgttaacttgttatataaccacactacaatacccaaaccaagaaagtggtattggtacaatccattgggcttattcagatttaaccagttaaacatatattcatttgtgtgcatagctctatgcagtgtaattacatgtgtaactttgtgtaaccaccaccaaaatcaagatactcaaccatatgactccttcgtgttacccttttacagctacatccgccacctcctacccccgaatccctaactcctggacaccaataatctgttctctacctctataattatgttatttcatgactgttacaaacatgaaatcatgcagattggctttttcacttcagcataatgtaattgaggttcttccaagttatgtatcgaactagttccaataaagttgctgagtaggattttattgtatggatggtttgtttaaccattaacccattgggtagtttccaattcttggctattacaaataaggctgatgtgaacattaatgtacagggttttatgtgaacataagttttcatttcttcgggataaatgcccagaagtgtgatttctgggttgcatgtttagttttttttttttaagaaattaccaaactgttttccagagtgtaccattttacattcccataagcaatgtatgagtgatagaatttctctgcatcttctctagtatttggtgtagtcactgttttttaatgtagtcattctgataggtatgtagtgcaatctcattgtgatactaactttcatttctgtaacagctaataatgttgaacatcttttcatgtgtttattcgccatctgtatatcctattcaggaaaatgtctgagcatatcttttatccatttttaaattgtattgcttgtttttctgctgagttttaagagttatttagtcctagcgccagtcaggaccttaagatgttctcatatgttcttttcttgaagttttatagttttatgttttacgtttaagtccgcaatctactatgattttttttttatataaggtgtgagacttgagttgaggttcttttattttttcattatggatgtccaattgctctggtaccaattactgaaaagattatccttcctctattgaatgacttttgcacttttgccaaagataagttgactatatttctgtggatctatttctgggttctctattctattccattgatctatgtatctgtccctccaccaataccacattgtcttgattactgcagtctggaagtgatttcttcccacttaattcttcattttcaaaattgttttgcctctcctagggcctgtatatttccatttaaattttagagcaagcttgtttataattataaaaaaaatcttgcttatattttgacaggaattgcattaaaactatagatcaatttggagaaaactgacatcattactatgttgagtcttccaatccatgaacatgatttgtttctccatgtatttatgtcttctttgatttctttcatcagcatttaataatttttatcatacagatcctatacatattttgttagattatacctaaatatttaaatttatttgaagctatttttgaaatggtcatttttcatttcagtttctgcatgtttaagtatatagaaatatgattgatttttgtgtgttgatcttgtgtcctctgaccttactgaactcatttattagttttcacggttttattatagattacttgaggtagtctatgttaggatgtcatgtatctgcaaataaagagttttatgtatgaattttattaatttttcttgacttactataatagaattttcagtactatgataaataagagtggtgagagtggatgttaaataatagtggtaagaatgggcatccttgccatgttccctgtcttagagggaaagcattaagtctcactattaagtataatgttagctgtggattgtaacaattttatttgaagagaaaaataaaatgtttcaaaaaatccttccaaaacaagaaaaaaagaaaagtaagtaataacctatttttgaaaggaacaaaccattttccacaaaataactgtccttcagaagagtacccccaaagaagatcaagtctcctgtccactcacaagtgaaaaagagtgtggtctcatccagacgaatggtctttggcttgatacataaatccacactggcagtatccaggctgcgctggtgagtcttagagttgtagcacgatgctgagcggcagtggtctcgaagccagacgtaatcaaagcgcatcacggtattagcatatttcagctctagggaaaagatcacatttatcagaactatttattgagataactttaaaaaatcagcatccagaaaacttccttctaaaagtcttctaccaataagcaataagggttgaggggagggacttgccccttaccagatattaaaatatactgtagaacttctataattaaaatggtgtaatgttgtatttaaatagataaaatgatggaagagtataaaaagcccagaaatatacccaaatgcatatggaaatctggtatgtaataaagtgacagcaaaagtcattgaggaaaaaatgaattttttaaataaatggtgttgggacaactgatagaacttgggaaaagataaatttgtgtctgtatgtcatgttgtcacaaggttatcaagataaactcaaaatatataggagtactaaatttagaaaatgaaaccattcaaggatcaaaagaaggaagcataggtgcgtagaggatatatatatgaggtgatatggtttggctctgtgtccccacccaaatctcatgttgaattgtaatccccagtgttgggggagggacctggtgggaggtgattggatcatgggggcaaatttcccccttgctgttctcctgaatgtgacggagctctcacgagatctggttgctttaaagtgtgtacacttctgccttcactttctcctgctttgccatggtaaggtgtgcttgcttcccctcaccttccaccatgattgtaagtttcctgaggcctcccagccatgcttactgtacagcctgcagaactgtgagtcaattaaacctcttttcttcataaagtacccagtttcaggttgttctttatagccatgtgagaacaaacaaacacagaaaattgttaccagagaagtggggcattgctataaagatacctgaaaatgtcgaagcaactttggaactgggtaacaggcagggattggaacagtttggagggctcagaagaagacagaaaggcgagggaaatttaggaacttcctagagacttcttgaatagttttgaccaaaatgctgatagcgatgcaaactgtgaagtccatactgaggtggtctcagatagagatgaggaacttattgggaactggagtaatggtcactcttgctatgctttatcagagactggcagcattgtgcccctgctctagggatttatggaactttcaacttcagagagatgatttagggtatctggcagaagaaatgtctaagtagcaaagtgttcaagatgtggcctggctgcttctaacagtgtatgctcatatgcatttgcaaagagatggtatgaaattggaacttatatttaaaagggaaacagtatgaaaggttgtaaaatgtgcagtgaaaccatgtggtggaaaacaaaccattttctgggaggaattcaaggctgcagaaatttccataagcaaagagaagccaaatgttaatatccaagacaatgggggggaaatgtctccagggcatgtcagagacctttgcaggagcccatcccattacaggccctgaggccaagagggaaaaaagagttttgtgggccaggcccagggccctactgctctgtgcagccttgggacatggcccccatgtcctttggctctgtgtctcagcagctccagctctagccatggctaaaagggaccaaagaacagcttgggccattgcttcagaggatgcaggccccaagtggtggcttccatgtgttgttgggcctatgggtgcccagaaggcaggagttgaggcttgggaacctccgcctagatttcacaggatggctggaaatgcctggatatccaggcagaagtctattgcaggggcagagccctcatgaagaacctctactagggcagtgtggaggagaaatgtggggttggaagccccacacagagtccccactagggcactgcctagtggaactatgagaagagggccaccatcctccagaccccagaatggtagatccaccaacaacttgcactgtgcacctggaaaagccacagccactcaatgccagcctgtgaaagcacccccagggctgtatcctgcaaagccacaggggcagagctgcccaaggccgtgggaacccaccccttgaatcagcataccctggatgtgagacatggaatcaaaggagattattttggagctttaagatttaacgactgccctgttgggttttgaacttgcatggggcctgtagccccttggctttggccaatttctcccatttggaatgggagcatttaccgaatgcctgtacccccattgtatcttggaagtaacaaacttgtttttgattttacaagctcataggtggaagagacttgccttgtctcagatgagactttggacttgaacttctgagttagtgctggagtgagttaagactttaggagaccgttggaaggcgtgattggttttgaaatgtgaaaagacatgagatttgggaggggctaggagtggaatgatggaatgatatggtttgtctctgtgtccccacccaaatctcatgttgaattgtaatccccaatgttgggggagggacctggtgggaggtgattggatcatgggggcaaattccccccttgctgctctaatgatagtgagttctcatgagatctggttgtttaaaagtgtgtagcacttccccctttgctgtctctctctccttctccaccatggtaagacatgcttgcttgccctttaccttctaccaagattgtaagtttcctgaggcctcctagccatgcttcctgtacagcctatggaactgtgagtcaattaaacttcttttcttcataaattaaccattctctgggagttctttatggcagtgtgagaacaggctaatacaggaggtccttgtactattttagcaactaaccttctgttaatttgaagttatagcaaaataaaaaaattacaaaaaaaacaaagactttctatacatcaggttactcatttagaaaaggtaaataaagtgtgtgacccaatttacaaaagaaaagaaaaaaataagttatgccttcatataattcaaaaaaaataaatttctgatggattaaagtacaaaaaattaaaactgtaaaacattaaatgttgacaaccttgaggtaggaaaggctgttttaatatgacacaaaaggcacagagataaattaatctatattaaaataaataccttctgttctgcaaacaatataaaagcaaagttaaaagagaagtaacaggaaaaatatttgtagcataaaaggattaatatccagcatacagaataaacctctgtgatcattaaagataaaaacccaacagaaaaataggtgaaggatatcaataaggaaagtcaccagaagtgacgggcaaacgtatgaactgcccccagccttggtaataatcaaagaaatgggtatttaaaccaaaatgtgataccattttatacccatcagagcaataaaaattttaaaggctgattaaaatgtgttttaaaggatgtggggaaaaatgcatacttgcaaacattggtagtaggagtatatattgttaaagttatactagatggcaatcagcaagtttctatgaaaataatttaaaatgtgcatatttgacctagatattcacctctcagtatttatttttttctcttgtactttatttatttattttatcttttaatatttttttttatgtcagtagcttctggggctcaagtggtttttggttacatggatgaattgtatattggtgaagtcagagatttcagtgcacccatcacccgagtagtgtacactgaaactgatatgtagttttttattctttatccccctccttccctctccccttctgagtctccagtgtccattataccactctgtatgcctttgcataacatagcttagctcccacttgtaagtaagaacatacagtatttggtttttcattcctgagttacttcacttagaataatggccttcagctccatccaagttgctgcaaaatacattatttcattcttttttatggctgagtagtattccatggtgtatatatacattttctttatccacttattggttgatgggtactgagattggttccatatctttgccattgtaaattgtgctgtgatgaacatacacaaacaggtgtctttttgatataatgacttcttttcctttggacaaatagtagtgcacctctcagtatttatcgtatagaaagtgtcacacatgtggagctgcatataaggttattcataatagtgatggttataatagtaaaaataattagaaaaaagactaaatgtctatcagtggggaagtggaagaatcgctgaataaactgtggtttatccacattttaagatattaagcaatagtttttaaaaactgctatacctgtacctctcacattcactttcattggtattatcattctcattttaaggacaactaactaaagctcagagatgctaagtaactttgtaagaatataatcattaggtggtagagctaagacatgaacccaagtcatgcaaccccacagcctagtacactaatgtgtctcaaagtacagccttgggaatctggaggtgatacttcttttagaaaaacacagagaggagcttggcaaattttctcccccaaaagtattgataaaactggccaaactaaaaaagaaccattttaagactctggaaattgtccaaaggtatacagcaaattgagaagtatttattatatttttaatttctttagtaaccttcatactgttttccataattggtacaccaatctacattcccaccaacagtgtacaagagttcctttttctccacacccttgccaacacttgttatctcttgtctttttgataataggtattctaatgggtgtcaggtggtatatcagagtagttttgatttgtatttctcttataattagtgatgttgagcatcttttcatatacgtgttggtcatttgtatgtcttctttggggaaatgtctattcagatccattgaccattttttaattgggttatatgttttgttgctattgagttgtatgaattctttataaattttggatatgaaccccttatcacaaatacagtttgcaaatatttttcctaatctctaggatatcttttcattttgttgactgtttcctttgctgtgcataacctggttagtttgatgttgtctcatttatttattttggtttttgtatcctaagcagttggtgtgatatccaaaaaaatcattgccaaggccaatgtcaaggagctttaccacctgttttcttctaggagttttatggtttcaggtcttattcttgtttaagtcttttatccattttgagctgatttgtgtgtaggatgacaaaggtccaatttcattcttttaccttctgagtatatgcccaaaggaaatgaaagtactacctcataaagatacctgcacttccatgttcattgcagcattattcatgaaagccaagatatggaaagaacctaaatgtctgttgatggacgaatgtataaaaaactgtggtatatatagacaatggaatattattcagccttttaaaaaggagatcttgccatttgccataatatggatgaacctggaggacattatgctaagtgaaataaaccagatacagaaaaaaaatttgcatgatctcatttgtatccggaatcttaaaaaaaaagtcaaataaatatacagagagaataaaacagtggttaccagggccaagggtaggggcatgaggctaaggacacaaagtagcagatatgtagaatgatcagatctagatgtctgttatataacaacatgaagactatagtttataatagtgcattatgttttggatttttgctaaatgagtcaatggtagctgttcttgccacaaaaaaatgggtaactatgtgagatgattgatatgttaatttgcttcactatagtaaccattatactgtctatatgtatctcataatatcatgtcatatactttaaacatacacaatgcaatttcttttaaaaaggaagcatttatttacaaaaaaactactgaaccttgggtaaaaacagtgggaatctgtggtgtattttagcatggggtgctcccactcctattcctccacctctagctccaatcagcagtagttccacgaaggtgggctaaaccaagaaaaccggcagctttgctgtcaaatatgactaacttgatttggagcagagcatgcataaaacccccatgcatctgggtgttatcaaaaacaattagggaagccatactggttggagcaaacaacagaccagaagaacaggcagaaatctaaccaggctatatagggagtgagaaagctataatgggccttgaaaagctcccacacatccctagtatttggaaggttgcacatgcatgcagtgctgtatgcacactgaagagagactggaaatggctccagttatttacatgtctctggatgaaaatgaggctttttgtaggagacatgagaatgacagaaagtaaaaaccaggacaaacttctatggttagtctgtttgcatcattatagagaaatacctggggctaggtaacttgtaaagaaaagagatttatttggctcatggttctgcaggttgtacagaaagcatagtgctggcatctgcttctggtgagggcctcaggaagcttataatcatggcagaaggtgaaggggagctaacatgacacatagtgagagagagagcaagagagagtgaagaagtgccaggctcttttaaacaactggatcttgtctgaattcattactgaggggcaggcaccaagccattcatgagggatttgccctcatgacccaaatacctcccatcaggccccatttctaacattgcagatcacatttcaacatgagatttggaggagacaaacatccaaaccatatcacttgtaaatagctcaaacttcaagtgtatgcctcaaacaacacacagatcctctggcaaagggtggaagccttattacattaagttttttaagcataacctctgatcaatacttggctggcctctaaactatatcaggaattcccaacctgatgcctcaactaggcctatggacatctgggccagatagtccttttgtcatagggacaggtgtcagcagcatcttcctctccagttgtgacgacaaaaaatgtctccagacaatgccaaaggtcctctggggggcaaaatagaccccaattgagagcctctgggctatggtgaccccagtgcaatgcttaggaaaccacagttaaaaataaaaacaagaagtaaaaataaaacctgagcagagacatcagtggctacacactgcagggcacaaagactccacagaattaccccagacaacaaaaaaatacacaaaacaaacaaatacacaaaatacaaacaaatacacaaaaatatgcaacaattcctctggggacatgagaactcagtttccataaaatattatctaaaatgtccagattttcaacaacaagaaaagatcatgagatatgtatagaaacagaagggttacctacacacagaaaaaaagcaggcatcagaaaccctctgagaatattacagaaaatcctattgcctaagtcaaacatgcagatagaaggcaacttacgtcctgcagaaaatgtctttcccttctaatagtcttgagctttacaggagagaagcagaatggactattggggcatcacctccatgtacctatattatttcctcattataagccaacacttggtctttactgagtcattttgtctgtgacagcaggcatgccttatacaagtgctttcaaggtataccccaactggatgcttgaaaatgtatagatactgaacttaattgaaagactgtctgatacaactgctgatactctgaaatagggctattcatttggtggtgccctacagttggagttcttgtcctagggtgtgtggaataatatgcaaaattcgtgtgtgtgtgtgtgtgtgtgtgtgtgtgtgtgtgtgtgtgtgtagaatttctatggggtctataacctaaaaatattgagaaccctttccctagagtgacaaaagtgtttgagtaccactaacccttattcagtttggtcattgcagtgagatgatgcacagttcaacaaactacagcttgtgggtcaaatatagtatgtgacctattttgtttggcttgcaagataaaaaatggtttttacacttttaaagtgtaataaaacaaaaacaaaacaaagaaaatcactgtaatggttaactctatatgtcaatttgactggaccatggggtgcccagataagtggctaaacattaattctgtgagagtgtttctggaggaaattagcatttaaatcaatagactgagtagagtacattgccttctgcaatgcgggaataattctatctgcctgcttgaactgggatattggtcttttcctgttcttggactgaaacttacatatcagccttccattttaggcctttgaacttcgactagaacttagaaaggttctcctggttcttaggccttcagactaaactggaatcatatcaccaggtttcctgggtctcaagcttatggatggaagactggtactttttagtttccataattgtgtgagctgattcctttacacacacacatacacatgcacacacacgtgcacacgcacacacacacacacacacatatatatccccctattggttctgttctgtttctctggagaacactgactaatatagatattggtactgagaagtagggtactgctgtaacaaatacctaaaattgtggaagcagctttggaaatgggtaatggggtagaggctgaaagagttttcaggtacatgctagaaaaaagcctagattactgtgaagggattgctaatggtgtttctggtaagaggtcagaaaaaaaaagaggacagctagagggaaagcctccatgttcctagagaatataaataattgtaaacagaatgctggtagaaatgtgaatggtaaaggccattctgatgaggtctcagatggaaaagaggaacatgctactggacaaaggaaaaaaaagtgacactttttataaagtggcaaaaaacttagctgcaaagtgatgagagagcagttggttccttctgactgcttacagtaaaatgcgagaagagataaatgaattgaagaaggaactgttaaacaaaaaggaaccaggacttaaaagatttagaaaattctcagcttatccatattgcaaagaatgagaaagtatgtttgaaagagaatactaagggtgtggctgatccacatttgataaggagataagtgtgtgcatgaaccatggtcctagtcagccatctcaacagaagccataaacagagatgggattataccagcagaaaaactgccagctgggaccaaaaagaacagagaaaatgggacaaaattgaaagagttgtgcatgtgctatttattcctcaaaaaaagggaagagtgaggctaaaggcaatttagagatcatcggggctgccactcccaccacaggcccaaggggcagggctagttcttcctcaggctagagtgcagtggtgcgatctcggcttactgcagcctctgcctcctgggttcaagcgattctcctgccttcgtctccctggtagctgggactataggtgcccgccaccatgcccagctaatttttgtatttttagtagaaacaaggttttgctgtgttggtcaggctggtcttgaactcctgacctcaagtgatctgcctgccttagccttccaaagtgctggtattacagacatgagccacctggcacccggccttatttctctctttttggaatgggactgtctctattgtacctgtcccaccttcctattttggaagcacatacttatctggtttcacaggagaagaaattttgcctcaggataaattgtacctcaagtctcacccatatcaaatttaggtgagatttagttgagactttggaattttcatctttagagtggatgctggaatgagttaagacggggttgttgggatggaaggtatgtattttatgtgagaagaatatgaatttggggaatctatgggtggaatgtaatagactgaattgagtctcccctaagtccatatgttaaagctctaatccccaatgtgatggtatctggagatggagactttgggagataattaggccatgaaggtagattcctcatgatggtattagtgctcttataacaagggacaggagatggagccctttatctctccaccatgtgaagatacagcaagaaggcagagggcagccttctgcaagccaggaagagagtcctcaccagaacttgactatgctggtgccctgatgttggattttgtagcctccagaactgtgagaaataaatgtctgttgtttaagccacctgggctatggtcttttgttaaagcagcctgagccaactaagacaaccatgggacagagattgtacatggcccaaaaaaagcctaaaatatttactgtctggctgtgttagtcagttcaggctgctataacaaaattataatagactgggtagcttaaacaacagatatttatttctcactgtctggaagctaggaagtctaagatgagggttccaggccatttgattcctggtgaggacactcttcttgctgtgcagatggctaccttgttgctatatcctcaaatgatagagatagaatgtgctctctcttataatggcactaattccatcatgaggactccaccctaataatctaattagctctcaaaggttccatcttcaagtaccatcacattgggagttaggcttcaacatatgaatttggagaaaacacattcagtccatagcactggccctttacagataaaagtctgctgacctctgagataatctgtagcagaaactctttttttcatcctctccttcacttctagtgagttggcaagagtagctaatactaccaccttaatagcatttgaaacctaactaacccctgtctccatttaagctccacacatcagtcagaatactctttccaatgaaatttagcttagaatcccttaagtagtttcccattacaataaagaccaatctcctcaagattgcctacaagggtctgcacaatgtggccccggctaacctctgtagcatcttttgtcaacccttccttgcacttgatgtagcagtccatataggccaatatgacatattctctgtagcctaactcttgtacatatagtttgctctaactgaaacattcttcttcactgcctcaaccctcttcccctgcctagttcatattcaatactcatgactcagcaggcagtcattcataactctccaggttggattaagtacctttcctctttgttcttacagcaccctatgtatttcctaaaagaatttctcatcttgtcttatgcttgtttatcattgccacaagactgtgagtatcttgaggatagggaatgtgtcttcttcctctctgcatgctttgcacttaggacaatgcctgaatcctggtaggtattcattaaatgtttgttgaataaatcaatggtaaatcaagcagtggtgcagctgccttactggtaactccaatacaggccacatatctacaaatgatcttctcctgctctactagatagctagtaatcctgactatatgctatattccattttcaggttaagagttgctagttatataagcagtgtagtagtggaataaactactgtgtggctagacttgccttttagtaggcttcaatatatcccctcattttagttaagttggtatgcttactgtccttttgctgactggaatccattcttgccttttcacttgtaacttttctccttgaaatcacaggagaaattaattaaaggactttctgattaaatgaccaccttctccttcaaaatatagctaaaaattcatttattcaaggcagcttctttgaataatgtatttcctctttgaaattaaatatttgataggtatcaactcaatttacatttgtgtctggcataagctaattatgcttcttatatttatttacttattttattcatttcagggactctacatcttacattgagaaagggaatcttccatctttggttctctaacagttcttagctcagttaataaaattaacactcagcaaatgcttattaattagatcttatcaaaattttaatacagaaaagaaatttgaaactcaccttgattcatctcttttataacccacatttaatcaatcaccaaggtctgttgattccacttcctaaatctttctgaaatccatataacctctccatttacactcctttctcctgccacattcaggtattcatcatctatagacactgggacactataaaaggattttaaaaatcaaggcagtaaaatcagattggagtttagaaagagcactctagtttcaggatggataatggatcatcaggagagcaagacaaggctgcagtaatcctgttaggatagttacctcctcgcttctcaatgttgtttttggaccactttttctccctccttcctctaaaacccaagcttctttgaagatcatgctttcttaattattctaatcaagtacctcttgagtcactctccatttttaatgaagaccagtttactgttgtccactttatcctttccctgtcatccttggcaacttcatcatcattaatgacagtactctcaaaattttcatttaaaacattccatactctagccacctcttattaccattccagttcaattattctggcactcctcaccccgataatccttcaaccccataaagagctccaattcattgaccctaagctccttttcactctctgtcatcttgtttcctttaatgtcctcacttacctccttaatgtcctcacttccctccttacagagcccatattccatggtccatcattttaatcaattccctgcaaacattcttaacttccttgtcccctctctctgtgccatacttctctgacaaagccccaaccatggtaaactcaagttcctacctcctgtgcagccaagcagctgaaaattgctggagaaaaatttttcttttatgttttatttttttaattgacaaatactgtgttttgttatcttgtaaacatgatgttttgaagtatatatacattttggaatggctaaacctaaccaattaataaatggattacttcacatagttattatttttgtggtgctagtatgtaacgtcaactctgtttttcaagaatacaatatcatcattaactatagtcattttgctgtatgatagatctcttgaaatgtattcctcctatctaactctaattatgtatcctctgaccaacatgtctccatcttccctcccctcaatcaccctagcctctgataactaccattatactcacttctatgagatcaaattttttagattccacgtatgagtgagataatgcagtatttgtcttcctatgcctggcttatttcctttaacataaattcctccaggttcattcacgttgctgcaaatgacaggatctgactctttttatggctgagtagtattacattgtgtatgtatacctcacttttttcatccactcatccattgatggacgcttatgatggagaaaattttaaaaactgcactggctagtatcattttaaactcatcatgaaaaatctcaaattagtactcaatatagccaaataattcttgcataatttcctagtaaaatcactcactctctaagaagactgtgtcataccatctccccatcctcaaactgccaacacctcctcacccttcacactttcaactgatgaccttgcttcttccttcaaagaaaatgtagaagcaataagagaatcttcacaaactgatgccccatatccaatcacttacctgcatctgtgcccatatattccacctttctttctgttacaatcgttgaaatatctgtgcatctaatcaaggtcaatacttccatttatgaactagattctatctctttttcatactcagagactatgctcctgaagcagttctattcctctcttttgcatcaccaaattttccttccctattggatcatcctcattagcaaacatgtaatatctcccatattaaaataatattccaggagtgccatcagcaagatggcagaatagaaaaaaaagaccctccttcccccatggtttgaataacaatttatggaacaattgcctttatgacaaattcagaaatgagttaaaaggttgctgcaccccaggcaagtgcaaagccaacctcaccaaaacccagtaggaaaattcatggcatttcttcaccagagactcttctcccagcttggtgcattgtaactgagaggaaacccctacctcctgacttatcctaggggggaaaagaagttgaatgtccaacattctaacttttcagggtgttatctaaaagattggtttctgtcttgcctgaatctaagaactgacagcaatgggatgccaggttgggggcctgctgagaacaaaggtgatcaatgtggcttggcctggcaccagagtctgtagaccacagacagacattatgtggagctccaataccctagtttactacagaaacagagagatggcagtatcacagacagacatcaaggggaactcctgaatagaaactgataaatctcttcaactagatgattatatgcacaatcccagaagagtatgccttcccaggaaaggattaggaggtctctggattctttaactgggctaattggagaatgtcctccttgtatgcaaccagaccacaaagactgagaaaggtagctgagctttcaaatgttaaagtctcaacaagatatagtaagacatacgaagaaacaaagaaatgtggactattcaaaggaataatttaaacctccagaaagcacccctacagacatagagaaatataaattaccaaaaactcaaaataagcatcaccagaataattaaagaattaaacaagaacatagataggcaactaaacaaaattaggaaactgacatataaacaaaataagaatatcaacaaataaataaaagtataaagaagaatcaaacagaaattctggaactgaagtatctaataatcgaattggagaaattcactggagggattcgatagcagaattgaccaggcagaaaaaagaattagtaaactcatcgatagggctttgaaattattgagaaagagaagaaaaaaacaacaaagaatgaagaaaaatgaggagagcctaagggatttatggggcaccaacaagcagaacaacatacgcatgatgcaaatcacaaaaggggaaaagagaaatgagtagagagcttatctgaagaaatgatggctgaaaactctccaaatttgatgagagaaaaggacacacaatttgaataaacaaacaactccagttggaataaatctaaagagacctacactgagacccatcaaaatccaactgtcaaaagtcacaaagacagaatcttgaaagtggcaagaaaaaatgactcatcacatataagggagcttctattaaactatcagctggtttctcagcaaaaccttgcaggctagaaaggagtgaaataatatattcaattactgaagaacaaaacctgcccaccaagaacattatattttgtaaaactgtccttctaaaatgaaggagagattaagacttcccagataaacaaaaggagaggaagttgatcaccactcaatctgccccacaagaaatgctaaagggatccttcaagttgaagaaaaaggatgataaatagcaacacaaaaccatatgaaaatataaaccttctgataaaggtttattgtgtagaattgtaatataagtgtgtaaatcacttttaaatatggtataaattttaaaaacaaaagtaacaaataattatagatctatgttaatggatgcacattataaggaaaggatgcccaccctcaatattactattgttgaagtactgggattcctagctagaaaaattagacaagaaagagaagtaacagaaatctaaattggaaaagatgaagtaaaattgtctgtattcacagatgacatgatcttatatgtagaaaaccctaaatattccatatgcaataaaaagtattataactaataaatgatgtcagaaaatttgcaggatacaaaagcaatacataaaatgcattgcatttctatatattaatggtgaccgatctaagaagaaaaattaagaaaaaattccctttatttattttattttattttttattatactttaagttctggggtacatgtgcagaacatgcaggtttgttacataagtatacatgagccatggtggtttgctgcacccatcaacctgtcatctacattaggtatttctcctaatgctatccctcccctagaccccactccctgacaggccccagtgtgtgatgttcccttccctgtgtccatgtgtcctcattgttcaactcccacttatgagtgagaacatgcgatgtttggttttctattcttgtgttagtttgctgagaatgatggtctccagtgtcatccatgtccctgcaaaggacatgaactcatccttttttatggctctatagtattccatggtgtatatgtgccacaatttctttatccagtttcacactgatgggcatttgggttgtttccaagtctttgttattgtgaacagtgctgcaataaacatatgtgtgcatatgtctttatagtagaatgatttataatcctctgggtatatacccagtaatgagattgctgagtcaaatggtaattccagttctagatccttgaagaatctccacactgtcttccacaatggttgaactaatttacactcccaccaacactgtaaaagcgttcctatttctccacatcctctccagcatctgttgtttcctgactttttaatgattgccaatctaactgatgtgagatgatatctcattatggttttgatttgcatttttctgatgaccagtgatgatgagcttttttcatatgtttgttggctgcataaatgtctgcttttgagaagtgtctgttcatatcctttgcccactttttgatggggttgttttttttttcatgtaaatttgtctaagttctttgtagattctgaatattagccctttgtcagatggatagattgcaaaaattttctcccattctgtaggttgcctgttcactctgatggtagtttcttttgctgtggagaagctctttagtttaatcagatcccatttgtctattttggcttttgttgccattgcttttggtgctttagtcatgaagtctttgcccaagcctatgtcctgaatggtattgcctaggttttcttctagggtttttatggttttaggtcttatgtttaagtctttaatccatcttgagttaatttttgtgtaaggtataaggaagggatccagtttcagccttctgcatatggcatcaaaaaggatgaaatacttaggaataaacttaaccaagttagtgaaacacttctacagtgaaaactacaaaatgttgctaagataaatcaaagaaaggtacaaataaatgaaaaggcatctcctgcttatggattggaaggcttaatgttgttaaaatgtccatactacccaaagtgatctacagattaaatgcaatgcctatcaaaactccaatggaatttgttgtagaaacagaaaaaaaccttcctaaaagtcatacggaatctcaagggaccctgaatagtcaaaataatcttgaaaaatgagaccaaaattggaggcctcgcacttcccaatttcaaaacatgcaacaaagcaacagtaatcaaaatagtattgatgtatgaaaaagtctttatctctcacttttgaaggatcattttgctggatatataattctacattggtagttgtcccccctttaacactttaaggttgtcattccattgtgttcttgcttgcacagttcctgatgagaagtccactgcaattcttatctttgtttctctgtaggtaaggtgtttttctccccactaggctgccttcaagaatatctctttgtctttggttttctgcagttttaatataatatgcccatgtgtgaggtcctgcttgtttattttaaggggtgtgtgtgtgtgtgtgtgtttatttataatgcatttgttaatgtgtctatttttatgccagtatcatattgttttgattactattgctttgtaatatattttgatatcaggtagtatgatgcctccagctttgttctttttgctcaagattgctttagccattcagggtcttaagttgaaaacttttcctttcagatcaggaacaagacaatgatgttcactcttcctactcttactccacatagtactggaagtcgtagccagagtaattaggcaagaaaaagaaataaaagacatgcaaataggaaagaaagagatgaaattgtctctgttcactgatgaaataatcttatatatagaaaaccctaaagagactaccaaaaaactgttagacttaatgaattcagtaaaatcaacatacaaaaatcattaatgcttctaaaccctaacaatgaactaactgaaaaagaaatcaagaaaacaatgctatttgtaatagttgcaaaaaaatacttaggaataaatttaaccaaggagattaataatctctacactcaaaactataaaacattgattaaataaattggagaacacacaaataaatgaaaaaaattccatcttcgtggattggaagaattaatattgttaaaatatctatactattcaaagtgatctacagattcaatgcagctcctgtcaaaatttcaattacatttttcacagaaatagaaaaaatcctaaaattctgactgataatttcaacacctgtgtcatatgtaagtctggttctgatcttgctttgtctcttcaaattgtgttatttcttgccttagcaagttttgtaatgttgttattgttaaaagccagacatcttgtatagagcaatagctactgaggtaaataggattttaccatgaatatttatattaatctggcctggagttaggttgtgtttgatgtttgttgtctctgtgggtaccagaagcattaaatttctctagtgattttgcttttgtcttctctcttggccttggcccttccctttgtgctgtacctcagagacaggctgtctcttgcagctcttccagctgtaatccactgtcattttaactggaggcttattagcttgttgtaggatgtggggggatgagggcattctacaatcttcagattctcagtctttggagtgcatagtgggcctgtgtcttggaagtgtgactttaacaattgtttttgtttctcttccagggtgtggtagattgaactgtaaccctcaaaaagatatgttgaagtcctaatccctggtacctgtgaatgtgaccttatttagaaagcctctttgcagatgtaatcaagttaaaatgaggtcacactggattagggtgtgttctaaatccaatgactgctatctttataaagagaaatatttgaagacagagattagatattgagaagaaggccatgtgaatatgaaagcagagattggagtcatgctggcacaagcaaagtaaagccaaggattgccagcaaccataagaaactagaaaaggcaaggaaaaactctctcccaaagggagcatggccttaccaaccctccaagactatgagaaaatacactgttgttttaaatcacctagtttgtgtaatttgttatggcagccttagaagactcatacacataggtaaagtattccctcctgccaactaatactttctgtggttctaacattcctagtctatatctttgaaaccctctcccttgtatattaaggctttcttttctttatttttttttcccttaggtaagacagggagatggagtggggctggagcaggctgagttgccttcccctagttgagaagggatttcactattgccctctgttatttttgtctttctcccaacttgtaggctaatcttaaaaataaatggctagaggtcctgtcaactccacaaaaagtattttcagaccacacaaaaggtatttatcattgcataacaatgtgaattgtacacttaaaatggttaagatagtaaattttgtactatgtgttttcttaccacgattttatcattccaatttttgatatatgtgctgccaaagcaaacatttcttaccacaagttttaaaaagtatctgtcttcacacatctcttaccaaaatgatcttcatgttgctgccaagcacaagtcagagacttggaggctgtatggtgccaatggacagctaaaggaagtaagcttttgaagttgggctgtggaagggccggatatatgactcctcccttcagcaagtcctgaagcctgctgtgtaggtgggacaatctgtggtaccacatcctagaagattggataataacaagttagtagtaatatacaacaacttttatgaggctataggaataacactacagatataattatgtaaaatgatagatttaatgatctcaatacagaggattaaacaaaggagaaattgtgaaaagttaagcataagtgatctataaccattacttacattttctcattagccactcttattttatgtcatacaatcttccttttggcctactacctaactgaagcagtgctttaaaaaattcactaatcttaaccttccaaatacatacagtcatctgcataatgacatttctgtcagtaacagaccacatatatgatggtggtcccataagattataatggagccgaaaaatcctattacctagtgacatggtaatgtagcacaatgcattaccttttctatgtttagatgtgtttacatacacaaatgctcagcgttatgttacaattgcctacagtattcagtacagtcacatgctatacaggtttgtaccctaggagcaacaggctatatatatcatatagcctggacgtgtagtaggctataccatctgggtttgttaacactctaggatgttcatacaaccatgaaattgctgaatgaggcatttctcagaatgtatccctgtcgttatcctgtcaactgacccataattgtaaaaggattatttttcatgtctcatccttctgggtctctctgcttgtgacactactaatcacccctattccgactatgtgaaactttcttctccgctggttatgtgtgctgtgggcaagttacttaaaccctcagtgactccatttcttcctttgtaaaatgaggttgataatagtatttatctcatggctttactgtgaggactaaaatacttagaattatatgttccatactaagccctacatatgtatcactgctattactatcgttattacggctgttgttaggcataaactttatgttgggaaaatgccttgataaacctgcttggagttggtgatgctgagtagcatagttttagaaaaattaataaaacaacaccatttgcataaggtcttaaaaggaattaatttgtcctgtggcagaagactgagagagctatgtgattgcagataggctgtgtggttctcaatgtgaaccttctcaattacaccctcaaatatgcagtagtgtaattaaacccacaaaatgcttatgttgagtggactggtgagtgcctgtgtgtgtgtgcgcgcatgcgtatgtgtgggtatgtgagttgtaagctgatgaaaggactgaacttcatgctgatatgggatgaaaccaatcacataaattaaagccatagctagagatataatagaatttactaatcactagggagcagtctgtaattacaggatagagaatggaaggctaaagtcaaatttattgagattttgtggctgagggcaaagaggagagcacagaaactcctctgctgataatctgggttacatttatttcttcactgtctcttgtttccaacctcctacctacagatactgtctgaaacaggggctggcaatctgtgccccacaaactaaaaatggattttatattttttaaggagttgtaaagaaaaacaaagatgagtatgacaccaagactccagaccaagaccagactagaatttcttctttgtagtctatgaagtctacaatatgtgctatctggatcttcaaagaaaaaaaatttccaactcctagtcaaatattaaattcttaatcaaatactcttctcccactacatcgaaaaatctcccaaaaatctactcttaagtatattcactcacttcattatttcacaaaataaatattactaataggtactttttttttttttgagacggagtcttgctctgtcgcccaggctggagtgcagtggcgctatctcggctcactgcaagctccgcctcccgggttcacgccattctcctgcctcagcctcccgagtagctgggactacaggcacctgccaccacgcccggctaattttttgtatttttagtagagacggggtttcaccgtgttagccaggatggtctcgatctcctgacctcgtgatccgccgcctcagcctcccaaagtgctgggattacaggcgtgagccaccacgaccagctataataggtactttcttaagtattaagatacaaacataaataaatcagcagtcctagccaccattcaagatgttcacaaactagcagggaagaaagacaagtacagggtgataactactactatttataatagttttaagcatacaacacagtgaaaggtgcaaaggagtaagaagttaaccatgcctgaggaaagtggtggagctccacatgactagtgttctttgaagaaggtttcattgttttatattaacttaaaaataaaactgattgtaaaaaaaaaaaaagatgggattgttggaggtgttggaaataatccacacaaccctgaaatatataaaataataagtaaaagcctctttctttcattatttaccaccccattctttcaaggaaactgttgatgaggtttggcatatacaatgacacatataattaaaatctccacacctgctatagacacatacagaaatacatatgtatttaaaccataaagaatggtagaaaacaaagtctctcctcccccatttcccataatctcactactcaaatgttaccagtttcaatttttagaaatcagcccaagcaaaactggatatccatatgcagaagaatgagacccctacctcttgccatatacaaaaaatacaatctaagtgaattaaagacttaaatctaagaccgcaaactatgaaactactacaagaaaacattggggaaacataccaggacgttggtctgggcaaaaatttctggagtaagacttcaaaagcacaggcaagctaagcaaaaatggacaaatgggatcacatcaaattaaaaagctactgtacatcaaaggatacaaccaacaaagtgaagggacaacctggagaatgggagaaaataatttgccaaccacccatctgacaagggattaataatcaagcaatttgcaaactggcagcaggtatctgaaattcacacaactgacaaagtattaatatcaagaatatttaaagacatcctacaggctgggcacggtggctcatgcctgaaatcccagcactttgggaggtcaaggcgggcggatcacaaggtcagcagtatgaggccagcctgactaacatggtgaaaccctgtctctactaaaaaatacaaaaattagccgggtgtggtggcacacacctgtattcccagctactcaggaggctgaggcaggagaatcgcttgaacccaggaggcaaaggttgcagtgagctgagattgtgccactgcactccagcctgggcgacagagtgagactctgtctcaaaaaaaaaaaagacatcctacaagtcaataggaaaagcaaacaatatgtgagcaaatagtatgaacagacatttctaagagaaaacacatatggtcaatatggtcaatcaattcatgaagagatgttcaacctcattaatgattagggaattgtaatctagtcacagtgagatatgatataaccatctgatcggcaaaaattaagatgtctgacaatagcaagtatagaggtcttgcacatctttcattgaattcattcctaagtgatttcttgtgctattacaagcagcattttaaaatttcaatttgtaattgctaacagtatacacaatgcaactgacttttatattctgacctggaatgctgtaatcttaataaaaacagttattacttccagtaagcgctttggaaatttctcagcattttctatataaggaatgtcatatatgaatagagttctacatcttcttttgcaaactttataccttttgtttgtttttttgctgcattgtgctcactagttaggaggagtaagcatggacaaccttgccttgttcctgatcttaggggaaaacattctagtttcatgattaagtatgttgttagccatgtttttggatttttttgttattgttattaatggcctttttctggttggggaagtttccttcaattcctagttttctgagagtatttatcaggaatatgacttgaattttagtaaatgtactttctacatctattattttatggcttgttgctttattctagtaaagtggttaattattctaattgacttcctatgttaaaacaaccttgcatttctggaataaaccccatttgattatgatatattatcctttttatacattgttggattcaatatgctgaaattttgtttcagtattttgcatctagatacatgaggaatacatggtctggtgtgtgtatgtgtgtgtgtcatctttatcaggtattttatcagatttatgctgggtttttaaaattgtactttaagttctgggatacatgtgcagaacgtgcaggtttgttacataggtatacaaaccatggtggtttgctgcacccataaacccgtcacctacactaggtatttctcctaatgctatccctcccctagcccccactccccgagaggccccagtgtgtgctcttcccctccctgtgcccatatgttctcattgttcaactcccacttatgagtgagaacacgtggtgtttggttttctcttcctgtgttagtttgctgagaatgatggtttccagctacatccatgtccctgcaaaggacatgaactcatcctttttatggctgcatagtattccgtggcgtatatgtgccacattttctttatccagtctcaaattgatgggcatttcggttgtttccaagtctttgctattgtgaacagtgctgcagtcaacatacgtgtgcatgtgtctttatcgtagaatgatttttttttggtcttgcaaaatcagttttattgtaatatgcatatatgaaaatttacccatgatgcatagtcgcaatcctaatttaacttgtcctaattaaactaatcctaaagtaactaattttacttccatttttattatgtgtgaaaataagttctttctataatgttttgtactattggtctacttgcttgcttgcttttccatccattgcaatatttgggaatggattacaaaaagatacttggataagtagcactgaaagctgttaaaaacagaatatcaattcctggagtatgtttctatctggatgcacacgaatgaaataattgaactctcaaagttcttttcacgcccttaattcaatgaagcaattcctgaagcaacacattcacatctcatagctgatttacatgtttccttttgctagccttctcttttggactaagttttctccttactaatgtcagttcaaactggtgagacttcagacaagtggtttctcaatcctgatggcacaatagagtgatgtggggaactttagaaaagttctgatgatccggccctgcccctagagactgtgattaaatattttgagtgtatatgaaccacttggttatttggttactatgtcatcaaagcaggttaaaaacgaggggaaaagccatttttttcttcagcctggctatcttgacaactaacaaattattttttaaccccaaaagaaaagaaaaatgggaccaaagatatttttacttttagtaaataaagcgcatcaactctcaaaaggtgcttggccctttaaacggcatggcaatgcacagaaagacagttgggtgaggctgcatgcccttcataaccatttcaacacctacctcgggtcccaaaataaatatttttaatattgtctcattctggactgttccaacatgcactatatcagcttgtctacatattctaatgtaactgcatacaagtttccagcagctcatgtattttctttttttttattatactaaaagttttagggtacatgtgcacaacatgcaggtttgttacatgtgtatacatgtgccatttggtgtgtcgcacccattaacccgtcatttaacattaggtattcttcctaatgctatccctcccccctccccccaccccaaatcctttgggtatatacccagtaatgggattgctgggtcaaatcgtaattctagttctagatccttgaggaattgccacactgtcttccacaatggttgaattaatttacattcccaccaacagtgtaaaagcgttcctatttctccacagcctctccagcatctgttgtttcctgactttttaatgatcacaaaataagttagagaatgttacctccacttcacttttcagttctagtatttccacttggtccttatttagaaattctgtttatcctctgaagttttccatctgttcattcattccacttatttgctcctgtaagttctctaacatatttacaataacagttttaatgtcctggtcagaaaacaccagtatctgggttatctgtgagtctgcctttattgactattgtcctccctccttattatgactatttattcattttgttatatatgtagtattttttggaatgttggatattgtggatggcgtgttttagatggttttgtaaataacctttatcagaagttactttttattcctagtttgctaaaagactttttctctcataaatggatgttgaattttagggttttttttgcatttattgatttgactgtatgatttttctcctttgtttctgtggtgagttaccttgattcactttcaaaatgtaaaccaactttgcaacgctggcataaaccaaactacaatagggtatattatccttttaatacatcactgtttacaattttctaatagtttgttcgaaattttgcatctatattgatgtgtaaaattaacccaaattttcctttctcatattttccttataatattttagttacagtattattctaactttataaaaagagttgtaaagacatctattttcttctgttctctggaaaatgtcatgtgagattgatattatttctttcttaaattttgatagaattactcagtgaaggcatctgagtcttggctttactttgtgagatgggtttgagttacttaatagttataggtcagtgcagaaatttatcttcttgtgttctttttggtaagttatgtttcctaggaatctatgtattttatttaaatttttagtatactgacttaaaattatttacaatatccaattgtaactgttctgttttatgatatataatggtagctcctgtctcattcctaatattggttatttatgctttctctctcttcttttgtttctttatccatatttctagtggtattatcaattttattagtcttttcataaaagaaactttcggtttcaataatgctgtctgtcaaatatgtctttcttacaggaaattctgttcttatctttgcttccttctacattctttaggattaattttctattgtttttccaattccctgagatggatccatatgtcattgattttttagcctttcctcttttgtggaatatgcattttaaggacacaaatttcccttacagtaatggttaaacagtatccctttaaattttaagatgctatatttccatttctcagtcagctcaaaatattttctattttacattgcaatttttaaaaatttggcccacaggttattttaaagtatactacgaattttagggagattttctaatttatttcttgttttctaacttaatgtcagtgtggccaaaaaatactataattgtttaaagtttttgagatttgctttatggctcaacacatcacgtatttttctatgtgcagaaaagaatatgtattctgcaattgttgcatgtggttgtctatatatgtcaattaggtcaagtttgttaatattactgtccaactcttctatataattattggttttctcttttttgtctgatattctatcagttactaagggatatattttaagatctctgattatgattgtgaatttattgggcatcagtaaatttttgctttgcctattttgagtgttaagtgcatacaaatcagaataattgtatcttcttggtggattgcccctgttatcattataaaatagctctatacttagtaaatatttctaccttaaagtcacctttgtctggtattaatatagctatatcagctttcttttgggtagtatctgcattctatacttcttccatccttttactttcaatcttcctatatctttccattttatatatctcttataaacaagatgtagattttgtattttttaaccattctaataatctttgtcatttaactgaggtattcagtccatttacatttattataattactgatatatttaactctactatatcactatttactttctgtttgtcttgcctattctgttatcttttctctccttgctttgttttgtactaatatggtaatttgtattattcaatttactccttgtttaattcttatacattcttttactgtttttagtgattattctatgaataataacatatatatatgacatattaaagtgtagcacaaattagagggtttatgttaactccatttatcttcctccctcaagtgctattattgtgtattttaattgcatacacatgcacgccacatgacattactatttttattcattcattcattcattcattcattcattcattcatttatagattcagagcctcgctctgtcacccaggctggagtgcagtggcatgatcatggcaaactgcagcttcaaactcctgggctcaagatcctcacctcagcctcttgagtagctgggactacaggcatgcactaccttgctttgccaagacattactatttttttaaatatgatcaatgaacattcagatctacccacatatttaacctcccccctgcacttcattcattatatatttccaagatttcatttaggatcagtttaattctgcctgaagatccttaatatttcctttggtttttggtgacaggttccctaagttatggaccatctaaaaacatctattttacttccattttaaaaggctggatatagaatttaccagataaaattttaggttgacagttaattttgtcagcattttgaaaatgtagttctatcgtcttcatgttgtttttttgaaaagtcaaagccaatctaattgctattccttgaaaggtaatactttttttttctccaaatgcttttaagacttttttttctttatttttttggcagttcttactaaatacacctagatgagggttttttatttatttattctgcttcgggttatggtactttttgaatccacgaactgatgcttgtgacaggcagatttctaagatgacctccagttacccttgctgttgtaaaatcttttcccctggagtgtgagagggattatgaatatgataaggtttcacttgcattattacattatgtatatgggacagctgactttaagaaaggggaatggcccttggttgggattacctaatgcagcaatcctttgaaagagactggtctcttcttttttttttcctttttttaattatactttaagttctagggtacacgtgcaccatgtgcaggtttgatacataggtatacatgtgccatgttggtttgctgcatctgtcaactcatcatttacattaggtatttctcctaatgctatcccttccccagctccccaccccctgacaggccccagtgtgtgatgttccccaccctgtgtccaagtgatctcattgttcaattcccacctatgagtgagaacatgcggtgttggttttctgtccttttgatagtttgctgagaatggtttccagcttcatccacgtccctgcaaaggacatgaactcatcattgtttatggctgcatagtattccatggtgtatatgtaccaaattttcttaatccagtctatcattgatggacatttgggttggttccaagtctttgctattaggaactgtgctgcaataaacatatgtgtgcatgtgtctttatagcagcatgatttataatcctttgggtatatacctagtaatggaatcactgggtcaaatggtaattctagttgtagatccttgaggaatcaccacactgtcttccacaatggttgaactagtttacagtcccaccaacagcgtaaaagtgttcctatttctccacatcctctccagcacctgttgtttcctgactttttaatgatcgccattctaactggcgtgagatggtatctcattgtggttttgatttgcatttctctgatgaccagtgatgatgagcattttttcatgtgtctgttggctgcataaatgtcttttgagaagtgtctgttatatcctttgcccgctttttgatggggttgtttttttcttgtaagtttgtttgagttctttgtagattctggatattagccctttgtcagatgggtagactgcaaaaattttctcccattctgtaggttgcctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacatttaagtctttaatccatcttgaattggtctcttcttagtgaaagagacttgaagcaagaaagggagttgatgccaggaagatttttcattggctttgaagatggagataactacgtggcaagtaaggcaggcagtctctagaagatgagagtgagttacagctgacatgcagcaatgaaacagggacttcagtcctatggttacaaggaactgaattcagccaaccagaaaggaatgtagcctggccaacattgtgatttcagcctttaatactgtgaccagagaactcagtcatgccacacctggacttctgtcctattatcgggggacctgccccgataatcacgtgggttcttttctagtttcctaagcatcggctggcttgagaaataaaaggacagagtacgaaagagagaaattttaaagctgggcgtcctggggagacatcacacattggtaggatccgtgatgccccacaagccacaaaaaccagcaagtttttattagggagtttcaaaaggggagggagtatatgactacgtgtgggtgacagacatcaagtacttaacagggtaatagaatatcacaaggcaagtggaggcagggcgagatcacaggaccacaggacggaagcgaaattaaaattgctaatgaagttttgggcaccactgtcgttgataacatcttatcaggggacagggttttgagatcaaccggtctgaccaaaatttattaggcaggaatttcctcttcctaataagcctgggagcgctatgggagactggagtttatttcacctctgcaatctcgaccataagagacaggtacgccccgggggggccagttcagagacctacccctaggtgcgcattctctttctcagggatgttccatgctgagaaaaagaattcagcgatatttctcccatttgcttttgaaagaagagaaatatggttctgttctgcccagctcaccggcagtcagagtttaaggttatctctcttattccctgaacaactgctgttatcctgttcttttttcagggtgcccacatttcatattgctcaaacacacatgctgtacaatttgtgtagttaacgcaattattacagggtcctgagacgatatacatccttctcggctgacaggattaagagattaaagcaaagacaggcctaggaaatcacaagggtattgattggggaagtgataagtgtccatgaaatctttacaatttatgtttagagattgcagtaaagacaggcataagaaattacaaaagtattaatttggggaactaataaatgtctataaaatcttcacaatccacgttcttctgtcatggcttcagccggtccctccgtttggggcccctcacttcccgcaacaacctatagaactgttagctactaaatggatgttgttttaaaccactaagtttgtggtaatttgatatgcagctatagaaaaataatgcaatgctgtattacttttcaaaaattcctcatcatcacgtcttcaaatattgtttctgtaccattctctctcctttttttctaggactcctattgcacatatatcagatctttacacatattaggtgccagacactgttaaaggtgctgaaaatatatcagcaaccaaaaatattcctatcctcatgaagcaccttttaatgacatcctgatcccccctacacctaaactgtttcctcccacagagttcctcctcacagtaaattctagtctcattcaaccagttgcgtaactcaaaaatcagtgcttcaaactcaatacttcattaaaaaaagttttccccccagtcaattatcaagtcatgataacttttatcccctaaatgattctcaaacttcacccaccgtagtgtatctctacttgccaacatgcctgtccaggcccatcattatttctcacttaaagactgcaacagccttctaattgacctatccactcttgccctcccttcaaactttttgcacatggtaggaagagttaactaaaatatgtcagtgtgtcactccatttgaatatctccctaggcttttcaatgtaaaatccaatgtccttaatgtaatgccttctactacctggttctgagctacctctcagcctaacttcctgctacttacctccttgtactttattgcttaaccccagatttaccatgttctttcatatttgaagaaactcatgttcatgctctttgttcaaactggaagcccttcccttcctattctgccttttattcatcttttaagaatcagtctagatatcatctcatctaagaagtcttctctaaactcccagaataaaccagtagctttcttttgttctctcataatagtctttatgtgtttcttcttaatacattatgttgaaatgatatgtttatatgtctttccccctaataatgctggatgttcctcaataggaaggcctatctgtctcattcattttgataccctaacatctagcatggttcctagtacttagcagaactccataaatgtttgtgaaaattgaattgaattattattcttccagcatcatagcccctttaaatctaaaatgtttgcttaatcttaatgtctgcttaagatattttgcttaagtaaataatattgactgggtcaatccaaaggtagggtatacagcagatcatcaaaaaattcatcctttgcctatgatatgttaatcagcactctttgaatatggtgatttaattaattaatacataattatattacttttataacccatattatcttgtccagaaggttatcataaatgacttattagtcttgctgaaatttcattcattcatttaagatatgtaattatgtctgccatatttccataaactacctctaatagccttgtcagaaataagaaccaggtttgtgttgaatggctttgttgataactgtaattttttaagtactcgcttatttgaaaatttgttttagaagctaacttaagagacatttagctcactgattagaagattgaagactccccctttttctttgttagcctcagtaatatatttatataaatccaatcttaaagcacctttcctattttccttaatgccttcgattactgagagtagtttagtaatatcaactgagttacaatttacccattccaggacacatgtactttttctttctgagagtatagttaaaatattgttcttgttgtctttacaaatatgcatttctacaagcctgaggtaattttggaccttatccttccaaatactaaccctttaggcacatgtcaccagttatatttatccttgtgtttgtgccctttttcctatttcttatatattatcttttaaaaaaaagaaagtatgaactcattgtaaaacttcctatgtggccccatggttttcctcttttctcctttaatagaataatttgctgtttcattgtcaaaattatgtttttgagagcttcccaacctttagagtctaaagccatcgtaatgtaaattaaggtccaaaaagtatcaatcataataacagaaacttttggagatcagccatagctagaaattctagtcagagtaggcaattacataataggtcaatctgaatcttttcatggttattactaaggaagaagcattacctcctgaaaggcttaaagccaagagtgcatttagctcctgtcaatttttccttccaaatgtctttcagatttgtccttctctttccattcctatagattccttcatcacctcatacctggcctattgccatagactagatggtttccttgccttcagtccatccatattccaatccattgtccatacactattgccagattaatcttcttaaaacactttcatcatgccattctcctgcctaagacttagctcaaatgtcaccttcttcgtaaaatattcccagctcccttaggaagagttagcaactgcctactcagtgttttcacaggtctctgtgcataaccttattagtgcacttaaaacatgtatgacaatcatttctttaattatttttcttacctcaattgctatgagctccttgaggagaggcaaaggtttgagccatctctttacaattgcactcagggcgttacataatctatcttgccccacccatgtcaggaccatcacatatactgccttctctgcttaccatgctctccccttcattcttcctgctcgttccttaggtctcagattaaatatcaattcattgagaaaccttcgctgacactcttattaactaattaattagttaatcatttgaacaaatatttgtcgggtgtctactttgtgctagacattgttttaggcactagggatataccagtgaacaaagaagacaaaaagtcttgctttcaagtttatcttctagtgggagaaggtagataattaagtataaacataataagttatatatagtaagctataaaaaatagcaggataaagcagtgtgctggaagttggactttgaaacatggtggtcagggtaggcctcattaagaaagatgacatttgatcaaaggaggagttagtcataaggatatctggggtaaagtagactaggcagaggggatagccaatgcaaaggctctaagttgtgattatatctgttgtggccaaaagaaaaaaaaaagaaagaaaaaacattgtagctggagctcactaagcaagaagtaaaataatagatgaagtgagaaaggtaggaataaataggtcaggtcagatcatgtagggccttataagctaatatataaaaactttagtttttactctgatagaaatgatgaaccattgtagggttttaaaactaataggtaacatgatgacacattttaaatgaactgttctggctgttgtattgagaataaactgtaaacaggccaaggaaaggagggatacctgttagtaggctattacagtactggatttattgaagtaatccaggcaagaaatgatagtgacttagactaaggcagtagcagtgaaagtggtgaaaaagggtcagagtctgtttttttgaaggcaaaaacgacaggatttgctgatgaattgaaaatggggtgtgagataaagaggaatgtattagtccattttcacactgttataaaggactacctgaaactgggtaatttataaagaaaagacatttaattgactcacagttctacatggttggagagacctcaggaatcttacaatcacagcagaaggtgaagggaaagcaaggcacgtcttacatgatggcaggagtggggggaattgccacacttttaaaccatcagatctcatgagaactcactcacaataatgagaacagcaaggggaaatccactgccatgattcaatcacttcccaccaggcccctcctctaacattggggattacaattagacatgagacttgggtggggacatacagccaaaccatattatcccacccctggcccctcacaaatctcatgtccttttcacatttcaaacccaatcatgccttcccaacagcccccaaagtcttaactcatttcagcactaaaaagtccaagtccaaagtcttatcggacacaaggcaagttccttctgctatgatcccataaaatcaaaaacaagttagtcacttccaagatacaatgggggtacaagcattgggtaaatgctcccattccaaatgggagaaattggccaaaacaaaggggccacaggccccacacacgttcaaaacccaacagggcagccattaaatcttaaagctccaaaataatctcctttgactccatttctcatatccagggcatgctgatgcaagggttgtgctcccacagccttgagcagttctgcccctgtggcttagcagggtacagccactgaggctgcattcacgagctggcattgagtgcctgtggcttttccaggtgtacagtgcaagctgttggtggatctaccattctggggtctggaggatggtggccctcttctcatggctccactaggcagtgcccagtgtggactctgtgtggggcctctaaccccatatttcccctctgcattgccctagtagaggttctccatgatggttctgcccctgcaacagacttctgcctggacatccaggtgtttccatacatgctctgaaatctaggcagaggttcccaaacctcaattcttgccttctgtgcacccacaggcccaacaccacatggcaattaccagggcttggggcttgcatcctctgaagcaatgtaccatggcccctttaagccacagttggagctggagtggctgggatgcagggcaccatttcccaaggctgcacagagcagggaggccctgggcctggcccatgaaaccttttttttttctcctaggcatctgggcctgtgatgggaggggctgccgcaaaggtctctgacatgccctggagacattttcttcattgttttgaccattaacatttggcttctctttacttatggaaatttctgcagcaggcttgaatttctccccagaaaatgggttttttggttttttcctttctatcatatattcaggctgcaaatttgccaaacttctatgctctgcttcccttttacatataagttccaatttcagaccatttctttgtgaatgcacatgacagtatgctgttaggaacacccaggtgcatataacactatgctgttaggaacagccaggttacttcttgaacactttgctgcttagaaatttcttccaccagataccctaaatcatctccctcaagttcaaagttccacagatctctagggcaggagcacaatgctgccagtctctttgctaaagcatagcaagagtggccttcactccagttcccattaagttcctcagttccatctgagatcatctcagcctggatttcactgtccaaatcactatcagcattttggtcaaaacccttcaacaagtctctaggaagttccaaactttcccacatcttcttgtttctgaaccctccaaactgttccaacctgtgcccactatccagttccaaagtcacttccacattttcagttatctttatagcaatgtcccactctcctggtacccattttctgtattcgtccattttcacactgctataaagaactacctgagactgggtgatttgtaaaacaaagaggtttaattgactcacagttctgcatggctgcaaggcctcatgaaacttaaaattatggcagaaggtaaaggggaagcaatgcacaccttacatggtagcaggagacagacagagcaaaaggggaagttccacacttttaggccatcagatctcctgagaattcactcacaatcatgagaacaacaaggagaaagtccacccccatgattcaatcactttccatcaggcccctcctctgacatgtggggattacaatttgagatgagatagcaggagtggggaacagagccaaaccatatcaaggaatgaatgataacccaaggtatttggactgaaaaactgaaaggatggggaagactgctggaggatgtttggaaaaacagattagaattttagttttggatctgttaaatttgagatgtctattagatttttaggtggaaatatcagagaggcagttggatacatgagtcttgagttcaggggagagatatgagctgcagatacaaatttggcagttgttccatagttggtatttaaagtcaggagactggatgagactaccaaaggaattggtatagacagagaaaagaagattaacatttgttagtttctcatagatccttttattcttcaatgcacttattacaacttgtaattatttgtttatttgtttttatttctgtgattgtttggctaatgtctggttgccttattacaagaaaatgttccaatgagagcagggtctatgccattttctccatcacaatcagcaaaataatatgttggattgcatgaattaaaagaatgttcctttttttcaaggactcaaaattaaatgctcacaagggctaggcaagtaacataaataagtcgagtataagagacaatgtgttgtagagagaggggtgaactgaagtgtccaaaaatcatagccactacttagttccagctgattatggacagataggcctagtgttgtaatcttcagaatttttgaaatgagccagatatacagattatatatgaaatctcccaaattgtaatgccaacaactgtattagttcaggtcttctaaaaaagcagatgccatgataaaaatagatgtgcaagtaatttactggggaaaagatatgtgaggggaagtgggaagagtgtctagacttggagggtcatcagaccatggtacaggtcctatccctgtggaagacagaaagaaggaagcacagtctcagactgcaatgcagatctaagaaagtttcaggaaggctgttggggaatactcaagccaaaggtggccattaaaggagtctgggtctccaaggaatgggctctcattagtattcttgccatggtcattcagtagtttggaacagttgatgggaagtgtagccttggaagaaagaaacaatgatggatgatagaacacagcagctgggccctcagtcagctatactccctttagtaggagatatgagtggcacattgtggtgggcatcacaatgactaaattcaacaatgccacaacagtatgagccaaaaacacatcttcaagccatattcagccccaatgtggacagttgtcaacctctgctctagtcactaacatatactttaccatcaatgggctagttatgtatagatcctaacataggccaaaatggattgccaatagcatctaggtagtagagtttaagttaccaggtgagaacatgaaaagcattagccaaagtgggtttaaaatgtgctgccagaatagaggtagtttcagagtatgaaggagcaaaaactacaatccaaaaggaaaaggtatgagttaaagcaaagtgtctacaagcattatacgaacataaacagtgaagtcaaaaagcagaaatagtttataataattgactaagcagagcatttcagatcttttgtctgtgaaaggagaataagcactgttatatgtatttactgtcaacaatatgctgtgagaggaaagggaagaccttaaagaatttggagtctgaaaggcagtgacaactgtggcctttggtgagagacaataatatcaggcagggcatagccaattacatcagtgtatctaccataatgggtatggcttgtggtactgaaaagcagggcaggacaaggttgaagtaaagtttaggtcaaacaaaggtggtctagggtcaagagtaggtgaaactaccccttgagtttcctggtatgtccttgattccaatgcatggacttcatgtttccatgtaccaaaagacattatgtcagatgcactgccatgaaaggtcttaaaaggacttctaggggctgcagaggcacactggggtggcattataatatgggcagaaaagtagggcttggacttagcccatcaagacttacaaatggcagtgaaagttcagttcctccaatccacagtcacacacacacacctcatccacacatttatttgccaggtgccaagtaaggtttttctgaatgtccaccatgctctgctgagcacaggtgttggtatactgttgcttctgaatgaaatctattgactctactgctaggtggaagaggtgcctcgatactctggagatactgacttgaaaatggggaccacccacttgccctttggggggtagcctttggctgctgtgagtttgtagtaaaagtataggcaaggcaccccatcaccccgtgggggtctcctgcattgctctgttggagaagtccctttctcagatgcatagatgttgtgggataagatacggtataaatgaagagccccctaaatgccttaggttgctttgaaaacctagggaccattatgaatctgagacactatgatgaatagctagaaaaaaaatgttccaacagaagcaatgctgtatggttaacacctttaaagtaaagcctgaaccaaggctatgtgcatctgtgtgttttccagggacagtagatgcagcaaagtgacttcaaggttagtgattatactcctggattctgttatctggccagttagcattcttaatttgaagaaacacagtttcttatctctgggccatactttgcagctatattgtctactggggcaccattatctcctccaagggtatactatgttgccactagaatcattgtatcaaagatatatttttctaggaggcagatgtcacaatccaagaaggatttcttccagtctaagcaggaaggttgtgagcaatgctaaaaccaggaaataaaccatcaaggactgtccaaggatgacctactaacatggcaatataagattgtagtcagggggacagaaggtaacaatgagtgttcaacatgaaggataaggcagatatacaacagaagaacagacagcaaagttggttcctgggagagtaaagtaagagatgggccaatgttagattgaatggttcattatttccctgtgaatggccacttaaggtaccagaactccctttttatgggttgaggtacacgctgagagagtaggtatatgtgactaaaagagacacactaacctactcaggagatgtcaatggtcctgttcatggtgttgctcataatacttcaacctgggatgctctcttcactctatataaaatctctcttcattcttcaaagaccatttcaaaatctgttcattcaaagaagtcttcctcacttcatttggactacacagatttctatctttcctgatggccagtgatgcatactatttgaaccaaacgtgctggtgttatcttgattttaactgtcctcctaattggttcatcaagtatgtaagctttgattctctagctaagctgcaaatcccatgagtttggagagtaaatttacttgtaacctccacagtgtcaaacatatactaagaacttaatacatttttatgtgaattaacaaatcaagatccaacaatcattggttgcagaataatcagaaatgtctggggaatggccgcagttggaaactctagtcagagcagcaactgcatatgggccaacttcgatatctttatggttactacaaagaaagaaacagcatctcctgaaaggctgcaagccaacagctagagcatttgacttcctgaatgactggcagttacatctgaacataatgactgcattaggaattgaaataaaaacaatttttcctatactttttgtgcagtacaagaagcaatctaagaacttgaaatcccaaatgtctatttatctcaagttacaaaataaaacgaaacaagctatccaattaaaaaaaataaatcacccataatagatacctaaaataaatacaggggacacaggaatagctgagtgaggagttcaataaagttattcaaaatgcaaaaataaactggacaaagttgtcaaaaacaaccacatcatgactctggaaaccgacaaaatcatacaacaaattgagaagtattaattcaagaaaaactattgaatcttgagtacaaatggtagaaatctatggcattttaacctggggtcattcccattccttccaccagccctgtggcatggtcattttaaatgtacagtggaagaccgaagaactgaaagctccactgatggagggtgctgccatcatttgtagaagatcacaataaaacccatatccacttcagaggtcaggcagccaagatggccgaataggaacagctccagtctacagctcccagcgtgagcaacgcaaaagatgggcgatttctccatttccatctgaggtactgggttcatctcattagggagtgccagacagtgggcgcaggacagtgggtgcagcacactgtgcacaagccgaagcagggcgaggcattgcctcactcaggaagcgcaaggggtcagggagttccctttcctagtcaaagaaaggggtgacagatggcacctggaaaatcgggtcactcccaccctaatactgcgcttttccgacaggctgaaaaaacggcgcaccaggagattatatcccccacatggctcagagggtcctacgcccacggagtctcgctgattgctaccacagcagtctgagatcaaactgcaaggcagcagcgaggctgggggaggggcgcccaccattgcccaggcttccttaggtaaaaaaagcagccgggaagctcgaactgggtggagcccaccacagttcaaggaggcctgcctgcctctgtaggctccacctctgggggcagggcacagacaaaaagacagcagtaacctctgcagacttaaatgtccctgtctgacagctttgaagagagcagtgattctcccagcatgcagctggagatctgagaacaggcagactgcctcctcaagtgggtccctgacccctgacccccgagcagcctaactgggaggcaccccccagtaggggcagactgacacctcacacggctgggtactcctctgagacaaaacttccagaggaacgatcagacagcagcattcgcggttcatgaaaatccgctgttctgcagacaccgctgctgatacccaggcaaacagggtctggagtggacctctaacaaactccaacagacctgcagctgagggtcctgtctgttagaaggaaaactaacaaacagaaaggatatccacaccaaaaacccatctgtacatcaccatcatcaaagaccaaaagtagataaaaccacaaagatggggaaaaaacagagcagaaaaactggaaactctaaaaagcagagcacctctcctcctccaaaggaacacagttcctcaccagcaacggaacaaagctggatagagaatgactttgacgagttgagagaagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactacgtgaagaatgcagaagcctcaggagccgatgcgatcacctggaagaaagggtatcagtgatagaagatgaaatgaatgaaatgaagcgagaagggaagtttagagaaaaaagaataaaaagaaatgaacaaagcctccaagaaatatgggactatgtgaaaagaccaaatctacatcgtattggtatacctgaaagtgatggggagaatggaaccaagttggaaaacattctgcaggatattatccaggagaacttccccagtctagcaaggcaggccaacattcaggttcaggaaatacagagaacgccacaaagatactccttgagaagagcaactccaagacacataattgtcagattcaccaaagttgaaatgaaggaaaaaatgttaagggcagccagagagaaaggttgggttacccgcaaagggaagcccatcagactaacagtggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaacagctcctgaaggaagcactaaacatggaaaggaacaactgataccagccactgcaaaatcatgccaaattgtaaataccatcgaggctaggaagaaactgcatcaactaacgagcaaaataaccagctaacatcataatgacaggatcaaattcacacacaacaatattaactttaaatgtaaatggactaaatgctccaattaaaagacacagactggcaaattggataaagagtcaagacccatcagtgtgctgtattcaggaaacccatctcacgtgcagagacacacataggctcaaaataaaaggacggagaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatgctaaatatatatgcacccaatacaggagcacccagattcataaagcaagtcctgagtgacctacaaagagacttagactcccacacaataataatgggagactttaacaccccactgtcaacattagacagatcaatgagacagaaagttaacaaggatacccaggaattgaactcagctctgcaccaagcagacctaatagacatctacagaactctccaccccaaatcaacagaatatacattttttttcagcaccacaccacatctattccaaaattgaccacatagttggaagtaaagctctcctcagcaaatgtaaaacaacagaaattataacaaactgtctctcagaccacagtgcaatcaaactagaactcaggattaagaaactcactcaaaaccgctcaactacatggagactgaacaacctgctcctgaatgactactgggtacataacgaaatgaaggcagaaataaagatattctttgaaaccaatgagaacaaagacacaacataccagaatctctgggacacattcaaagtgtctagagggaaatttatagcactaaatacccacaagagaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaagactcttcaaaaaattaatgaatccaggagctggttttttgaaaggatcaacaaaactgatagaccgctagcaagactaataaagaagaaaagagagaagaatcaaatagacgcaataaaaaatgataaaggggatagcaccaccactcccacagaaatacaaactaccatcagagaatactacaaacacctctacacaaataaactagaaaatctagaagaaatggatacattccttgacacatacaccctcccaaaactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtactattccttctgaaactattccaatcaacaaaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcaggctaaaaactctcaataaattaggtattgatgggacgtatctcaaaataataagagctatctatgacaaactcacagccaatatcatactgaatgggcaaaaactggaagcattccctttgaaaactggcacaagacagggatgccctctctcaccactcctattcaacatagtgttgtaagttctggccagggcaattaagcaggagaaggaaataaaggctattcaattaggaaaagaggaagtcaaattgtccctgtttgcagacgacatgatcatatatctagaaaaccccattgtctcagcccaaaatctccttaagctgataagcaacttcagcaaagtctcaggatacaaaatcaatgtgcaaaaatcacaagcattcttatacaccaataacagacaaactgagagccaaatcataagtgaactcccattcacaattgcttcaaagagaataaaatacctaggaatccaacttacaagggacgtgaaggacctcttcaaggagaactacaaaccactgctcaatgaaataaaacaggatacaaagaaatggaagaacattccgtgctcatgggtaggaagaatcaatatcgtgaaaatggccatactgcccaaggtaatttatagattcaatgccatccccatcaagctaccaatgactttcttcatagaattagaaaaaactactttaaagttcatatggaaccaaaaaagagcccgcattgccaagtcaatcctaagccaaaagaacaaagctggaggcatcacgctacctgacttcaaactataccgcaaggctacagtaaccaaaacagcatggtactggtaccaaaacagagatatagatcaatggaacagaacacagccctcagaaataacgccgcatatctataactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttagacctaaaaccataaaaaccctataagaaaacctaggcattaccattcaggacataggcatgggcacggacttcatgtctaaaacaccaaaagcaatggcaacaaaagacaaaattgacaaatgggatctaaactaaagagcttctgcacagcaaaagaaactaccatcagagtgaacagacaacctacaaaatgggagaaaattctcacaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaacagacacatgaaaaaatgctcaccatcactagccatcagagaaatgcaaatcaaaaccacaatgagataccatctcacaccaggtagaatggcaatcattaaaaagtcaggaaacaacaggtgctggagaggatgtggagaaataggaacacttttacaccgttggtgggactgtaaactagttcaaccattgtggaagtcagtgtggcgattcctcagggatctagaactagaaataccatttgacccagccatcccattactgggtatatacccaaaggattataaatcatgctgctataaggacccatgcacacgtatgtttattgcggcactattcacaatagcgaagacttggaaccaacccaaatgtccaacaatgatagactggattaagaaaatgtggcacatatacacaatgaaataccatgcagccataaaaaatgatgagttcacgtcctttgtagggacatggatgaaattggaaatcatcattctcagtaaactatcacaagaacaaaaaaccaaacactgcatattctcactcataggtgggaattgaacaatgagaacacatggacacaggaaggggaacatcacactctggggactgttgtggggtggggggaggggggagggatagcattaggagatataactaatgctaaatgacgagttaatgggtgcagcacaccagcatggcacatgtatacatatgtaacaaatctgcacattgtgcacatgtaccctaaaacttaaagtataataataataaaataaaataaaataaaataatacaacagagcacacacacacacgaaactcatatccagtggcattgctgaaaacaatagcaaaatcagtggcaagcaatcaaggaaggccaatatgacagctagcctaaagcctccataatggttgtagagagccacaggccagaaggcctgccagcaagaaatttaacagggatatccaggtaatgagacagccaaagtaggccttgaaaagttctgacatatcactgggggtttggcagactacgtatatttacaaactgcacacttgcttatgaaaggtcagagtggatcctagatatgcacttgtccctgggagaacatgagtccttgtccacacagaaagtaagagtgagacaggcttgtaaacagcctgaactttgaatttgtttcccatcccacatgcagatccacttttcaaagggtagaaacttagccttactggttaaagattttaattgcaatctctgaccaaccattaactgaccactaagctatgctgatacagaggtaatattgtctaaaacgtccagttttccttaaaaaatattagacatgagtgtgtattccatacatggggtgaaaacagcagtcaacaaaaaccatttctaggggctcagatgttgcacgcaacagacaaggacaaaaaatgtactcaaagaacaaaagaacaaaataaaccatgtttaatgaattaaaggaaattaggagaacaattacttagcacacagaacatcaacaaagagacagaaattataaaaaaagaaaaatggaaactctggaattgaagggtataataactgaaatgaaaaattcactagggagactacacagattgctctgacagaagaaggaatcaacaagcttaaagatagattaatagagataacttgatctgtagaacagaaagaaaaaatttaagaaaaatgaacagagctacagagacctgtgggatagcaccgaacacaacaacctgtattagtttactaagactaccataaaaaagtgccacgaactgggtggcttaaccatcagaaacatattatctcacagttctggaggccagaagtctgagaccatgtgttggtaatgttggttccttctaagggctatgagggaaagatatgttccagaccactttccttggcttgtggatagccatcttctccctgtcttcacatcatttcccctctgcatgtatctgtctccaaattttccctttttataagaatataagttaaataatttcattttaatttgattacctctgtaaagaccttatcttcaaataaggttgcattctcagatatagagggttatgactttaacatacgaattttggagggacaaaattcaatgcatatcgtaacatatgagtcattggagtccaagaaaaagcagagagacaaaaagggacagacaaaatatttgaaaatataattgtcagaaatttcccaaacttgatgaaaaatattaatctacacatccaaggatctcaacgccaaggatgataaacacaaagaaatctacatactgaaaaatcacaataggctgttgaaagccaaagaaaataagcaagtttcaaagaaacaaaagaaaaaatgagcaaaccaaatccagcagcacaataaaaagctaatccaccgcaatcaaatagactttacccctgggatgcaagtttggttcaaaatatgcaaatcaataaatgtgattcatcacataaacagaactaaaaacaaaaactacatgattatttcaatagaagcagaaaaggcttttgataaaattcagcatctgttcatgttaaaacaaattaggcactggaggaagatgcctcaaaatagttaacagccatctataacaaacccacagccaacatcatactgaatgagcaaaagctggaagcattccccttaagaaccagaacaaaacaaggatgtccagtttcaccactcctattcaacatagtactgggagtcttggccagagcagtcaggcaagagtaagagataaaaggcatccaaataggaagagaggaagtcaaactatctctgtttgcagattatataattctatacctagaaaaccccatagtctctgccaaaacctcctagatctgatttaaaaaaaaatcagcacttcagcaaagtttcaggatacaaaactcaatgcacaaaaatcagtagcatttctatacaccaacaacatctaagctgagagccacatcaagagtgcaatcgcattcacaacagccacaagaagaataaaatacctgggaatacagctaaccaggaaggtaaaaaatatctacaatgagaattacaaaacactgctcaaagaaatcatagatgacaccaacaaatgggaaaacattccatgttcatggataagaagagtcaatattgttaaaatggccatactacccaaagcattttacagattcaatgctattcctatcaaactaccaatgacattcttcacataattagaaaaaaaatctaaaattcatatgaaaccaaaaagtagcctgactagccaaaacaatcgtaaggaaaaagatcaaagctggaggaatcacattacttgactttaaactacactacaaggctactgtaagcaaaggagcatggtactggtacaaaaacaaagatatagaccaatggaacagaatggagagcccagaaataaagttgtgcacctataaccatctgatcttcaatgaagttgacaaaagcaagcaatgaagaaaggattccctattcaataaatggtgctgggataactgctagccatatgcagaagattaaaactggaccccttccttataccatatacaaaaatcaactcaagatggtttcaagacttataaatgtaaagcctaaaactacaaaacccctggaagataacctaagaaataccattctggacacaggcccagtgaaagatttcataacgaagatatcaaaagcaattgcaatgacaacaaaaattgacaaatgagacctaattaaactaaagagcttttgcacagcaaaagaaactatcaacagagtaaatagacaacacacagaatggggcaaatatttgcaagctatgcatctgacaaaggtctaatatctggaagctataaggcacttaaattaacaagcaaaaaccaaacaaccccattaaagagtgggcaaaacacatgaacagatacttttcaaaagaagacatacacatggccaacaagcacataaaaaagtgctaaacatcaccaaatcattagaaaaatgtaaattaaggcctggtgcagttggctcacacctgtaatcctagcacttttgggaggccaaggcgggtggattgcctgagctcaggagtttgagaccaggctgggcaatatggtgaaaccccatctctactaaaaataaaaaaaattagttggccatggtggtgtgcacttgtagtcccagatactcagggaggctgaggcatgagagttgcttaaaccaaggaggcagagactgcagtgagctgagatcacaccacggtgctccaacctgggcaacaaagcgagactctgtctcaaaaaaaaaaaaaatagaaaaatgtaaattaaaaccacaatgagataccatctcacaccagtcaggttcatagtggctgattagatgtagctagtatatgccccttccatggagataatactaacagcccagctctcaaagaactattaggttggtgcaaaagtaattgcagtttttgccttaacacatccagccctggtgccactgccactgctgccaccactggccaaggagggaaagaagagatcaggcactttcacacactctgaggacgaatcccatccctgctgctgctgcaggctgctgtgaaacgaaagagaaagaaaaccatgtaacacacaggtgcctgcctatgttgctcccactgatagtggtcccaccctatatggtgacaggactacagctgctaccattgagagcccagtccccaaagaactgcatcctgccctggggctaatgctgccactgccaccatcaggcccaggagggagatgggggaggcctggcacttttacatgccccaaggaaaagttgtactagtgctgctgtaggctgtaggaccaaggtatgagcaggctgtgtgccccacaagtgcctgcttgcactgctgacaatgacaatggccccatcctcccagatggcaggcccacagtgcagccaccactgcccccacctgaatatcctgccggcagcctggagacaaccctgcccctgcctatcacagctatagcctgaatacactaaccagggtccctgagggcaagtacactaacccagtcctatgcccccagtactcaagtatgctatccagaggcctggggatctctcagcccagtccataccagtggaacctgagtactcttcccagggtctgaagttgggctgacccaacataccaataccaccactgctggcaaacaccaacacatatcacctgtgtgccaggagattggcccacccaacccattgctgccacggcaaagacgagcttcaaccacataggttgtaggaggatgccccatcaatgctattgccattgcccacatcatgcccactgcacaggggcctgagaacctgcccataaacccggccaaacattgtcactgctgacatctgaacaagccacccggaggcccaagaattggcctgccttcacctgttaacaccagagccagaatacatggctctggggttcaaggacaggcaagctcagcccactgctgccaccactggggccccaaaactggcacacttcacatcacagccccagaaaaactttgccctagaaaaccctaaagactttctccaaaaaacttgtagagttgatttcagtaaactttcaggaaacaaaatcaatatacataaattagtagcatttctatatgccagtaattatccagctgagaaacaaattaagaaggaaatcccatttacaatagctacaaaaaataaaatagtaaggaatatatttaaccaagaatctctacaaggaaaactacaaaacactggtgaaagaaattgtacatgacaaaaatggggaaaaacatcccatactcatgggtcaaaagaatcaatattgttaaaatgaccatactgctcaaagtaacctacagattaaattgcaatccctatcaaggtacccacatcatttttcacagaattagaaaaaaattataaaattcatatgtaaacaaaaaagagcctgaatagccaaaggaatcctaagcaaaaagaacaaagacggaggtatctcattacctgacttcaaattatactacaaagctataggaaccaaacagcatggtactggtataaaaacaggcacacaaatcaatggaacagaatagagaacacagaaataaaaccacatatctacaaccaactggtctttgacaaaggtgacaaaaacacacaatggggaaaagacaccctttatttttctttttcaacttttgttttagaattagaggttacacgtgcaggtttgttacaaaggtatattacataatgctgaagtttggggtatgactaaatctgtcactctggtagtgaacatagtacccaataggtagtttctcagcctttagccccctctttctctcccacctctagcagtccccagtgtctgtctattgttcccatctttataggacatcattttcaataaatggtcttgggaaaattggattgccacatgcagaggaatgaaactggactcctatctctcaccacataaaaaaatcaacttaagatggagtaaatacttcaatataaaaccagaaactatacaaatactggcagaaaacccagggaaactgctggatattggtctaggcaaagaattcacaactaagacctcaaaatcgcaagcaacaaaaaaaaaaaaatagaaaaatgggacttcattaaaaagctcttatacagcaaaataattaatcaaccaggtgcacagacaacctggagaatgggagaaaaatatttgcaaacgatgcatccaacatgaacctagttctcagcagccagcactcaaattcacaaggaacatgaacaactcaacaacaacaaagaaaacaaataactccattaaaaagtgggtgaagaacataaatagacatttttcaaaagaagacatacaaatgaccaatagacatatgaaaaaatgctcagcatcactaatcactggagaaatgaaaattaaaaccacaatgagatatcatcttacaccagtcagaatggctattactaaaaagtaaaaaaaaacagatgttggtgaggatgctaaaagggaatgcttatacactgttgatgggaatgtaaattaatataacctctacagtatggagatttctcaaataagtaaaaatagaactaccgtttgatccagcaatcccactaataggtatctacccaaaagtaaaaaagccattatataaaaaggatacatgtacttgtatgtttattgcagcactatattagtccgttttcacactgctgataaagacatacctgagactcaacaatttacaaaagaaataggtttaatggacttacagttccacgtggctggggaggcctcacaacgatagcagaaggtgaaagacacatctcatgtggcagcagacaagagaagagggcttgtgcagggaaactactctttataaaaccatcagctctcctggtaccatttcttctgaaactattccaatcaatagaaaaagaaggaatcctccctaactcattttatgaggcaagcatcatcctgataccaaagcctggcagagacacaacaaaaaaagagaattctagaccaatatccctaatgaacatcgatgcaaaaatcctcaataaaatactagcaaaccaaatctatcagcacatcaaaaagcttatccaccatgatcaagtgggcttcatccctgggatgcaaggctggttcgacatatgcaaattaatacatgtaatccatcatttaaacagaaccaaagacaaaaaccacatgattatctcaatagaagcagaaaaggccttcaacaaaattcaacagcccttcatgctaaaaactctcaataaactaggtagtgatggaacgtatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaaaggtatttgattaggaaaagaggaagtgaaattgtccctgtttgcagacaacatgatgtatatttagaaaaccccattgtctcagccccaaatctccttaagctgataagcaacttcagcaaagtctcaggatacaaaatcaatgtgcaaaaatcacaaacattcctatacaccaattacagacaaacagagagccaaatcatgagtgaactcccattcataattgcttcaaagagaataaaatacctaggaatccaacttacaaggaatatgaaggacctcttcaaggagaactacaaaccactgctcaataaaataaaagaggacacaaacaaatggaagaacattccatgctcatggacaggaagaatgaatatcatgaaaatggccatactgcccaaggtaatttatagattcaatgccatccccatcaagctaccaatgactttcttcacagaaattgaaaaaactactttaaagtccatatggaaccaaaatagagcctgcattgccaatacaatcctaagcaaaaagaacaaagctggaggcatcatgctacctgacttcaaactatactacaagactacagtaaccaaaacagcatggtactggtaccaaaacagagatatagaccaagggaacagaacagagccctcagaaataataccacacatctacaaccatctgatctttgacaaacgtgacaaatacaagaaatggggcaaggattccctatttaataaatggtgcttggaaaactggctagccatatggagaaagctgaaactggatcccttccttacaccttatacaaaaattaattcaagatggattaaagacttaaatgttagacctgaaaccacaaaaaccctagaagaaaacctaggcaataccattcaggacataggcatgggcaaggacttcatgactaaaacaccaaaagcaatggcaacaaaagccaaaactgacaaatggatctaattaaactaaagagcttctgcacagcaaaagaaactaccatcagagtgaacagacaacctacagaatgggagaaaatttttgcaatctacccatctgaaaaagggctaatatccagtatctacaaagaacttaaacaaatttacaagaaaaaatcaaacaactccatcaaaaattgggcaacagatatgaagacacttctcaaaagaagacatctatgcagccaacagacacatgaaaaaatgctcatcatcactggccatcagagaaatgcaaatcaaaaccacaatgagataccatttcacaccagttagaatggcgatcattaaaaagtcaggaaacaacaggtgctggagaggatgcagagaaataggaacagttttacattgttggtgggactgtaagctagttcaaccattgtggaagacagtgtggcgattcctcaaggatctagaactagaaataccatttgacccagccatcccattactgggtatatacccaaaggattataaatcatgctgctataaagacacatgcacatgtatgtttattgcgaaactattcacaatagcaaagacttggaaccaacccaaatgtccatcaatgatagactggattaagaaaatttggcacatatacaccatggaatactatgcagccataaaaaatgatgagttcatgtcctttgtagggacctggatgaagctggaaaccatcattctgagcaaactattgcaaggacagaaaaccaaacaccacatgttctcactcataggtgggaactgaacaatgagaacacttggacacagggtggggaacatcacacactggggcctgtcgtggggttgggggatgggggagggatagtattaggagatatacctaatgtaaatgatgagttaatgggcgcagcacaccaacatggcacatgtatacatatgtaacaaacatgcacgttgtgcacatgtaccctagaacttaaagtataataaaaaaaaagaaaagaagaaagaccatcaaaaaaataaaataaataaaaccatcagctctcgtgagacttattcactatcatgagaacagcatgggaaagacccacccccatgattcagttacctcccaccaggtccctcccaccctcccacaacatgtaggaattcaagatgagatttgggtgtggacacagccaaaccatatcaagcactattcacaaaggcaaaggtatggaattaacctgaatgtccgttaatggatgactaaataaaatgtagtacatatgcaaaatggaatactattcagccataaaaaataataaaattgtcttttgcagcaacatggatgtaactgaatgccattatcttaagtgaaacaacagagaaacagaaaagaaaatgccacatgttctcacttataagtgggaactaagtaatgtgcacacatggacatagagtgaggaatgataaatatcagagacttggaagggtaggaggggagtgagggatgagaaattatttaatgagtacaatgcacattattcaggtgatggttaccctaaaatcccagacttcattactaggcaatatatccacataacaaaactacacttgtacctcatatatttatacaaataaaaagaggaaaagaaaaaaattcacaatgactttccagcaacagatcccaatcaaaaagatattcacaaaatcccagataacaaattgaaaatacaaattttaaagaagctcagcaagataaatgagaaatctgaaaaacaaaaataaatcagaaaaacaattcaagatatgaattagaaatttttcaaatagatatttttttaaaaaagaacccaacaaaaattctgaaactgaagaattcattgaataaaatataaaatacatttgaaagttacaacaatagattaggtcaagcagaagaaagaatttcagaacttgaagacaggtcttttgaaataatccagtcagaaaaaaaaataaataaaaaagaattaaatagaatgagcaaaaccttcatgacatttgggataccataaagtgatcaaatctttgaattatcagtgttctcaaggctgaagagagaacaaaatgatggaatcctatttaatgaaataataggtgaaaaattcccaagtctagcaagagacttcgacatccatatgtctatatggggctcaaacatccccagaaatacaatgcataaaggttttctccccaccacattatagtcagtctctctaaagtcaaagataaaacaggattctaaaaatagcaagagaaaaatgtctagccaccaataaaagaactctcatcagactaacagcagatttctcagcagaagtcttacaggacaggaaagaatgagatgatgtattcaatgtcctgaaagaaaaaaaaactgccagccaaggatactatccccagcaacgttttcactcataaatgaagggaaatttatgatttccctcataaatgaagtctttttcagagaagcaaatgctgagagaattttcaccactagatgagtcctacaagaaatgctcgagtcttaaacctgaaagcaaaatgacagtatttaccaccatgaaaacaaacaaaagtataaaacccactagtaaaccctacacacaaatgaggaagagaatggactcaaatgataccactacagaaaatcaccacaccaaaataacaaacaataagagaaaacaaaaggaacaaaaaatatacaaaacaaccagaaaacaattaacaatatgataagaacaaaacctcacatagcagtgataaccctgaatgcaaatggactaaattctccacttaaacatatagactggctgaatggattttaaaaacatggtccaactgtatgctgcctccaagaagagcactttacctgcaaggatacatatagacaaagggggataatgaagacattacatgcaaatggaaactaaaagtaaacaggagtagctatacttagataaaacagactttaggtgaaaaacagtaaaaagacaaggtcattacataatggtaaattaatcaagcaagaggatataaattatacacacacacaaacacacacacacacacacacacacacacacacacacatatatatatgctttatgaatctgtgtgctccatgaaaataaacaaaatgttttgtatgtttggagtacatatatgcactcaatcctggagcacacagatttgtaaagcaaatattgctagatataaagggagagaaagattccaacacaataataatggggaactttaacagcccactctcagcattagacagatcatctagacagaaaatcaacacagaaacattggatttaaactggtaaactgatccttagaccaaatggacctaacagatattaaagaaaatttcatccaacaattacagaatgcacattcttcccacaggcacatgagacactcttcaggatagaccatatgctggctacaaaacaagtctcaacaactttttaaaaactgaagtcatatcaagtatttcagaccaaaatggaataaaattagaaatcaatagcaagaagaactttagaaactgtaaaaatccatcgttattgggccaggcacggtggctcatgcctttaatcccagcactttggggaggccgaggcgggcggatcacctgaggttgtgagttcaagaccagcctgaccaacatggagaaaccccgtctctactaaaaatacaaaaaaattagccaagcatggtggtgcatgcctgtaatcccagctactcgggagcctgaggcaggagaattgcttgaacctgggaggcagaggttgcagtgagtgagatcatgccattgcactccagcctgggcaacaagagcaaagctccgtctcaaaaaaaaaaaaaaaatccatggttattaaacaaaaagctcctagatggcattgagtcaagaaataaattagggagagcaaaaaatttcctgaaacaagtgaaaatgaaaacaacacatacgcaaaagtacagggtacagcaaaagcagtgctcagaggaaagtttatagcaataaatggctacatgaagaaagtacaaatatttcaaataagcaacataacaacgcacttgaaggaactagaaaaatatgaacaaaacccaaaattagcagaaagagaaaaaataataaagataagagcagaattaaacaaaatagagactcaaaaaatacaaagatcaacaaaatgaaaatttggttttttgaaaagataaacaagttttataaacaactcactaagcaaatcaaaaaagagagaagacccaaataaacaaaattagaaatgaaaaaggagatattacaactgataccaaacagaaatacaaaagatcatcagagactattatgaacatctatacactaacaaagtggaaaacctacgggaaatggataaatcccttgacatacacaatgtgtcaaagttgagtcaggaggaaatagaaaagctgaacagatcaataacaagtagtgagattgaaccagtaataaacagtctcccaaagaagaaagctcaggaccagatggattcacagatgaattctatcaagtgtataaagaacaactaatattaaccctcctgaaactattctaaaaaattgaagaagagagaactatccctaactcatttaatgaggccagaattaccttcataccaaaatctggcaaagacacaacagaaaaagaaaagtaaaggctgatattcctgatgaacacagatgcaaaaatcctcaacaaaatactagcaaacaaaatccaacagcacatcaaaaagataatacaccacaatcaagtgagatttatcccagggatggaaggatggttcaacatatgtaaaccaatatatgtgctacaacccatcaacagaatgaaggacaaaaattatatggtcatcttaatagatgcagaaaaagaatttgataaaattcaacgtcctttcatgataaaaactctcaacaaactagtatagaaggaatatacctcaaaaacataaaggtcatatataacaaacccacagttaacatcataccaaatggaaaaaagctaaaagccttacctctaagaaatggaaaaagacaaggatgcccactttcaccactcctgttcaacataatactggaagtgctagccagagcaaccaagcaagagaaagaaataaaacgcatccaaattggaaacaaggaagtcaagtcactctctttgctgatgatatgatcttatatctaaaaaaatctagagactctactaaaaaactcctacatttgataaataaagtaacattttaggatacaaagtcaacatacaaaaatcagtagtgtttatatatgccaacaatgatctagccaagaaagaaagcaggcaatcccattgacaatagctacaaaaaataaaatacttgggaataaatttaatcgaggtgaaaaatctttacagaaaaactaaaaaatactgacaaaagaaatttaagagaacagaacaactggaaaacatcccatgcttaagtattggaataattaatattattaaaatgaccaaattacccaaaccaatctacagattcaatgtgatccctatctaagaaccaatgttattttacacagaattagtgaaaacaatcttaaaatttgtatggaactaaaacagagcccgagtagccaaagcaatactaagcaaaaagaacaaagatggaggcatcacattacctgacttcaaattatattacaaggctatagtgtctaaaacagcatggcattggtataaaaacagatgacacatagacaaatggaacagaatagagagtctagaaataaatccatgtacttatatccaactgatttttgacaaagataccaagaacatatactggtgaaaggaaaccctcttcaatagatgattctgagaaaatgggagacctgtatgcagaagaataaaactggacctctttctctctccatataaaaaattaagtcaagaaggattaaagtcttaagcatgacccaaaccgtttaagcagtagaacaaaacacagagaaaacattggtctaggtaaagatttcatggctaagacatcaaaggcacaattataataaaaacatacaaatgagactttattaaactaaagagcttttgtacagcaaaagaaacaatcaacagagtgaagagacaacccattgaatgggagaaaatatttgcaaattattcatccaacaagggactaatatccagaatctagaaggaactcaaagaactcaacaataaaaaaaaaaatcccgttaaaaagtgaacaaaggatatgaatagacatttctttttaaaatacatacaaattgccatcagctgtaggaaaaaaatgctcaacatccctaatcatcagggaaatgcaaattaaaaccacaatgagatataatcataccccagctaggaagcctattatttaaaaaacaacaaatgaacaaatgttgatgaggatgtggataaaagggaactctcatctgctggtggaatgtaaattagcacaactatggaaacagtatggaggatgtttcaaaaaactaaaaatagaattaccatatgatctagcaatcctataatagtactgggtatttatctaaaggaaacaaaatctgtatatcaaaagaatacctgcacttacatgtttataacagcactattcataatagcaaagatatagaataaacctaagtgtctattgaagaatagataaagaaaaatttggtatatatacataatggaatactattcaccataaaaaagaatgaaatcggctgggtgtggtggctcacgcctgtaatcccagcactttgggaggccgaggaggggagatcacctgaggtcaggagtttgagacctgcctggccaacatggagaaaccctgtctctactaaaaatacaaaaattagctgggtgtggtggtggacacctataattccagctactctcgggaggctaaggcaggagaattgcttgaacccgggaggcggaggttgcagtgagccaagatcacaccactgcactccagcctgggtgacagagtgagactctctcaaacaaacaaacaaaaaaacaatgaaatcatgtcatttgcagcaacatggatggaactggagttaagtgaaataagccaggaacagaaagacagatactgcatgttctcactaatttatgaaaggtaaaatcactgatttcatgaagatagagaccagaatgatagatattagaggtcgagaaggatgtgtggatgggagaagtgatatagaaagattggttagtgggtaccaacatacagttgaatagaataaataagttccaataatctataccagagtgactacagttagcaacaatgtattatatattccaaagtagctaaaagagaggacttgaaatgttaccaacacatagaaatgataaatattcaaggtgatggataccccaaataccctgacttgatctttatccatcctatgcatgtaacaaatactcatatgcaccccaaaaatatgtaaaatattttgtatcggtaagaaaaagaagaaaatgtcaaccgaaaattctatttgcagcaagactgtacttcaaatgaaggtaatataaagacattcccaaatggataaaaattgagagaatttattactagtagaactcctgtacaaaaatactaaagaaagttccttgggctgaaaggaaatgacaccagatggtaataaaataatcacaaagtaataaaggtaaagattattacatgggtaaatataaaacatggtacatacgtgtacatacacatgtacttctgtttcctttgcttaactgatctaaaagacaattgtataaaacaataatttatgaaagtgtatggttggtcttacaacatataaagctacaagatacatcatacttaccaaaatatgtgtggataaaatagacctatattggagcaagaaaatgatgccattgataacatgcatcctcagaaagaattgaagacaaccataaatgataaatatataaattaatctaaaagactttataaatgtattttctcctttcttccatctcttctttaaaaacataattttacaaattcataattataactgtatttgggggtttatatcacatatagacataatatacattactttaataacataaaagaaggtagaaaatggagctcttctgaagtttctacgtgctactgaaatgaagtcagcattaatcttctgtaaactgtggtaaaataagatgcacattataaaccctagagaaaccagtaggaaaataattaaaaatatacatgtatatgataaagacatcaaaaattaattataacagtatattagaatatagctatttaacacaaaaaactagagcaggaagaacagaggaacaaaaagacagggtatatgtagatgaaaaatagtaaactggcaggcagaaattgaaacagactaaatgtaaacagttacattaagtataaaataattaaacattcaaatcaaaagggagaaactatcaggctggattttaaacactagatgaaaaaatatatatctaactatactatgagagacacgctttacagtcaaagaaacaagctaaagggaaaggatggggaaagatataccaggtaagccttaaagagagctagagtgactacactgttattatactaaatagactttttaaaagagaaaaattttataattcagtaattcaattcctcagggaaatgtgaaaagtaaaatgatacatgcatctaacaaatagagccccatggtacatgaagaagaaagaaactgatagaattaaagaaagaaagaaataatgcaacaataatagatgaaaacctcaaaatcccactcttaataatggatataacaaaaagaaaatcagtgaagaaataaaagacttagacaacactatatacttatggactacctgacatcaatagaacacttcactccaaaacgcacattcttttaagcacacatgtaactttatacagaaaagacaatatgcaaggtcataaaataattccccataaatttaaaagactgaaatcataaagcatgttctctaatcacaatggaattaaattagaatcaatagtagaaagaaatttgggaaatccacaaatatttaaaaattaagaaaaacatataaataatccatgagctaaagaagaaaccaaggggaaattttttttgaactgaatgaaaataaaactaatataccaaaatttatggaacacttcacacctattagaatggctattatcaaaaagactaaagataacaagtgtggtaaggatgtggagaaaagggaacccttgtacacttttggtgggaatgtcaattaggatagccattatggaaaacattgtaatggttcctaaaaaaattaaaaatggaattaccatttgatccagcaatctcacttactggtatagccaaaacatataaaatcagtctgttgaagagacatctgcacccccatgctcactgcaacactatttactataatcaagatatgaaatcaacctaagtatccatcaataggtgaaagtgtaaagaaaatgtggtatgtatacacaatgggatactattcagccttaagaaagaggaaaatcttgtcatttgcaacaacatggatgaacctggaggatgttatgttaagggaactaagccaggcacaaaatgacaaataccaccttatctgacttatatgtgtaaactaaataacttgaactcatagaagcagagaataaactggtgcttctgaggggctgggtgcaggggaggggactggggagatgttggtcaaatgataaacaatttcaatttgacaggagaaaggagttcaagacacatggtgactatatttgataacaatgtactgttattagcaagatgtcaaaataggagattccaggctttacttctctccatagaaagtgcaactagcaactatcaacagaccaaaacatctttgtgaaaaccccaaaacttgggaaaagcctgagacacccatgtggaccacagaactaaataaaaacccattagaaggataagaggaatgatcccactttgacttcaaggcatctcctactcccctaagttggcacagtgccatacagagacagttctcctgggcttacagtttctacagtgggaaaagagaaccagaggcagacaactagatttctagcattccaagatgctccccaggaagcccactctagtctcacctcatggggaacagaaagaataatgacacagctagactgccttgggtcaagtagaaacaaagaaaggaggcagagctcataaccaccagtgtgtgaatcttggtgatagctctgggctcctgctagcagtggtgccctgtcagatgtaccagccaatggcatagcccacccacaaagtagagctgattgctcccagaagcacagtgggaagttcaatctggcttaagtctctaggatggccagcctccatgcccagcctcagactccccaaggccccttccagggagagagttgcccatcacagcacattttggcaaagcacaggggctaggcctgcccccatctgggagaacaaacagcagcttggctcagccacaaaccccatctgaaaaccccacccagacagggaggcaaacctcaactatgcatttctactgagcatagaagatactcccaaccatcccaagcagcaactctgcctaatcttggagaccagcctgcacccctggcccaaccacagaaatcaaatggtggtaatgcccagccaaggaatacaccctgtgatccagcctgatcagaggtgattgtaaagcccagccaacaactctgcctgatttcagagctcagccagtgatgccataagatattgaagcccagccagcagcctcatatgacctcagagcaaaggcagcagcccaccaagctagaaaatacaacagcaagctctgacttcccaggcttgttaccagatggccccgtccagtatcacaggctagacaatagtgaaggtccatccctgccaaagaactcctgtaaaggttggaagaggtggttgcctcctcaaatgtaaagacaccaacataaagaaacaagaattaagaagaatcaaggaatcattacatctccaaaagaaactaataaaactccaacaatgggtcctacagaaatggagatctatataatgactgacaaagaattcagaataatcctctttaaaaagttcagtgaactacaataatatatggataaaaaattaaatgaaatttggaaaacaatacatgaacaaaataagaaggctgacgaagaaatagaaacaattttttaaaaataaaaatcttagagatgaagaactcaatgaatgaactgaaaatttcaatagaatatatcagcagcaggctctataaatccaagaaaaaaaaaacaatcagtgagctcaaagacagaacatttgaaataatgcagtcagagagcaaaaagaaaaaagaatgcagaaagcctatgagaattatggaacaccatcaagagacttaacatttgcataataataatacatgaagaagaacagagaggaaaagagccagaaaggctatttaaggaaataatggctaaaacctttccaaatctgggggaagatgccaaaagtctggcaaaggaagcatacagacctgcaatcaaattaaacccaaagaggagctcaccaagacacaataatcaaactgtcaaaattcgaagacaaataaaaagttctgaaagcatcaagatataagaaacacatcacatacaagggaatatcaatatggctatcagcatatcagatgttttagcagaaactctgcaggtcaggagaaaatgggatgataaattcaaagtgccaaagtggggagggggaaacccagcaaccaagattactttaactggcaaatctgtccttcaaaaatgaggaagcaatttttaaaaaaaagaaaaaaatgagggagaaggaaaagctttctcagacaaacaaaagctaagagagttcatcaccactaggcctgccctgcaggaattactaaagggagttatttaagctaaaacagaaggccactaattaataacataaaacatatgaaaatgcaaaacttaatggtataagtaatacagttacatatagaataggagtataatgatggtgtgtaaagcaattttacctcaagtacaatggctaaaagtcaaaactatgaaaaataactataattaaaataaattatcaagggatataaattacaaaatgctgtaaattttgacaccaaaaccaaaatgtgtgtgttcaggggaataaaagtgtagagctatatgtgataaaagttaagttcttatcagcttaaattcacctattataagatgttttatgtaagccttatgataacaacaaagtgaaaaatctatagtacagctgactcttgagcaacatggtttgaactgcatgggtccacttatacacagaattttttcaacatatttgaaaaattttttgaaatttgcaacaatctacaaaaacttacaaaccatgtggcctagaaatataaaaatttaagaaaagggtatgtcacgaatgcataaaatatatttagatgctagtccattttatcatttactaccacaaaatatatacaaatatgttataaaaagttaaaatttgtcaaaatttacaaacacagactgtacatgatgccattcacggtcaagataaatgtaaacaaatataaagatgcagtattaaatcataactgcataaaatttactgtagttatactactataataatttcatagacacctcttgttgccattgtgggtgggcttaggtattatgagtatccacctaaaaagctgtgtgatgctaatcatctccacaagagcagttcatgtctgcagtaaattgcatatcatagtaagaagtgatctctcatgattctcacatatttttcattgtatttagtgcaatgccataaaccttaaacatcatgggatccatacaaagtgccacttgtgatgttggaagtgcttccaagaagcagagaaaagtcatgacattacaaggaaatgtttagttacttgatatgtactgtatgtagattgaggtctgcaactgtggttgtccaccatttcaagataaataaacccagttaaggaccattgtaaataaagaaaattcatgaagctgtggctgcagctatgccagcaggcacaaaaaccttgtaccttttgtgaaatacctttttatctcattttgaaaatgtagtttttatatgggtacaggatttctatgagaaaggcatacctatagattctaatatgatttgaggaaaactgaagtgattatatgacaagataaggcaaacgaaaaggtgaaggatctaaagctggaaaatttaatgccagcaaaggatggtttgacaatttcagacagaggtttggcattaaaaatgttaagagaagcagcttctactgactaagaggcagcagatgatttctgagataccattaagaaaatcacccaagagaaaggctatctatatgaacaaggttttaatgttaataaatgtgccctatactgaaagaaagataccatgaaggacatttattagtaaggaagagaagtgaatatcaagatttaaggcaggaatggataggctaactctaccgctttgtgcaaatgcagtcaggtttatgatcaggattttccttatctataaaactgctaatctccgagctttgaagggaaaagataaacaccagttgtcagtattttgattgtacaacaaagcctggacaacaagaaacctttttctggattggtgccattgatgctttgtccttgcagtcagaaagtaccttatcagtaagatactgacttttaaagttcttttgatattggacaatgtccctggacacccagaacccccatgagttcaacaccaaaggcgtttaaggggtctacttgcctccaaatacaatgtctctaattcagtccctagatcagagggtcataagggcctttaaggctcattacacccagtactctatagaaagaattgtcaatgctatgaaagagaaccccaataaagagaacatcatgaaagtctggaaggattacaacattaaagaattcccccatgtgtatcaaaagaaagaaatgaggctattttgacatgacttattcttaggaacctcagtcagttgcccaatacactgtcccctaaatgctaacattatctaatactttcaagggttgttgtccaacttctcagaatttactcttcaaaatatatgtttgtcagttccccaatcttttggcgcctcttatgttttctgtagtttccataattcctgacagtgactatactcaggaatacatttcttctaagtatacgaactcattgaaataggctcagtgtttctttttttttaaattctattattattatactttaagttttagggtacatgtgcataatgtgcaggtttgttacatatgtatacatgtgccatgttggcgtgctgcacccattaactcgtcatttagcgttaggtatatctcctaatgctatccctcccccctccccccaccccacaacagtccccagtgtgtgatgttccccttcctgtgtccatgtgttctcattgttcaattcccacctatgagtgagaacatgcagtgtttggttttttgtccttgcgatagtttgctgagaatgatggtttccagcttcatccatgtccctacaaaggacatgaactcatcattttttatggctgcatagtacacatgaaaaaatgctcatcatcactggccatcagagaaatgcaaatcaaaaccacaatgagataccatctcacactagttagaatggcgatcattaaaaagtcaggaaacaacaggtgctggagaggatgtggagaaataggaacgcttttacactgttggtgggattgtaaactagttcaaccattgtggaagtcagtgtggcgattcctcagggatctagaactagaaatgccatttgactcagccatcccattactgggtatatacccaaaggattataaatcatgctgctataaagacacatgcacacgtatgtttattgtggcactattcacaatagcaaggacgtggaaccagcccaaatgtccaacaatgacaggcttagtgtttcttaagcatttttttacctaagctaatacaagttgagtattccaaattcaaaaatccaaaatctgaaacattttgagcactgacatgagctcaaaggaaatactcactggagaattttggaatttggatttggggattaaagatgctcaactggtaagcatgtaatgcaaatattccaaaaaaaacaatctgaaatgcttctagtcccaagcatttcagataaggaatactcaacctgtacattcttcaaaataaaatccttttcaaaaaaaaaaaaagatgccatcattgttatagaacaaggcatgaaagccataaagccccaaacaataaatttctgttggagaaaactgtgtccagatgttgtacatgacttcatagacttatgacagagccaattaagttaatcatgaagtagattgcacatatggcaaaagcaggtggaagggtgaagggtttcaagataggaatattggaaaagtccaagagctaatagataccatgccacaggaattttaaaattttaaaatgacgacttgatggagatgagtgcttccgaaccagtgccagattatgagaaagaagatgtagatgaagcagtgccagctataaagacacatgcacacgtatgtttattgcggcactattcacaatagcaaagagttggaaccaacccaaatgtccaacaatgacagactggattaagaaaatgtggcacatatacaccatggaatactatgcagccataaaaaatgatgagttcatgtcctttgtagggacatggatgaagctggaaactatcattctcagcaaactatcgcaaggacaaaaaaccaaacaccgcatgttctcactcataggtaggaattgaacaatgagaacacatggacgtaggaaggggaacatcacacaccggggtctgttgtggggtggggggaggggggagggatagcattaggagatatacctaacactaaatgacaagttaatgggtgcagcacaccaacatggcacatgtatacatatgtaacaaacctgcacgctgtgcacatgtaccctaaaacttaaagtataataataataataataaagaaattgacactagacaatacagaagaagggttctgattattcaagactgcttttttacttcttttacaatatggacttttctatgatatgggcactgaaactaaagcaaatggtggaataattggtaccatataggaacatttttagagaaatgataaagcaaaaaatacagacagaaattatgatgttcttctgtagttacaacgagtgttcctgcctctcctgcctcccgttccacctcctccaccccttccacctctgccactcctgagacagtgaggtcaacccctcctagtcctcctccttctcagcctactcatcttcacataagaatacagtatataatatgtataacataaaaagtatgtgttaattgactgtttatgttatcagtgaagcttctggtcaatagtaggctattagtagttaagtttgggggaataaaaaattacacatggattttcgactgtgcaagagtcagaagccctaacccccacattgttcaagtgtcaactgtacttccatattatacaaactcttcctgagaacaaataaagagaaaatactcccatactcatgtttaaggcaagtataatctttatatcaaaatcaaaccaagacaacacacttacagaccaatctcactcacaaacatgcttgtcaagaacacaaacaaaatatattagcagaacaaatccaagaaaaaaagtaaagacatgaatcatgttcaaggttgcttaaattttagaaagtatattatagaattcaacaaattaataggtgatagaagcaaaatacactcacttcaacatgttcagaaaaaaatagataatatatccattcacaatattttaaaagtctctcagtaaattaggcatagaatggaacttccttagcctgttaaggggtactaaaacataacaaacatacttaacagtaagatataaaagcatttccatttatttattgatagtgagacaaaaattgatacaaccatgttgaaaatgagtttgacgttttttatctagtagagttgaggatatgcatacactttatcctaaagtagtggttttcaacaggcatcttgccaccatcaaccggcatcttgccatgtctagggagtgtgttggaaatgtgtatggggcaggttggttatcacaatgattggaggggaattattgacatttagtggcatcagagatattaggcatcctgaaatgttcaggacagtcccaggcaatggagaatcctgcctaaactttttaatattaaccttgacatgcctacaaatgaaaaacctgtttataattaccagaggccagaacctacctccttttgttacatataaacatggtatttttgcatgaatttactatatactgaattttctaggagtaaatctaccaagtaaattgagagaacagtatattttcttttgttcagaaatttatccaaaataatttttttagaaaatcatgtcaccaatgataattacactttgtggtattatatttgtagccgtcacattcatggcgatcaatgtataggtgtaaatatttggctacttcaggtagtcatgtttcagcatttacatatttaaatacattattataaatcactcgcatttaatttttcctttaaattctagttaggacattgtgctcatattttaaatatgtgtataggtaggttatgctatctatgaatttcacttctggttaataaagaaattggtacaaaatatttgttacaaaaagggaattggtagagtctttcaagatggctgactagaggcacaagacacttgactcctccacaaagaagaaccaatcaactgggaacgaccaacatcacagctgacaaaagttgcaatactagttgaagcaaatgagaccagcctaaaatttaacagagtaatctactgcacgagacagctatactgggctttaaataaggtcctacatatccctaggggtctccaagtctgtgcacatgctcgggagaaactgaacagtgcctcacttatctactagtctttgcctaaatgtgtggtgttatacagtagcaagtaatagcaaaggtagatttctaaactgcgtgaatctggaatgtacgccccagcccacacatggatactttcagcaaattgtggaaccctcactggcagaaggtgtttaagcataacatatgaacaatcactggatgaccactaaaatatggcccagcagtgaccccctggaagctagcataataacaacaacaaccaaaaaaactgagtaaaagcatcagaggccacaccctgtgggggaggccagaaggcagtggaatagcaaaatgctgaaagaaaaatacccaaaattttcaagtaagaattctatatccagcaaaattatccttcaaaaatcaatgtgaaataaataaattccacaatacacaaagacagagaattcattgctaacagacctaccctacaaaaaatactaaagtccttgagctaaaaggaaatgacaccagatggtaacttgaatccataggaagaaataaagaggattagtaaaggtaattatgtaagtaaacataaaagagaaaatacatacttttcttactttcttttaaaggaaaactacataaaacagtatttttaaaactgtgttgttgggcttataacatattaagatgtaaaatatactgcattaatagcacaaaggatgggtggagaaaacttccctgtgttgctgaaattaaattattattaatctaaagtaggttatttcaagttgacatacatattgcaatccccagagcattcaataaaaaagctctagaaattacagtaaaaacatcaaaaaaggatttaaatggtatgcaagaaattagctatataacataaaagaaggtaataaaggagaaacggaggaacaaagaagtcaagaaacattaatgaaataaatgaataaagccagatgtacatctataagtataaatgggttaaacagtccaatcaaaacaaacattgtgagactggatgaaaaacacactccaaggatatgccatctacaataatggaaagacacactttaaatgtgaagacataaacaggttaaaagaataaaagaatgaaaaaattgtattaaaaaaaagagcaaccataaaagagctggagtggttaaactgatatctagtatcagacaaaatggactttaagaaaaaaatgttatagaaaaagaaggacattttataatgatgaaaggttctattcatcaggaagatatgtaactataaacatatacacatctgacaacaaaactctccccaactaattctatgaggctggtctctgacatcaaacaaaacaaatacattataagaaaagaagcctacaattcaacttcccttatgaatacaaatgcaaaattccttaacaagatgttagcaaatcaaatccaccagtatttcaaaaaggattatatatcatgacaaagagagatttattccaggaaggtaaggttcgtttaacacccccaaattaaggtaataccctatgttacattagttaataatgtattgtgtagaataaaggacaaaaaccacatgatcatttcaatagatgcagataagccatctgacaaaatctaacagtcattcatgatcaaacataaaaacttaaccaattagtaaaacttcctcaacctgataaagaacatctacgaaaaatgcacagctaacatcacatttagtgatgaaggattgaatatttcccctaagaccagaaaaaaaacaaagatgttcactcctgtcattcctattcaacattatactggagatgctagccaggggaattaggcaaggaaaacaagtaaaaggtatccaggctggggaaaaaaaataagtcaaactgtccttgacataatcctgaatgagaaaaccctaaggaatatacccacacactcacatgcacacatacacatggacacacacacacacaatattaaaactaataattctactcaacaaagtcacaggataccaaatcaacatgcacaaagtcaatttgtatttctatacacttgcaaaaaatcataaagtgatattataaaaaataattcacaatagtaccaaaaattaaatacttgggaataaatgtaacaaaaaagtaaaagatttttacactgaaaactacaaaacattgttgaggaaaattaaagaagatctgaataaatggagaggtatttcaagttcatggattgaaaaatccaatactgttagttggcagttctccccaaactgatgtatagattcagtgcaatcgctaccaaaatcaaagcagaggctgggcatgatggttcatgcctataatcccagtactttgggaggccaaggcaggaggatagcttaagcccaagagtttgagaccagcctgggcaaaatagggagaccacatctctacaaaaatattgttaaaatagccaggcatagtgatgcacatctgtagtcccaggcactcaggagactgaggtgggaggatcgtttgagcctgggaggttgaggatgcaatgagctgcaactgtgtcactgcactccagcctgagcaacagagcaagaccctgtcgaaagaaagaaagaaaagaaagaagaaaagaaaagaaagaatgaaagaaagaaagaaagaaagaaagaaagaaagaaagaaagagtgacaagatgatcctaatatttatatggaaatggaaagaacccagaatacccaaaacaatgttgaaaaagaagaacaaaattttaggattcacctttctcaatttaaatacatattacaatgccacaatagtcaagacagtagggactggcataagaatagaaatataaactaatggaacacaattgagaggtcggatataaacccttatatttatggtcaattggttttcaaaaaaggttccaagtcaattcaacaggaaaaggttagtttttcaacaaatgatgatagtacagttggatatccatatgcaaaaagattaatgaagaccttcaccttacaccatacacaaaataacacagaatgaatcagagtcataaacgaaagacgtaaaagtataaaacttttagaaacataggaaaaccttcatgatattggattgggcaaagaattattagatacaacatcaaaaaacacaattgacaaaagaaaaaaaataacttggactttatcaaaaataaagaaccgagagcccctctgccactgccattgcagcagctctgtccttgctgccctaagactggggaaggaataaagagcctgagggatttacttgcacctccaacatgccacagttgccatacagaatagagccaagtctctcatctctgtgagcctccaaccccctggtcttcaccaagcagggcccctggcttgggcccacagaacagctgccctacctcgtggctgaacatacccattgtcagtggctctgtgttgctctggggtggagctcccagaggcaaatgaaatgccctctgagactgccactgcagtggtactgcctttgctgcccttggattggggaaggaacaaagaccctgagtgctgtactcatacctccatcatgccacagccaacctaagaagaggctagtctgtcttccctgtgagctcccttctccccctccccattcatcaccaggcagggctccctggctcgggcccacaatgcagccactccaccccaggatgaatgctccaaatgatagtagttctgcatttctctggagtggagacccaaaagacaagtgaaaggccctctgcaattgccactgccaaggtccctgcccctgctgctcccaagctggggagggaacacaaagcctgagctcatctgaaggctgcatgtgaagcccaagagtgtcaagccaagctctgcagccagcactcaagtgggagaggagcccacaccctcagagcaccaagagggagcatggccgcaaacacaaggaaatagaggagtcatgtggctgagcaagagcctacctaatggccattacacttaagcaccatctactggatcacagcccaaattttgacaccaaaaatacttacctaatatatccctctgtgaaacgaagaacaagaattcagctacaaataaagaccccgcacaaagctccagcactctgacaatgtccagaaatgaggtcaactgactatactcaaatcacaccacagttaaagaaacattagcccacacacaggagaaagaaccagcacaagaactctggcaacccacaaagccagagtgtcttttttcctccaaacaacactagttccccagcaaggattcttaaccaggctgaaatggctaaaatggcagatatagaattcagaatgtggataggaattaagatcatttgagatccatgagaaagttgaaactgaatccaaggaatttaaggattataataaaacaatacaggagctgaaagatgaaatggccattttaagaaagaaccaaactaatatgatagagctgaaaaacataatactgtccatgaaaatttcccaaacatcactagaaaggacaacattcaaattcaggaaattcagagaacctctgcaagaactatacaaaaggaccatccccaagacacatagtcatcagatgctccatcaagctaacagcgacctttcagcagaaatcttgcaagtcaaaagagattgggggcctagattcagcattcttaaagaaaagaaactccaaccaagaatttcatatccagccaaactaagcttcataagcaaaggagaaataagatcttttttttagacaagcaaatgctaagggaattcattaccatcaggcctgccttacaagaggtccttaagggaatgctaaatatggaaacaaaagactattactggccaccacaaaaacacacttaaagacataggccactgacactataaagcaaccacgtgatcaagtgtacataataactagctaacaacatgatgccaggatcaaatctgcacatatcaatattaatcttaagtgtaaatgggctaaatgccaaaattaaaaggtatccaacggcaaattggataaagaagcaagacccggtggtatgctgtcttcaagagtcccatctcacatacatcacatacaatgacacccatagactcaaagtaaatggatggagaaaaacctacaaagcaaacaaagaacaaaaaaaagcagggattactattttaatttcagacaaaatagacattaaaccaacaatgatgaaaaaaggcaaagaaggacattacaaatggtaaagagtcaacaagaagacttaactatcctaaatatatatgcacccaacacaggagcacccggattcataaaaccagttttcagagacctatgaagaaacttagataactatacaataatagtgggagatttcaataccccactgacagtattagacagatcctcgaggcagaaaactaacaaagatatttgggacctgaactcagcatttgatcaagtggagctaacagacatctacacaacaatccacccaaaaacaacagactatacattcttctcatctgcagataacacatactctactgaccacacagtcagccataagacaattctcagcaaattaaaaatttttaaaaccaacaaaaacaaaaatcataccagccacattctcagaccacagcacaataaaaatagaaatctataccaagaagattggtcaaaactataaaattacatggaaattaaacaacctgctcctgaatgacttttgagtaaacagtgaaattaagtcagacatcaataaattcttggaaactaatgacaacaaagatacaacatgtcagaatctcaaagacatagctaaaacagcatcaagaggaaagattatagcattcaatgataaaaaaaatgaatgaaatcaatgaggctggttccttgaaagaataaataagacagatggactgctagctagactaacaaagaaaaaaagagaagacacaagtaaccaaaaacagaaatgataaaggggacatcatcaccaaccccacagaaatacaaaaaaaaaaaaaaaaccccatcagagactattatgaacatctttctgcacacaaactagaaaacctagaataaactgataaattcctggagacatataacctcctaagactgaaccaagaagaaatacaaaccctgagcagaccaataacgagttccaaaattgaatcagtaatgaaaagcctaccaaccagaaaaaaacacaggtccagaaggattcatagctgaattctaccagacatataaagaagagctggtaccattcctattgaaactattccaaagaattgaggagggactcctccctaactccttctttgaggccagtatcatgctgataccaaaacctggcaaggacacaacaaaaaaggaaaacttcaggccaatatccgtgaagaaagtagcatgtcaaaaagctaattcaccaagatcaagcaggctttatccctgggatgcaaggttggttcaatgtatgcaaatcaataaatgttattaatcacataaacaaaactaaaaacaaaaatcacatgttcatttcaatagatgcagaaaagccttttgataaattgcagcatctattcatattaaaaaccctcaaaaaactaggcactgaaggaacatacctcaaaataataagagctatctatgacaaacccacagccaacatatactgaatgagcaaaactggaagcattctccttgagaactggaacaagacaaggatgcccactctcaacatactactggaagtcttggccagagcaatcaggcaaaagaaagaaaaaaaaggcatccaaataggaagaaaggaagtcaaactatctatgtttgcagacaatattattttatacatagaaaacccctttgtctctgacaaaaatctcctagatcatatcaacaacttcagcaaagtttcaggctaccaaatcaatgtacaaaaatcagtagcatttctatacatcaataatgtccaagctgagaaccaaataaaaaatgcaatcccattcacaatagacataaaaaaaataaaatacctgagaatacagctaacctgggagatgaaagatatctgcaatgagaattacaagacactgctgaaagaaatcggagatgatacaaacaaatgaaaaatcattccatgctcacggataggaagaatcaatattgttaaaatagccatactgctcaaagcattttatagattcaatgctattcttatcaaactaccaatggcattcttcacataattaaaaaaaattattctaaaattcttatggaaccaaaaaggagcccaaatagccaaagaaatcttaagcaaaaatacaaacttggaagcatcacattacttgatatcaaactatagaagtctacagtaaccaaaagagcatggtactggtacaaaaacagacatatagaccaatggaacaaaatggagagcccagaaataaggttgtgtgcctacagccatctgatctttgacgctgatgaaaacaagtaatgggatagatactccctattcaataaatggtgctaggattgctggttgctgtgtgcagaagatagaaaccagaaggcgtctgccttctttacaccatatacaaaaatcaacccaaaatggattagacttaaatgtaacaactaaaaccataaaaacccttgaagaagacctaggcaataccattctagacatgggccctgtcaaatatttcatgacaaagacatcaaaagcaatggcaataataataaaaactgataaatagcacctagttaaactgaagagcttctgtacagcaaaataacctatcaatagagtaaatagacaacacacagaatgggagaaaatatttgcaaactaggcatctgacaaagttctaatatctagaatctataaggcacttaaattaacaagcaaaaaccaaacaacctcattaaaaagtgggcaaaggatatgaacagacacttttcaaaagaagacatacatgtggtcaacaagcatatgaaaaaatgctcaacatcactaatcaatgaaaaccacaatgaaataccatcttacaccagtcaggatggctattactaaaaagtcaaaaataacagatgttggcgatggtgcaaagaaaagggaacacttatacactgttggtgggaatgtcagttagttcagccactgtgggaagcagtttgacaattcctcaaagaacttaagacagaactaccatttgacccagccatccattattgggtatatacccaaagaaatataaatcgttctgccataaagacacatgcatgcatatgttccttacaacactattcacaacagcaatgacatggagtcaacctaaatgcccatcagtggtatatggaataaagaaaatttggtacatatacaccatggaatactatgcagccacaaaaagaatgagatcatgtccttggcaacaacatggatggagttggaggccattattctaagcaaagtaacacaggaacagaaaaccaaacaccacatgttctcatttataaatgggagctaatattgagtacacatggacacaaagaaggggacaatagacacgggggcctacttgaggatggagattgggaggagggtgaggatcaaaaaactatctattgggtactatgcttattgcctgtgtgatgaaataatatgtacgccacacccctgtgacacacaatttatctatagaaccaacctgcccctatacctctgaaactaaaataaaagtaaaataaataaaaacctttgcccttcaacatacagtagtaagaaaatgaaaagacaaaccacagacttggagaaaatattttcaaactacatatctgataaaggacttgtatataagcaactcttacatctcaatagtaaggaagcaaacaacctaatcagaaatgggcaaaatatgtgaggagacatttctccaaagaacatatacaaatatctaacaagcaaataaaaagatgctcaattagccattaaggaaatgcaaatctaaatcacaatgagatacttctccacaccctcaagaatagctacacatttgaaaaaaacaaaacaaaacggggaaataacaaatatggtgatgatgtgaagaaatacattgctggtggttcatataaatctagtaactgtaaaatagtacagccccttgggaaaacagtttggcagaaaattaaacatacagttataatatgaccaagtaattccactcataggtgtttaaccaagagaattgaaaacgaatgtccacccaaaaacttgcacacaaacgttcatagcagctttattcataatagccaaaagatagaaacaatccaagtgttcatcaactgatgactagatagacaaaatgtagtatactgatgcaatggaatattactcagctataaaaaggaatgaagtatttatatatgccacaacattaataaactttggagacattatttagatgaaattttcaggataggcaaatccataggcacagaaagtagattagtggttgtctgatgctgggagtagtaatgaagactgactgcagatgggcaaggaagatgtcactgacgtgatgcaaatgttttaaaattagattgtagtgatggttgcaccacccaataaatttataaaatcactttaaatatgcaaattttatggcatgtaaattatcctaaatacaatatttaaacactgtgagcatcaagaaaaaaagagaactttcatctccttactttgacaatttattagggatcatacagaggtcattaggctgtttgttgttgttgctgtggtggtggtgggttgtggttttcccatgagagtcgagggtcatgcaaccatttggtcttttaaaataaaaatttttaaatcaattaaaaaagaatattgctggcttgaaatttggagtagtcatgggacaaagagaagtggatggattttttaaaatattcaggatgtagaagtgacaagattttgtagcagttagatatagggagtggggaaaggtgaggaggcctcagactgagtatgcttaaagttgaattcctgttgtcctcccgaactggctgtcctgtgctgccaatctcagtgaatggatcagcatcctggcacagagttgacattcattgattgcctttggagtgaatgaacagagtatgatgaatagagtgaaaatatagctaaacaaggcagacaccaggtcctgccaaatagccaatgcaaaactcacccttcaggttggctcagcagatatccagcataatttttttctcacctttcaaaccatttgggaaatcatgaggtattttcctcatccagaagaacactcacctacatatcagccactccttccctagaacctacaggtatggagcaggctgggttttttcaagagcctcttatcctgtaaatctttacacagggcaatggcaggtgcatgtacagcccatatgagcccaggggatgcttggtattatagaaaggggatcacagtggtgcccaactgatggatccgtgttcagtttgcaggaagagactcttcccaccaaagaggtttgttaatcctggggtccccctcccagcccctggaggcatcagatacagctgtcagaaacattgtaaacacccagtgatccacttggctggttttactgttgttcccagggttgacaagcagaaatacagaacaaatggtggttcctgaaacagaggccaaaacaaggaagtgatctgttccagtccaagcttccaagaaataaagaactaggtggggcacactaaacaagcccccagactcaaccaccccagtaaacattcccttcatcacactggttatgagataaagtataagttttttaagccttattataaataaccttacttaacgtcttctggttgttgtgaaaattatagtattttgcaaaatatatgttcaccattatcattaccaccagttccttaatgaggagaaaccagaagttgacaccaaaatgttgatccataatgtttatagtccttctttgtctttatagttaatgtaaaataaactgtatgtaatttttactacagtgtgtcctgaaagggcaaaccaagctacaagcaactctaaaagactactactgtatgggagtggattatgaaagtgtttcttaaatatgagagctcaagtttttctttcagcgactgagttaaagcacgcaactcatttatcatgagacttttgctaggcagtgtactatgtccactcaacacacatcattttaggcaatcatctggttaaaacgtttaatagtatggcattcacaaacccattcttcagagttgacattcaattaatggtttgaatgtcgtttccagggcagtcaggagtatttaaaggcttttccattgttttcggaagagaaagaaaacttcctagcctaacttacttacccagagccttgctccagagggggcagacaaagggtaaaatctgggcagagaacattagtggatatgagaacgaaagaaagtgctgcaagatcttgcagacagctgagttccaccttccactctactgccgaacaaagtgaggcaggaagagggtagggactcgctgaaagctaaacaccaagtcagtgacagatccagggctgtaaagtccgaccgagattgaaacaatgtacactgggcgtcagtcccaacgcgagcttgctccagctcttccagctcttcctgagcgctaggcccatccggcctcacgctgatctccgggcagactctgtcgcgcaactggcacagatcgtgacgacaaccctgcggcaaggcaggagtggccttcctctccgccagggttaaggtgagtaccaccgcccttgggcccagcagcccgggtgagagcctccgccgcccactgcgacaggcctgaaagcgagcgcctgggtaaacccacccgtagcacccatggggacaccccttccctgacccacgggacggaacccacctgtgctggaggtcgtgactgctaactccgcagagtgggcagaattccaagcaaggagagtctcgggaggcagcctttcacccgccttttgccttttcacccccaaaactgtcggccccacgctcccctcccccagcccgctcgggcccagcggagagcctgtaggcccc

SEQ ID NO: 1548 - DNA, 2540 bp, Homo sapiens
gtgtttttgaagatttatttcagagtgagcatcagcgacctacaagaacctgggacagaagccaatgcctcccgtttccctgtgatgtgaaacaggaccctgtgcttcctgtggacttcaagaaatgtggacttgagctttgccatcccttcccctgatcctgtttcatagattttgctgttatattctctgtatctttacagggatcgggaggctgaattagtgttattcagggttagtaactgtcccttccttaacggtggtggtcctgatagttcgcacatttttggctgtcccaaagagcagtgcaattatgaaggcgtaaatacgaccaaagaccactctcagatacatcactgattgctggctttgtttgacggaacgtgttctttttggaggtggcccgctgttgacactcccaccagcacctcttcttaggcacagtggaggatcccagcctatatggcaatggcagttccttctgttgttgcagactcctctatgaccgcacttctgagggtggcagttgtagcccagtgaagtgatagtcacattgcactgggtgttattacagaagtttccatgaacacaaggagtgccatctatcacacgcccaacatcagtcgtgtctgttgcatggtgttcatccagtccaaaacactgaaaccctcctctcactgagtgatggaatgaaacacgttcctgcagccggggaagatgggtcacattggtacactgcagtcttccacaaaacttatctattcctgcacaagcctggtagctgagatatgtttgttgtctaatacaatgtccaaatcggtagctttcaagatttatgtcatagcagacctcgggagcatcctcagcactgacaccaaagatcgccttgcagagcacattgcgatcagtgcagttcccacgatagcagtagccttcttcagtgcacggggttccatcttgcatataaacgtttgcgggacatgtcacggtggtcccgtgacagtactctggaaggtcacatatattttggataggtctgcagagagtccctggtggggagaagctgcagtttgtacagcactctcctatatggcagatgctccccggtgttaagtgacagtcactttggcagcaataactggcataacactgcttgaaggagccacagtcacattcctccctcccctccactatgaggtttccacagcgaaccgttgtcatggtttcgttatacacaggagcaagtgtttcaaaaacacaccggcctgaatgtataaaacaattttgtgcatgtccataagaacagttactgaacgcatctgtcatcccaggaaatcgctgcataatgcaggaggcccttctctgacatgtgcagtagttatcatcatactccagaccaatacttctcatctgtgtctgggttattatgacggctaccaataaataatgtctgcctggagtaccaatgtgtaacagggctatacgggaacagaagttatacctttcaggttcatagttagattcatgtggcacgtatttaataagtagtgtggatgaatgaacatgaaaagtatcaaaaaaagttgttttaaaataggtaaacattgcactctgaattcgatattcattcacaggggctgggtcacgattattatatatggtcaaaagataaatatagtaccgcagatcaatattttgagcaatgctgtcaatgagactgaacatctggaccacctctttggaacaagttgtaatattgccatatatgcgataatatgaattggaacattgaacgtggccttttatattgcctctatgagaactatacagcgaattagatatcctgggattcatgctgtcatttgcttcagagaacagggggtctgtctcattgtcatcatctctaaatgtgggccctgttgcgttgggctcggccactatctgaaaaacaacatgttcaaacctgcgggaatcctggaggggtttgatttcgtacgcaaggtcgtccagcctcatgatgcctctgaggtccccatagcacgtgtcgacggtgaccatggacagaggcacctcctccaggtagccgaggtactagcagtctggagggatgtaggggtcacccatctgcaagactccttggtcatcctgagttgtcaccagcagatgtctaggccaaagaaggtgtttcctccgcatgtgaatgacgtgtctttgaccccaaaacacaggctgtaggacagccagccgggaaactgaaggcctttgctatggtgtgtctccttcctgggaatcaccacctcggaggaggcatagtgccacaagggacggccttgagaacaccggaccggagccaggagcgcccagagccccagcagcaagaggggggtcctaagggtgacccgcgcctctgcccgcctcatgtcccagcccagcgatagtcatccaaagacaatgggaaaggaaaggactgtcctgggcgaagccaggccccaaccagctgcggtggctgcgtccctcccagggagaccctgacagagaac

SEQ ID NO: 1549 - DNA, 21455 bp, Homo sapiens
ctgactaacgtgggcggagctctagctcgcgtattctgaggaggcggggttggcctaggcgaagatccggactctgggtgttttgctaccgtgaccgtttaggtgagtggaatagccaagaacatttcggcaaataacaaaaacaaaacgtgcggtcacttgtgagtggatgagaactgtgaggaaacagcctctcagcccggttcgtttccggtggtctcgcgtttgctgagctgtcgcctggctttctaaatctggtcccgggtgtgtggcgagggtgacgggtgggatgtgtgcctgagtgttttgtaatcctttgtctatttctgccttcagaaacccttgtgtgttaaaatattggagaaggctcattctttgaccatgactcgaagtgtgtaacctttgtgctggacgccagtgttattccatagcacgcccaggtctcctccccacttttgcacctgtttcgtaagctcaccctttctgcctcccaggagttggctaacatgtcacaagtgagacctgtggaggatttgtttttcctaagtttcctcctacatcccccctgccccacaccattagttccttgaccggttcctgagttaagattaaacagtgtaaactagtttagttttggtggggtttttttctcccaaagtaatttttttttttttgagaccgagtttcgctcttgttgcccaggctggagtgcaacggtgcgatcttggctcaccgcaacatctgcttcccgggttcaagcgattctcctgcctcagtctccccagtagctgagattacaggcgtgcgccaccatgcccagctaatttttgcatttttagtagaggcgggggtttctccatgttggtcaggctggtctcaaactcccgacctcaggtgatcctcccgcctcggcctcccaaagtaattttaaaaaggaatgaactggtttgatttttccgctttcaaaattctgttttcatatgataaaccacaaaaatcagtaaagctgtctagtcttattttatagttcacattttaggattgaacgggccttaaaagtaatctggtctctttacctgctttgctccatagtttggacaattccggggataaaaagtccgatcctttaggcagcccactgcatttgatccacagggtctgggcaatgacgaagctccaggactggtatggcatgtccctcactgccgtattcagcagcaagcctagctgtgtaatttgtgaggctcaatgcaaaatgaaaatgcagcgtcccttgttcaaaaagaaggggaaaagtgctattaaagggaaggaacatttaactcctaatgcagaatcattgaaatttcacatttcattttgtattttttcttttttctttttttttttagaaacagagtctcgctctgtcgcccaggctggagtgcagtgtggcccgatctcagctcactgcaacccccacctcccgggctcaagagatccacccacctcagcttcccaagtagctgggactacacgcgcccgccaccacaaccggctaatttttgtacttttagtagagaccaggtttcaccatgttggccaggcaggtctcgaactcttgacctcaagtgatccgtctgcctcggcctcccaaagtgctgggagtacaggcgtgaatcaccgcgcccggccacatttggtatttctctgtttgtgttatagagacagggtcttgctctgccacccaggctggagtgcagttgaagcaggatattcctctgaccccttcgtgggtcttgcggctgcggtgcctcacttacttagcccacggctctcaactcctcgcgggagggggggcgcgagtgaatgaggcgggaactggagtgctggaagccacgaactccagtcacccaggcctgctgcgctccaccctttatgggagggtgcgtgggggtgagcagatgctggagccggagcgagcgcttttggtcgccggtaggagcgaactccatgcaggccctgcggctgtgtctaggggatgcccgcgacccctgaagacccacagcctgtcttacaacctgtcatggttgtgaaaagttttgagagaacgtctgcacagtgtctaacggtgtctggtatatagtgtgcactcaaatggtaaccagtttagttgcgatagttggtctacccctccaggtgttaacctctgcagctccgtttcccttctagaccctatttctgggccatcgactcccaccaattaggcaggaaaatactgtttgcctccatctggcccaaggctgtattcctggagtttatgtgagaacctaactcctttctcagctccaactgtaaccctctccccacctccaacacacacataaacactcacatacacatgctaccacactgcctgctgtgccatcagcctgcctgaagttcacatcattttagaattggacgggccttcataatttaaattttattatgaaaaagtgatagtctaaggaactcatttgatttttttgtctaaatgtcaaatatagagtagaacgcacaagtgtctgttatagaaatacttgagagtcctatatgcactgttatccacaaccatttaagcacttatccactaatccctaataagtacccctaataagtacatttctaaaccagttattcaagctacatcctcccaagattggactttgtttctactttggtagggacataaataaacggaaacaactgacctaactttttactaaagagataataaagggaataaaattaagattacatttggattttaacttgtgttcttattcctactgccagcaaaaatatgtaaagtgtttttatcattataaatgaatatactattcattgtgcagattttgacatgttcataaataagttagtacccaatgtttgcttgataaagaatgtgataaaatgttaacatttgggaaatctgggtgaagaatgtataggaattatttgtatgtaatatttgtcaatctgaaattatttaaaagaaaaagttaaactgtctcattcctgaacaattataaattattcaacccaaaactgaagggggcctgcccctccacacctgtgggtatttctcgtcaagtgggaagagagactgagaaaataaataagacacaaagtatagagaaagaacagtgggcccagaggacgggcacactcagtatgcgaggacctgcaccggcactggtatctgagttccctcagtatttattgattacttttcactatctcggcaagggaactgcggtgggagaacagggtgatggtggggagaaggtcagcaggaaaacatgtgagtaaagaaatctgcgtcataaataagttcaagggaaggtactgtgcccagatgtgtaagtaggctagattcatgtttctctttacccaaacatctcagtgtagcaaagagtaacagagcagtattgctgccagcatatctcccctccagccacagggtggttttctcctatctcagaatagaacgaatagtcggctttacacggagacattctgttcccagggatatgcgggaaacagaggccttcctcttttactaatccttctcagcacagaccctttatgggtgtcaggctgggggacggttaggtctttcccttcccacgaggccatatctcaggctgtctcagtggggggaattcttggacaatacccacgctttcttgggcagaggtccctgcagctttctgcagtgcatcatgtccctggttaatagagaatggagaatggcgatgacttttaccaagcatacagtctgcaaacatattgttaacaaggcacatcctgcacagccctaaatcccttaaaccttgattcaatacagcacatgtttctgtaagcacagggttggggctaaagttacagattaacagcatctcaaagcaaaacaatttttctttgtgcagatcaaaacggagtttcttttgtcttccttttccacatagacacagtaacagtctgagctctcttttccccacacaaaactatgtttaaaataatttaagtatgattatataagatttgggggccgggtgcagtggctcacgcctgtaatcctagcactttgggaggccgaggcaagtggattgcttgagctcaggagtttgagaccaacctgggcaacatggtgaaaccccgtctctactaaaatacaaaaaattagccgggcatgatggcacatgcctgtaatcccagctactggggaggatgagacaggagaatttcttgaacctgggaggcggaggttgcagtgagccgagatcatgccattgcactccagcctgggtgacacagcgagactccgtctcaaaaatttgggaccgttaataaacagttatatatatttgggagattagattacatgtattaaatcaagaacaataaaagctggtatttgataaagtactaaagtaaatataacatcctaaatgtttgcaatagaatgattatagaggatatgttgttggaaagtaccagaactagaaacccagtttctaagcaacctgtgaatctttggaaaattagaaaaaaaaatttggaagaatatttcaaatggctgaagatcaccgttccacttgctaaataggcatgttaagggcagaggccactcagattaatgaagtgttctattaacagttttaacgagaactcctgcagtactcttagaaacacccttaagagtcttgtctgtgttccctgttgtgattggcttggagtaggatacctgtctacctcatattacttatatttttccctgtcttcattttatctccctctggttgcatacttcatcactgaacacttaaggtaagatactaatctctgtgtatgtgcacttatttgttacaaagtatacttggcatatattttattttttagttgcaatgatagaaaagcatatatttaaatatcaaattataattggatagattatcagaattgaacattaaatctatttaccaagaaagtatgtttatttgtaaatgaaaataaaaatttgaatttcaaaggctaatcattccataaaagtttccatttctattcgtaatttaaattttattttgaaaaagtgatagtctaaggaactcatttaatttttggcctaaatgtgaaatatagaataaaaaacacacatatctattacagaaatacttgagatcctatatgtactatacaaatcctatatgtactgttatctacaaccatttgaacacttatccataaacccctaataagtaccttttgcttcaagacctatattccttagacccaccattagaaaattggatgttcactccagctatatgatatttaaaaaaaaaatgaatcagctgggagcagtggctcacacttgtaatcccagcattttgggaggcagaggatggcttgaggccaggaattcaagaccagcctgggcaacatagtaacaccttgtttctattaaaaaattagttttaaattttaaattacaataaaataaagtgtaagtattaaaaggccacttgtctatttctcacttggaatattaaatgctggaagctgtgtttgcctgtttatgaagatagaaacctaaatgcccttttgttctgtttatatgtttgaatgctcaatgttcatttccagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggaggtaaaaacaatattaactttggatttttaaaaattatcccaagagaaaattcttttaaaaagattctaagatctatctatatcttactacttatgtatatctatatcttacttatcaaaataatacttttggtacagaattcattttccatttcagtatctgttctgtcccatttttattgagaaagtccaaattctgtctaaaaaaactaaaattataatttataaattcttttttctttcacttatagattattgatgataccaactttacaagatgtaaatgattagtaatccaagacttaagcatgtgtgatgcccaaagagtcgcaaaattttgctttaacttttttcacttacattattctttaaatgtatactctactgttgtatgttaatcatattcccaatataattcccccccaccactgataatgacagactgccagtgaacttgctttgatttaaggcagtttcccaagataaattaggagggaagatagtcaaaaaaaggaaaacaaaaacgagtacaaaaatgaagccaggaatagttgttatccaaaactgtaaagtctgtcagaatactaacctttatttaacaacctctaggttctgttctaatggtaactatagaaccttcgcttgtttctcaaaatgtgatgttctggtagttcatttgtcatcctgataagattgaagttaagaaatagactcatttttgctttgttgtaactttcctcttataatctttttttttttccctaattgaatggtagctaataaacaatctgtattgtttggcctgtatttctttttcatcagtctgtcttccctaatatgacagggcagttaggaattttttctttttcttttttctttttgtagacataggatcttgctctgttgcccaggatgctcttgaactcctggcctcactcgatgctcctgcctcggccacccaaagtgttgggattacaggcatgagccaccatgcttggccagattttttctttgattgcttttctagaatctgttttcacttttgtgtttgtttctattttccttctatatgtgcaggatatattcagaaaaagtagaaattttatggcctggcacagtggctcatgcctgtaatctcaatactttaggaggccaaggtggacagatcacttgaggtcaggagttcaagaccagcctggccaacatggcaaaaccccatctctactaaaaatacaaaaattagctgagtgtggtggtgtgtgccagtaattcccgctattcaggagtctgagctacaagaatcacttgaacctgggaggcagaagttacgttgagccaagatcgcgccactgtacttcgacctgggcaacaacacgagactcagtctcaaaaaaaaaaaaaagaaagaaagaaattggcaaggtgcggtggctcatgcctgtaatcccggcactttgggaggctgaggcaggcagatcacgaggtcaggagttcaagaccagcctggccaacatggtgaaaccctgtctctactaaaaatagaaaaaatagctgggtgtggtggcgggcgcctgtaaccccagctactcgggaggctgaggcaggagaatggcgtgaacctgggaagcagaggttgcagtaagccgagattgcgccattgtactccagcctgggtgacagggtgagactccatctcaaaaaaaaaaaaaaaaaaagacattttgtaagaacttttgatccttaaaagtacataggctgatgcagtggctcatgcctataattccagcattttgggaggccaaggtgagcagatctcttaagcccaggagtttgagagccacctgggcaacaagccaaaaccccatttttacagaaaatacaaaaattagccaatcatggtggcatccacctgtagtcccagctactggggagtttgaggtgggaggattacttgagcctggagatcaaggctgagtgagccaagatcatgctgcataccactgcactccagtctgggcgacagggtaggtaaggctatcagagtgagactctgtctcaaaaaaaaaaaaaaaaaaaaaaactgttgaggctaggtgtgatggctcattgtaatcccagcactttgggggacccaaggcaggaagatcacatgagtccaggagttcgagaccagcctgggcaatatagcaagacctggtctctacatataaaagaaaaaaagagagagggaaatacattggtcttacattaataactttgagacacctatgcttttttacattgttactgaggtataactatctacagtaaagtatgctaatcttgagtgtacagcttgatgaatgttaacaatagttacacctatgtaactactatccagatcaaaatgtaaaatatttccaacatcccagaaggctcctttgcacaccttcccagtcagccttgatccattgcctgtttctgagatgcataaggtgaagtaatattgtatgtagtgttttgtgtctggctgctttgttcaacatattgtctgttaccttcactgaagttgttacatgtgattgcttactttttaaaaagtttaaatgtttgcatttcagttggtttttggaatcttctctcaaaaaagaaggtaatcctcaccctcacacaagtgcaggctgtttatcttcaacagttgaaaatcactgtagaggaagtatttatatatcttagtctacgttgtatcttgtgattatgtctaatgtctaattatattcattaataagaccatttcccccttcttttttattatacaagttgagattgggagtgtgttgagagccacataccacttttgatacgtggtagccaagtttttacctaatgttaaataatcttattccttgtctttattagttatgcagaaggggttaaaagataactttgctgatgtccaggtctctgtagttgattgccctgatttgactaaggaaccctttacctttcctgtaaaaggtaagcaatttttgcaattagcttttgttttttagtcataatctttttctgaaactagaattatttttaaggacatcttaaattatctacaaataaaggatattgtcacaacatttaggctaaattgtgccaaatttctgtgctcactcttctgatattggttaaatttcatttcatactcttgtggaaaaggattgtgttttattcacttatgtaaccttcacagattgtagaatagatatccaataggttagaattctttgtatcacacgagagttttgcttttaattgctcagactgttatggaaactgattttaatttttatgattttatttattcaagaccagaagggatcctaaaagccttgtatttgaatgatctgttaaaactaatccttcaacaaatttgccaagtgagcatccactgtttgaagtgagaaggaagggaaattagtattagaagaataaaataatttgtcagtatgatagatagttagttgatgtttcagtttttacaataacaccacaaggtaagtagtagcccttgtttatagatgagaaaactgaaaacgagagaggctagataagctcagtgtaaatcataaccaggattcaaatgcaagtctgtttccaaagtctaaccccctcctgttataccctattatgatgaggaatttgaggataaacactcaaagtgttctttttattatgtaattaacatctttgctaaaaaggagtttgccatagaaattctggactctagttctgtcttagaacaaacctgactttgagataacattagcatgaggggatttgaattgaatgttttttgggggcctttacagcttaaacaatctttgattttaagtagagctgtaaattctagaaggcttgtgtaccatgtggcaatttcttttagcttcttcaaaggatttagcatagtacttttttatagttttttttttttttttttttttttgagacagagtctcactctgtcaccaggctggagttcagtggcgcaatctcagctcactgcaacctctgcctcccaggttcaagcgattctccagcctcagcctcctgagtagctgagactacaggcatgtgccaccacgcctggctaattttttgtatttttagtagagacagggtttcaccgtgttagccaggatggtctcgatctcctgacctcgtgatccgcccacctcggccttccaaagtgctgagattacaggcgtgagccaccacgcccagccttgatttttttaaaaatatgagtgtaatgtatttcccctgctaattaagtaattaactaaaattaaataaaggtcaggagacagaagagtacaagaaagaaggaaaaatggttaatctttttttttttttttttttttttgtgtgtgtgtgtgtgagatggaatctcgctctgtcgcccagactggagtgtggagtacagtggcacaatcttggctcactgcaatctctgcctcccgggttcaggcgattctcatacctcaccctcccaagtagctaggattacaggtgtgcaccacgacacctggctaatttttgtatttttagtagagacggggtttcatcatgttggccaggctgatctcgaactcccagtctcaagtgatgtgcccgcctcggcctcccaaagtgctgggattacaggtgtgagccatcatgcccagccaaaatggttagtcttaattttgtcatgcagagttatgcttggaagaagtgttttctggtcagtaatttgtgagtctttaaattgcaatactagaagccagatatgcatctaatatgtgtatgtatgatctttcataaacataggagtttaagaccaaactggccaacatggtgaaacccaatctctactaaaagtacaaaaattagctggatgcagtggtgtgttagacattttctacatgaactggtcttgctaagatcaccagtgaccttaaaatgtttactagtactatttaacctctccacgtatttcatactgcttggccattgctgcctgacattctcccctaggttctatcttctctatccttgtttcacctgttcttcctttgtgcctttccttcctcttttcttccatattttcctggttcctttttctttctaatagtctcttaaatattgatcttttccagaattctttccttagcctcttcttatttctagtaatctatctgggtattttttaaatccactcttatggttttaattactacctgaatataactttgaaatttgtacatctcacctagatctctctgggttttttttttttttttttttgagacggagtctcgctctgtcacccaggctggagtgcagtggcgcgatctcggctcactgccagctctgcctcccaggttcacaccattctcctgcctcagcctcctgagtagtacacccagcctcctgagtagtacgcccggctaattttttgtatttttggtaaagatggggtttcaccgtgttagccaggatggtcgcgatctcctgacctcgtgatgttttgttttttgagacagagtcttgctctgttgcccaggctggaatacagtagcacaatcttggctcactgcaacctctgcccccgccgggttcaagcaatcctcctgccccagcctccttggtagctgggattataggctcccgccaccatgcccagctaatttttctatttttagtagagattcaccatgttggccaggctggtctcgaactcctgacttcaggtgatccacccgcctcagcctcccaaagtgctgggattgcaggcgtgagccaccatctgagaatttacattgtaccagagcaaaatattttaaattaaaaaacaagaaacaattttagccaaaaaaaggaaaaccaccccaaaatagattttttttaaagaaataaggcgtcaaagacattctagaaaccttacccaatccaaactttggccccagttctaacccttgcccttgccttgtattgcctttatgccaccaactttataagccatgcttggttatgatgattattagagacacaggtacttaaaataggacaggggttctagccactatgtcttccaatccctgttatttgtaaaactttatgataatggagaagttatatactgttggcattttattattaaattagatgtttgcctgtttttaaggtggcttgtgtttttgttttttggttttttcttaggcatctgtgggaaaactagaattgcagaagttggaggtgtgccttacttattgcctcttgtaaaccaaaaaaaagtaagtacttttactctgcatattcacatgaagattgtagaagttgggttgattactgtgtttattattagaagacctgttgatcagttggcaaggaagtgctaatggatcagtaataaaaggtaaaccagggactttgtacaagttgtgacttaaataatattttttcctcttctataggtttatgatctgaataaaattgcaaaagaaatcaagctgcctggagcctttattcttggagcaggagcaggtccatttcagactctcgggttcaattctgaggtcagcatatataagaaaattattttactttattggtttgacatttggtttgtctttttgcttttagtgccaaaaatcctactttctgagtgaattgtaaatctctctgcaggtttgatactacttgatgtagatttctgctatagcacacactccaactggactaactgtaatggagtactaacttgtagttttagattttcttaggtcatagcttcagccttagataaatgcagggttctatggtattctgttgaaggttctggattataaaatatttatattcttacaggattccgagcttatctataaatctttgctttgggtatgcaggcagctttggattagaagatgaatggaatattagtgatctagtcaactccttcttccacaccaaatagtaggaaactatcacaatagtatgatggttatttatgaaagttaatagttattactagtatatattattaccatatgaaaatattactgtttctttgaatctcatgaatacaagacttcagtctgctcattctctcataacctcttcagatatgaatagtagtcatacaagttctttgcagaaacattagtacaatttgcctagtgttcaagttaggaaaaaaagttaaaaatttaaaataagatatttaacgcaagttatagatacactgtaagaaatccaataaatatcttttttttttttttttttttttttgagatggagtctcgctctgtcgccatgctggagtgcagtggcgcgatcttggctcactgcaacctccacctcccaggttcaagcaattctcttgcctcagcctcttgagtagctgggactacaggtgtgtgccaccacgcccagctaatttttgtatttttagtagagacaggttttcaccatgttggccaggatggtcttgatctcttctcttgacctcgtgatccgccccccttggcctcccaaagtgctgggattacaggcatgagccacagcgcccggcctataaatgttttccaagttttttatgtctaaaattaaatattatgtattttatgttctcttattaggacttgaactaaaatgtcttaaaaggattaaatgttttgtaacattattcaagatattctctttgcagagatacaaagattgactaattgcctcactttcttttcagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtgattgtgtccataaaaatacaatattccctaaatgttctcagaaagctaaaaatgtgaacttttactgccataaatatggttttgctaagaaaattagtttcccactttgggaggccaagctgggtggataacttgaggtcaacttgaggtcaggagttcaagaccagcctggtcaacatggtgaaaccccatctgtaccaaaaaatacaaaaattagcagggtgtggtggtgtgtgcctgtaatcccagctactcgggggggctgaggtgagagaatcgctcagactcggaaggcagaggttgcagtgagccaagatcatgctactaccctccagtctgggccactgagtgagactctgtctcaaaaaaaaaaaaaaaaagaaaattagagcttcctaagtcaaagctctttaaataacccagtaatgaaaggttcagagagtatgacaggcagagcaaaagtcatctttaaggttaagaataatatggctggaggccagacgcggtggctcacgcctgtattcccaagcattttgggaggccaaggtgggtagatcacctgaggtcaagcatttgagaccagtctggccaacatagcgaaacctcgtctctactaaaaatacaaaaattagacagggaaggtggcacatgcctgtagtcccagctacttgggaggctgaggcaggagaattgcttgaacctgggagacagaggttgcagtgagccaagattgcaccattgcactccagcctgggcaacaaagcaagactctgtctccaaaaaaaaaaaaaaaaaaaaaaagaatagtatggctggcacaatggcttatgcctataattccagtcctttgagaggccaaagctggaggatcacttaaggctggcagtttcagaccagcctgggcaacatggcaagaccctgtcaaaaaaaaaaaaaaaaaatttttttttttaattagccaggtgtggtggtacatgcctatagtcctagctactcaggaggctgatgcaggaggatcccttgtgcccaggtgtttgaggccgcaacgagctatgatcacaccactgcactcctacctaggtgacagcaagacctgtcttaaaaaaaaaaaaaaaagactacttagtaagcaagacctttttctgagaactaaaaggtaatagaatattaatttggggagtgagtttgtcatctacatgaaccatacagctaaaataaataatgcctacttacaggtagtaaataggttatttgcttctttctgatgaatcacacattgctctagatagaaatggtggtagcaaaaacttacagcaagaacaaagtaaggaaaactaatgccttacttgatatttacttcctattagtacacaaaaatatgatttcagtgttagcttttgtgaagactctccagttttggaagtagagatagcctcttcagctactttgagataagagattgagaagtgaaaatacttaacgtccaagttgtggagataatacagaattttaagggaagtgagaaaatgtaatcattttctcctcatccccacttaccaaaggttaattcctttaaccaaagaattaccaaaggtaattctcaatctttgactgcctcgacacgtatgttaagagtctctagactctctgcactgagaaacttgtctttctcagtttctcagttcaagaaagcatgcttaagacttactagtaaattacatgtaactgataagtatgtgtgtgtgtgtgtgcatacatatatatatgactgatcaaaattcacgggattgcaacatctcaactcagatctgggggctctaagcaaagaacagaatatttgcttgatagaattaaattatataatgttttatttcagtagttattttgcagcatagtcaatggtatgcatctttatgtcctctataggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatggtaagagcccatgtgtgcatacatgcatgaaggagtttgtgtgtgtgcacttacttaagatcttaggatttttttttttttttaaacggatccttgctctgttgcccatgctggagtgtagtggcacaatcttggctcactgcaacctccatctcccggattcaaggggttctcctgcctcagcctactgagtagctgggattataggcatgcagcatcacaaccggctcattttgtagttttagtagagacaaggttttgccacattggccagactggtgtcgaactcctgacctcagctgatccacctgtctcggcctcccaaagtgctgagattacagacgtgagacgctgcaccgggccagatcttaggattgtaaagtatgtgttgggaattctacatttgaagacactttaaacaaatcctttttattatgattgtattactttaaaatttaaatgataattttataaatcagattgtaagataatatctttgtccatgttagtatattagaactttattttggatatgtttgtttttaagatcaagataaattcaaggcctgcagagtgactcatgcctgtaatcccagcactttgggaggcccaggtgggaggaccgctggaggccaggaattcaaaaccagcctggtcaacatagtgatgatggcagcggcaggctctctggagcggctgcagcagggaggcacggctgaggctacacactctatggagcgggtgggagctgaagacaggtgggagtcctgccccttccgagttggcgctggagctccgttggtgccgctgcaatcgcccaagccatggctgtagtccctggcatccctgtgctctcccagtgggaacaggcgagagccccaactgcccaggcgcagctgcagcagctcaaacccgcggctgcagacctgggtctcccgctccacggagcaggcaggagccctgccttctccacacagctgcagctgcccaaaccgtggctgcggacccaggcattcctgcattcttgggggtctgggaaggcccccactgctcttacaggcttggaaatgcctgctcccactgcctggcttctccctgctgtcggcgcctgctccgatccaggagcaaagtcaggcagagcccggtcgctgtcgcagcccagccaggtgtgcacacgctcagggcactgctgacacaccagccccctgccgtcccggccccttctggatttggggcgctgacacgagcgtagaagggaagctgagcggcggctgagagcagctccccactggccttcaggcaccccttggcacctacagcctggattccgtgatcggcagcaggaggcagacaggttccggggcagaagggggcgggtttccggtgaggccccactttcgggccagggaaggcctgaaggctgggggcccagctgccaatcccacacaccagagtggaaacttgtggtgctttttccaggcccactgtgatcatcccactgcactccagcctgggtgacagagccagaccctgtcaggaaacaacagatgctggagaggttgtggaaaaataggaatgcttttacactgttggtgggagtgtaaattagttcaaccattgtggaagtcagtgtggtgattcctcaaggatctagaactggaaataccatttgacccggcaatcccattactgggcatatacccaaaggattataaatcattctgtgataaagatacacgcacacatatgtttattgcagcactattcacaatagcaaagacttggaaccaactcaaatgactggattaagaaaatgtggtacatatacaccatggaatactatgcagccataaaaaaggatgaatttatgtccttttcagggacatggatgaagctggaaaccatcattctcagcaaactatcacaagatcagaaaaccaaacaccccatgttctcactcataagtgggttgttgaacaatgggaacacatggacacagggaggggaacatcacacaccggggcctttcggggagtgggggactaggggagggatagcattaggagaaatacctaatgtaggtgacaggttgatgggtgcagcaaaccaccagggtacgtgtatacctatataacaaaactgcatgttctacacatgtaacccagaacttcaagtataattaaacaataataataaataagtaaaatatatttttaaaatttttaattcttagtaatattcagtatgtttacctatgtaattatcttttgttgtagcctgcagaattttcttcctgccccttgaactctgatgaagaagtgaataaatggttgcatttttatgaaatgaaagctcctttggtttgtctaccagtttttgtctccagagacccagtaagtctgtgtctgttttttatattatactacaatgataatgcttgatttttaggataatctttaagaactaggcacttttgtgtttgttgttgttgttgttttgagacagagtttcactcttgttgcccaggctagagtgcaatggcaggatctcagcttactgcaacctccgcctcctgggttcaagcgattctcctgcctcagcctcccgggtagctgggattataggcatctgccaccatgcctggctaatttttgtatatttagtagacggggtttcaccacgttggtcaggctggtctcaaaccactgacctcaggtgatccacccacctctgcctcccaaagtgttgggattacaagcatgagccaccatgcccggccatgtgttgttgttatttaagaatgagggtagcctctagaattattttggaagataagggagctcttcaccatcctatgagttaggcagagcagattttacctttgagaaaatgaaggcacaagcattttaaataacacccaaaattattttattaaatagcaggtgtagttgggcatggtcacatgccccagtattcttagctactgaggaggctgacttgaacccagaagtttgagaccagcctgggtaacagtataatccccatctcaaaaaaaacaattagtagagtcacaactaggattcaggtctcctgtcatcttgtttggtgttcattatattataatactatacgctagaaaaaatattacagaccaattcaaagcaaatacctactaaaatattggtcatatcttctcttttttttattttttgtgacagagtctcgctctgttgcccaggctggagtgcagtgatgcaatctcggctcactgcaacctccgcctcttgggttcatgtggttctcctgcctcaccctcctgagtagctgggattaccggtactcaccaccacacccggctaatttttgtattttcagtagagacagggtttcgccatgttgaccaggctggtctcgagctcctgacctcaagtgatccgcccgcctcagcctcccaaagtggtgggattacaggcatgagctactccgcctaccctggtcatatcttgatccagtgattacatgcctaggatattatacttaaatatatgcataattgtgtaaaattactagttaaaaggttattattacagtattgttgtagtagcaaaagaattagaaataatgcaagtgtcagttgagaagttacatacgcaatagaataccatgcaggtataaaagaatgaggaagctcttttatgatttcatatacaaagatctcaaaactatattgttacatgaaaaaaagttacatgcagaaaagtgtgtacaaaatactacatttgagtaaaaataaaagtaagtatttatggaaggatatacaagaaaatgcttacactggttacctgctaggaaggggagtgagtggtgagggcaagagagaagaagatacattttactgaatacatcgttttgccccctttgaatttagaacatgtgaatgtattacctatttaaaaaataaaaactattgcaacgtaaaaagttatccctcccccttaaactctaatcaataatttgagtactaacatattgtttgtctgttatcttaggggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttgaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaattta

SEQ ID NO: 1550 - DNA, 41762 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtca

SEQ ID NO: 1551 - DNA, 47861 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtcacttgagaagaaagggagaagttcctatgaggctgtcggaaagggaaatggggccctccgcttgttgaaaacaaaacaaaaccctcaggaagctttgcatcctgttagtcatagcttaaatttatgacttcaatgacttggctgggacagtcttaatctctccatactcaagttgttttaatttctgtaataataatttttataccaatgtttgtgttgttaatactaataattttacattgtaactgtaatcctttaattattacaagtgttaacctaaataacaaacatatgaaagcttcctaaaggaaacagtgtttatttgggaatagagcattgcaattgggaatagatatgccatattaaactatgtatatattcaggaagataaaggaagacagaaatggggaggattgcatattgttttgacaggattttccttggccacaggatcaggcacaaaggtgacattagtctgaggttggacaggcagttgctgggcagcattccttgcagaaatattttttgtttaaggttgcaatgacctttatgcaaggttgtgggttttgtagagtctttttcattttcaagcatacaaggataagaccccccctcttcatggctttcctggctttatttgtcagggtcatcttaacattagtggctccattttgttctgacaactttcagatttctccttgtgatcaagaactttctctaaaagcattattgatcaatcattctgtaattaagatttgatgtcccctgatgccagcatggacctctcccagtttgctggtctcatcccatgttgtggggagtgactggtgactaggaatcgatgtcaaaagcacatttgagcaacaaaagagatttgaaggatgtggctctcaggctaagtctccctggagtccattagtaagttcaattttgtctgttctacagtcttttgctatccctttaaagtgctgattcagtattattttgttaggagctgcacctctgaaaaaatttaacaagtaacacatacaaagtttaaaaaggagaaatacaaagtaaggggaaatacaaattaagagcaatatgagattttcagtttgcatatggttttgagccataaacctaggtttaaagacaactaattgaagaactcaaacagttattcgagacagcagggagttaggtgagacctggggtaaccacatggcctgctttcttattttgtgtataggagcctcaacttttctcagaggaatttattcaggtatagcatgtcgtattagcaacatcacagacaatttcttgcttaaccaatggatactaaagaattttgtaggttgggttctgttaagttataagcagaaggaattgatcataaaatttaagttacaccattattctgctaagtagaaaaggtcgaattaagtgagatgaaagtctcattatgatatagagtcttgtttcagcatcttgcagaaagttatacagtgtgaaaacaccaactttttctcctggtttgtagtgtgaacgtctctggttatgatattgggcagtttggtaaactattgtgtgatccgcatatcagccttgaggtttgttccctctttcattttcctctggatcaccaacatgctaatctacgttcacatcactgaaaccgtagaggccaataccaatttcaccatttctggtcctggatatttgcaagactgttgtcaaactaggccatacatacaataatttaatatacatttggggcttggattatatttctgttaaattgcactgctctatgggacttattttattcattccacaaatatattttgcacatgttccttattcttggtactatttaatggatttggcatacatccgtgatctaaacagataaaactcccccaaggatcatttataaatgtcatggtgattcgccatgtcctgtttgtgttcctcatggtctggaccagcatcaacatggccagtctcctctgcagacaccggcggagagcccagcgtctgcacagccctagcctctcttcccagccatctcctgaacacagagccacccataccatcctcctgctgcttggttgctttgtgtgcttttattgctcaaacaacttcatcactctttatttcttttataaatctgagaaaaaatcaagactagagatgatcactggaattatttcatcatgctacccaaccatctgcccttttgtgctaataaaaaataataaaattatttcctaatttacctcttcctctctaagacaagaatgatcagctctcagggagcattcaatggctgatctcaaaccccatactttcttctgcagctgggaagtctccatgatgacttttgtggagaaaaagtcatgcagttattgagcaattgaattagggctagtttgaattgaggtgtatcataaatttaaaaagcattcaggttttgaagtcaatataaataacagtatataaatattatcttaataactttcacattgctgacaagtttaaattatgacattttgggtaaaacgtatgtatatgttttgttatgtttacatatatatgcatatttaaataaaatacatatacacaaatatgtaagtaaaacatatgtaagaatatatataatatatataattttttttttttgagacagagtcttgctctgtcacccaggctggagtatgcagtggtgtgatctcagctcactgcggcccccacctcctggattcaagcaatcctcccacttcagccttccgagtagctaggattataggtgtgcaccaccatgcctggctaatttttttgtattttttagtagagacagagtttccccacgttggccaggctggtctagaactcctgacctcaagtgaaccgcctgtgtcagcctccaaaagtgctaggattgtaggtgtgagccaccgcactggccttatcagtatatacacacacacacacacacacacacacacatatgtgtatacatatacaactacataggtatttttaaactaactgtatctgcttgtttttgcttttttaaatgcagttgctagaaaatttaatatacatttggggcttggattatatttctgttaaactgcactgctctatggcacttcttgtattcattccacaaatacattttgcacatgttccttattcttggtactatttaatgggttggacatacatccatgatctaaacagataaaacataatagcacaagagattatacagaatgtttgtggtacaggaaaacgtatatgtacacatgataggagctaaaaagaataggactggttaagagaatgtggtgtgtgagagtacaggtgcagggagctgcagtgactgggattacaggtatgcatcaccatgcctggctaatttttgtatttttgtagagacggggtttcaccaatttggccaggctggtctcgaactcctggcctcacgtgatccacctgcctcagcctcccaaagtgctgtaattacaggtgtgagccaccgtgcctggccaacatttatcattttaaatactcatctgcaaaaatgtttccaagtggggccacttccccacccctcatatgacagtggcagtgatataccatatacatggttattaaaaagaatctggagcaacaatatgaatgtcagacaaattaggcttcaagagcatttccctccatcttacaggggataaacccaaagaagttatattaagattccaataaaagaatgcaagatgactatctgtgtaaaaatgtaatcaatggggagcaggtgcacctccaataatattagacaaaatatattttacctaaacagcattactaagtataaagtagatcacttcaataagaataacaattttaattttgtgtatacatattcacactttcaatatgtatatagtatacacgggtagaatgataaacagatatagaataatcctccactcttgtgggaaatctgttcaatagtctttcagcaattaacagaataacagagtatcagtaaagatataaaaaattgaccaaagcaattcatattcttgacttaagtgccctagaataacaactcacacagccattgaagaatccccatcatcctatctcaagcatagaggaaacacatagcatacatatgtagccacatagcaaacacagaaatgactatcaacaaagtggaagagtttaatgcacagattaagttatctgaatatatgtacaatgagttataaataataaataattgagccaggtgaagtagtacatgcctgtaatcccacctacttgggaggctgaggtaggagtttgagcccaggagtttgagtctggtctgggcagcattgcaagatcccatcccccaaataataaataaactaactaagtaatcaataattgaatgagaaaagttagctcatatttcaatatgttcaatcttaggatatatacttctaggcaaccacttagtgacaaaaattctgtagaaatccatcattgaaagttcattatgtaaataaatgtgaagactagataagaaccacagaacacaatgacattggaaaaaatgccacagtaattctttgaaaaaagaaatgcaggcctggtgcggtggctcatccctgtaatcccagcactttgggaggccgaagtgggcagatcacaagtcaggggttcgagaccagcctggccaacatagtgaaaccccgtctctactaaaaacacaaaaacaattagctgggtgtggtggtgggcacctgtagtcgcagctactcgggaggctgaggcaggagagtgctttcagagaaacttcttgatcacaaggggaaatctgaaagttgtcagaacaaaatggagtcacttatgttaagataaccctgacaaatagagccaggaaggccatgaagagagggctcttatccttgcatgcctgaagatgaaaaagactctacaaaacccacaaccttacataaaggtcttcacaaccttaaaaaaatatatatttctgcaaggaatgctgcccagcaactgctggtccaacctaggactaatgtcacccttgttactgatctttgtagccaaggaaaattctgttaaaacaatatgcaatcctccccatttctgtcttcctttatctccctgaatatacacatagtttaatacggcatgtctattcccaattgcaatgctctattcccaaataaacattgtttccggctgggcgcagtggctcacgcctgtaatcccaacactttgggaggccaaggcgggctgatctcgaggtcaagagacggagaccatcctggccaacatggtgaaaccccgtctctactaaaaaataaaaaattagctggatgtggtggtgcacgcctgtagtcccagctacttgggagactgaggcacgagaatcgcttgaacctgggaggcagaggttgcagtgagccaagatcatgccactgtactccagcctagccacagagcgagactccatctcaaaaagaaaaaaaaattgtttcccttaggaagctttcatatgtttgttagttaggttaacacttctaataattaaagttatacagttacagtgtaaaattattagtattaacaacataaacattggtataaaaattattattacagaaattaaaacaaattgagtgtgagagagattattaagactgtccaagccaagtcactgaagtcataaatttaagttatgacaggatgccgagcttccagagggttttgtttttaacaagggaggggccctatttccccttctgacacgctcatatgaacttctcactttgtcgtactccttccttgctgactaagaggaacagaacacagagcagcctggcggtgtcctaccaacaagcctccgtttctccttcctgtacactagggctcctgaaactcacctggtaagcgctccagaaaagcagcaggtggtgactttagggtaggacgggccaaatgggagaatccccttaggtcggtttctctggttctcaacttcttttgaaataacgctcgcagaggaggtgggctttctgagaactgagggaagtaagct

SEQ ID NO: 1552 - DNA, 41762 bp, Homo sapiens; identical to SEQ ID NO: 1550

SEQ ID NO: 1553 - DNA, 41762 bp, Homo sapiens; identical to SEQ ID NO: 1550

SEQ ID NO: 1554 - DNA, 41548 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttct

SEQ ID NO: 1555 - DNA, 41548 bp, Homo sapiens; identical to SEQ ID NO: 1554

SEQ ID NO: 1556 - DNA, 17686 bp, Homo sapiens
taacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttaccctgaaaaaataaaaggaggttgtatttaggtacttgggaagaaccatcagataaatcttagcttctgtgtctctcaaaggttgacaaaagcgcttattgctcattcacaagagatgcatcagtggaattgctcctagtagtggtaggtacttgggacagaggccgaaacaggagagttgtaaaacagaaactagaaacttcctttttttttagatggagtctagctctgtcacccaggctggagtgcaatggcgagatcttgactcacagcaacctccacctcccgggttcaagcgattctcctgcctcagcctcctgagtagctgggattacaggcatgcgccaccatacccggctaatttttctatttttagtatagacagggtttctccatgttggtcaggctggtctcaaactcccaacctcaggtgatcggcccgtctcggcctcccaaagtgccggattgcaggcgtgagccaccgtgccctgccggatttttcaaattcttttatttttgatgtggccctgggtctgcaagttaagttatgcagaacaggaacttctaaagattccaacctgacagaggcaaaagtgtgattattttccttgccttccattcttctctcgtacaactctaatcgtttttcttgcctaaattgtcaccttgatttctttaaaatacttgggtttaggaaccgttgtctaatccattaccttcaccggctctgctatgacattttttaaagattagatttttaaaataatggctttatggatatatagttcacaaaccacacaattcacccacataagtctacaattcaatgttgtatatatagtaatgaagttgtacaaccaccaccacaatcagttttaggacagcgtcatcacctcaaaaagaaactcattaagcggcactccccattccccacaggcacgcacacccagccacaggcacccacgcatccaccttctgtctccataggttgactcattctggacatttgatttaataggagttgttatggaccgaatgtatgtgtccaccctcaagttcatgtgttgaaatcctaactccaaatgtgatgataggaggagatggggccttcgggaggtgatgaggtcatgagggtggaatcctcatgaatggtctcaacgcccttagcaaagagaccccagagacctcgctcccgctttctaccgtgggagggcgcagcaagaagtcagccgtctatgaacaaggaagcaggtcctctccaggcactgaatgtaccagtgccttgatcgtggacttcccagcctccagaactgtgagaaataaattctgttgtttaagccacatagtctatgatacttttgttaaagaagcccaaagtgactaagacaggcatcaaacaatatattgtcctttgtgatggattctttcacttcccgtatgttttcaaggtccatccatattataccgcataacagcacctcctttgctttcatggctgaataatattccaccgtatggagacatcacatattctcttatccattcagcagacgatagacatttgggtgagttccactttggggctgttatgaaaaatgatactgtgaatattcaggtacgaatttccatgtggacagattatttccttctcttgggtacatacttaggagtggagttgctgggtcatatggtaactctatgtttacccttcaaggaactgccagactgttttccaaagcgccaatttccgtgctcgcttcggcagcacatataccaaagcgccaatctccattcccaccagcagtgtaggagggggccagcttctccatatcctcacctataattgttattatgggccttttgaaaatggccattctagtacatgtaaagtgataagttattgtgatttttgaagattaacttttatataataataaaaatacatattattaatagcatttcagagactctggataacagaaaagataattagtgaaatacaaatcattaatttgtaattagtcaccaggctgctccacctcccaggttcaagcgattttcctgcctcagcctcctgagcagctgggactacatgcgtgagccatgacgcctggctaatttttttgtatttttagtagagacggggtttcaccgtgttagccaggatggtctcgatctcctgacctggtgatcctcccgcctcagcctctcaaagtgctgggattacagacgtgagccattgcccctggcccagagaaataatctaaagatttgaattccaaaaccctatacaaatgttttattttaccaccactgaatttatctgcaataactgaatgtctatttatatgcataataatcactcacaggttccaactaaacaaatatttctatccaattttcaataaaaatattaaaatctgcatatttaatttattcatgtttaattattatgcttctcacagcctgcgaaaaatttaatttagctatcctctgaactacaagcttttcctttgttataacgaacacttttcttttacttaagtatcgttattccagagttaatatagtatgcattcaaattacttcttatttagtattattttacctagtaccattatatatttaattttttctcatgaagccaggcacagtggtttgtgcctgtagtcccagctactcaggaggctgaagtgacaggatcccttgatcccaggagattaaggtcgcagtgagctatgatggcgccgctgcattccagtctgggcgacaaagcaatacctcatttcaagaaacgaaatggaattttttccttataagaatcttaaagaaggtgtacattatcttggctaactttctataggattaagtagaagttattgagacttggtctacagtcttctttttttcatgagtcaaaaagcatctctcactttagttacacctgtattaggagagttatgatcaattacagcagttgtagtttctgagaacttggataaatacaaacctgaattacacagaatttatgtaaatccagatattcaaaaatgagaaataatgtaatatatgaccaaagtaatatcaagacaacatacaattaaatcactcaacaattactgggaatatgtatcaaggcaagaattgtaaaattctacctggtacttctgaaatgaacaaggcaatgagaaataacagtttatcttgtctattactgagtatcaatgaaagcaataaggtgaacggaaaagtccatgaaaactccattttcagaataatgaggagacagatttaattcacagatccaaatgtttctcaccggctgacaaaactgtgttaagtcagggtgaagcatggcggaggaacagggaggaagtgcagagtgagaaaacataaagaagtcaggaagtgccagaggagtaatttcctgtgagtaaagcctcatactcggtgatttatctatagagtttgaatacaagagctgtgaggtctgggcaggtagagtggaggctgagcaggagataaatgtggtagaggcggtgtggatccttgaaaacagagaaatgccctaatgtgacagagtacagaaatactacaaaaacacacttgtagaaagaacattctgcatataatcaggcatggaacggtcccatgcattccataataattaagaaaaagatattaccagagcattgcttaaaggcactacaagaaaataggtgagaagaccaggaagttgttgttttttgttttgttttgttttagataaagaacaatcaaaggaaaatgatggacccaagttaacaatcactcttggggggaaaaaaactccacccacaattcctaagtaaaaaggattacacacattctcggcataatatgtctctctcaggccaaaggataaccttgtgcttcatgtggacactatgaaatcattccagctgaagtcaggaaaataccaagaccttccctatttaagttaaaatatcggaagcttattccaaaatattggacaaattccaaatacagtgattgaaaggaaggagattaaactataactcactacacgttattttcctctatagagaaacataacgaatcacctgaaataagctacaaaagtaagataaaccagtaagttagagaaagaatctttttttttctttgagacggggcctccctctgtcgctcaggctgtagagaagtggcacaatctcggctcactgcaacctctgcatcctgggttcaagtgattctcctgccttagcctcccaagtagctgcgattacagacatgcaccaccatgcctggctaattttttttgtatttttagtagagatggggtttcaccatgttggataggctggtctcaaacttctgacctcaggtgatccgcccacctcagcctcccaaagtgctgggattacaggtgtcagccaccgcaccagccagaagaatcttaatatacaaaagtgaatagcttcttaatataacagactatcccaattccatgaaagaagaaaatacactcattaaaatagcaactatggtacctagaactaaactatacaaaaaaactacatgacccatataatgcttttattttgaaataattttaaacattgaaaaatagcaaagattcacataaatcctcaaccagcttatctgaatgttagctatatataattgtattatatataaaataattgttatatataaaataactaatttattgtattgtatattgtattatatatacatttattgtattatatataaataattgcatatctacatttaatatattatatataatatacaattgtatatgcaattgtaatatgataattacatatataatagtatatataatacaattatccaaccaggaaattgatgttagcatatcataccattacttaatgtgcagaccttatttgaattttatcaacatttgtctgaatgtcctctttgttctccaagatctaatcgaggatctcacattgcacttacttgttatccctccttagattcctccagtctgtgaccgtttcttattcttcccttgtcttttgtgattgtgacatttttgcggaacatggtcaactattttacagaatgtttatcaatttggatttctttgatgttttctcacgattaggctgaggtcatgcatgtttgtcttctgtgttcagtcaacatgccccgtcctttttggaatatttcttcatgttctggagtcacaatttgttccaatgttatcctatatactcctgccccagccctggaagtaaccacttctccacggatccttggctcccttgtattcaaaaacagtatttagaaaccaagatctggaaactatgtgtgtttacagctactaagatatctttgtcctaatctctctcagtggaaagacctggggaatccatgcatgtataccgaactgtgcctacacatgcctgtatttacttctcgatagatagactgacaaacagatagacaaatagagcagagcaaagagctattctgatacatgaaatagaaaatcaataataaaaaaaaacattgctctagaaataggtagacaaaggatatgaacatgaaattcacagaaatggaaaaataaatggttcccaagcacgtgctgaatgaaaaaacaccatgctgaatgaagattaaagctactcttgaatattttttctccatgaatttggaaatcatgcgaaagtctgaaaactcatctactgacaaggctgtgggaaatctgacattctgatattgctgatgggagtgtcacctgctattcattatatggatggcaactttatggacatctttgaacgcataaatgacatcccatttggaatggtaaatcaattttgaggaattgatatactcctatacaaatatacttacctatgtatgaactcatgctcacatgtttactcactgtggcactcttcataaatacaattgaggccaggcgctatggctcaagcctgtaatcaccacaccttgagaggccaagccgggtagatcacttgaggtcaggagttcgagaccagcctggccaacaaggtgaaaccccgtctctacgaaaaatacaaaaattacctgggtgtggtggcatgggcctgtaatttcagctactcgggagggtgaggcaggagaatcgcttgaaccaagaagtcataggttgcagtgagccaaaatggtgccactgcactccagcctgggtgacacagcaagactccatctcaaaaattaaaagtaaaataaaataaactaaaatttgaaacaactgaaatgtttttcaataggggaatgaataaagacatcatgatacatccgatgatgaaataatatgcaattttaaaagaatgtcaaagttcactaaaaactgatactgaattatcactaagatctattgttaatgaagaaaggcatagtaaacaacatgtaaactttctactcttcaagtaaagagtaaaaatttgtatatgcataaagaaactctggatatatatatatacagtaacaccacagtacatattcaactgtgtttggggagcagactatgtgaatttattaccctttataaagtaaacaaatggtttaaaaacctccacctaaaattttcacacgcaaaattttatatatatatactatactttcatgacactatgttattgtatatatatatatatatatatacacacacacacaatgcttccatttgttttgatgtcacacaagcaaaattaaattacactaaattttaaattttaacattaaaatacacatgatttttaccatttgtgatacacattgtatcatatgtattctcaattgaaatttcaattaaaattcagttaccactcatcaaattttactatgactatttcaactgaaaacattttcatattgcatttaaaaagttttgacggtttacttttattttagaaatcaaattatttcatgaaaaccaaatactcttcaccttaaattgtcttttttactcccatgaaaatctgtattcatcttcacaagaaaaaaatgcaaaattacattctttaaagttcaaatactaaaattcttgtatagtattttatgtgacattggaaattttaaaaaacatgtaataaaaatcccagtcacgcatgaagttatagccttgcctgcacgtattgcctgtagccccagccacccggaggccgaggtgggaggatcacttgggtccaaatggctgagaccagtctgtgccacacagcgaagccctgtcatttaaaaaaaattcctaaacttccaaaaattggaataaaattcattattccttgacatattgaagaaacaaacaacagagaaatgaattaatgatataaataaggaatcaaaaggataaaacacaaatgtcctgaaaagatgttaaaattcactagtaatcaggggaatgtgcatgacaaccactatcagttatcattctcacccacaatactgatggaaataagaaaagctgacaaaatcaagtgtgaatatgaatgtgtagcaatggaaactcgtaaaccagtagtggagatgactgaaaacacagccgctttggagaataaactggctgtatctagacttcaagacacacctacccttgaaattatgtgtggacaagaaaatgcatataaaaagtccattgtattatggtttgctatcagaaaacagggtaacaaactgaatgtccatcatcaaagaatggatacattgattataatatcatcattgcattaatactgtagcgcagttaacataaattattaaaaccacatgtaaacatggataaatatttaaaatgtactattgggccgggcacggtggctcacgcctgtaatcccaacactttgggaggccgaggcgggcggatcacctgagatcaggagttcgaagccagactggcaacatagtgaaactccgtctctactaaaaatacaaaaattagtcgtgcgtggtggcgggcgcctgtcaccccagctactcgggaggctgaggcagaagaatcgcttgaacccgagaggtggaggttgcagtgagccgagatcacaccactggactccagcctggatgacagaacgagactccgtctcaaaaaaaaaaaaaagtaatattgattaaaaatcaaattgcatgagactgcacagcacgataccaagcaaatacaagttttaaatattacagaaaataatatttaaaatacaaaccaaatacataaatcatgcagggggattaagacgtttctggatagtggcaacagccgagagtggctggatgaatttcagagaaatttcatatattgcttcaattttatttaaaatatattattacctatgttttagatattttattgtaaataatgggcaaggatattataaactctgcagaagtaagtgtagtcgtgttttttcctactcacattgaagatggcccagatgcttgcactaaccgcgtttaccgcccacagccatcatggcgaccggaagtcctgagagcttgtttccctcgaatctcagacagccctccttctctatgaacattatttcaaaagaagttgagaactagagaaaccgaagcttaaggggattctcccatttggcctgtcctcccctaaagtcaccacctgctgcgtttctgcagcgcttaccatgtgagtttcaggagccccagggtgcaggaaggaggagcggaggcttgttgcttggacactgccaggctgctctgtgttctgttcctcttggtcacttgagaagaaagggagaagttcctatgaggctgtcggaaagggaaatggggccctccgcttgttgaaaacaaaacaaaaccctcaggaagctttgcatcctgttagtcatagcttaaatttatgacttcaatgacttggctgggacagtcttaatctctccatactcaagttgttttaatttctgtaataataatttttataccaatgtttgtgttgttaatactaataattttacattgtaactgtaatcctttaattattacaagtgttaacctaaataacaaacatatgaaagcttcctaaaggaaacagtgtttatttgggaatagagcattgcaattgggaatagatatgccatattaaactatgtatatattcaggaagataaaggaagacagaaatggggaggattgcatattgttttgacaggattttccttggccacaggatcaggcacaaaggtgacattagtctgaggttggacaggcagttgctgggcagcattccttgcagaaatattttttgtttaaggttgcaatgacctttatgcaaggttgtgggttttgtagagtctttttcattttcaagcatacaaggataagaccccccctcttcatggctttcctggctttatttgtcagggtcatcttaacattagtggctccattttgttctgacaactttcagatttctccttgtgatcaagaactttctctaaaagcattattgatcaatcattctgtaattaagatttgatgtcccctgatgccagcatggacctctcccagtttgctggtctcatcccatgttgtggggagtgactggtgactaggaatcgatgtcaaaagcacatttgagcaacaaaagagatttgaaggatgtggctctcaggctaagtctccctggagtccattagtaagttcaattttgtctgttctacagtcttttgctatccctttaaagtgctgattcagtattattttgttaggagctgcacctctgaaaaaatttaacaagtaacacatacaaagtttaaaaaggagaaatacaaagtaaggggaaatacaaattaagagcaatatgagattttcagtttgcatatggttttgagccataaacctaggtttaaagacaactaattgaagaactcaaacagttattcgagacagcagggagttaggtgagacctggggtaaccacatggcctgctttcttattttgtgtataggagcctcaacttttctcagaggaatttattcaggtatagcatgtcgtattagcaacatcacagacaatttcttgcttaaccaatggatactaaagaattttgtaggttgggttctgttaagttataagcagaaggaattgatcataaaatttaagttacaccattattctgctaagtagaaaaggtcgaattaagtgagatgaaagtctcattatgatatagagtcttgtttcagcatcttgcagaaagttatacagtgtgaaaacaccaactttttctcctggtttgtagtgtgaacgtctctggttatgatattgggcagtttggtaaactattgtgtgatccgcatatcagccttgaggtttgttccctctttcattttcctctggatcaccaacatgctaatctacgttcacatcactgaaaccgtagaggccaataccaatttcaccatttctggtcctggatatttgcaagactgttgtcaaactaggccatacatacaataatttaatatacatttggggcttggattatatttctgttaaattgcactgctctatgggacttattttattcattccacaaatatattttgcacatgttccttattcttggtactatttaatggatttggcatacatccgtgatctaaacagataaaactcccccaaggatcatttataaatgtcatggtgattcgccatgtcctgtttgtgttcctcatggtctggaccagcatcaacatggccagtctcctctgcagacaccggcggagagcccagcgtctgcacagccctagcctctcttcccagccatctcctgaacacagagccacccataccatcctcctgctgcttggttgctttgtgtgcttttattgctcaaacaacttcatcactctttatttcttttataaatctgagaaaaaatcaagactagagatgatcactggaattatttcatcatgctacccaaccatctgcccttttgtgctaataaaaaataataaaattatttcctaatttacctcttcctctctaagacaagaatgatcagctctcagggagcattcaatggctgatctcaaaccccatactttcttctgcagctgggaagtctccatgatgacttttgtggagaaaaagtcatgcagttattgagcaattgaattagggctagtttgaattgaggtgtatcataaatttaaaaagcattcaggttttgaagtcaatataaataacagtatataaatattatcttaataactttcacattgctgacaagtttaaattatgacattttgggtaaaacgtatgtatatgttttgttatgtttacatatatatgcatatttaaataaaatacatatacacaaatatgtaagtaaaacatatgtaagaatatatataatatatataattttttttttttgagacagagtcttgctctgtcacccaggctggagtatgcagtggtgtgatctcagctcactgcggcccccacctcctggattcaagcaatcctcccacttcagccttccgagtagctaggattataggtgtgcaccaccatgcctggctaatttttttgtattttttagtagagacagagtttccccacgttggccaggctggtctagaactcctgacctcaagtgaaccgcctgtgtcagcctccaaaagtgctaggattgtaggtgtgagccaccgcactggccttatcagtatatacacacacacacacacacacacacacacatatgtgtatacatatacaactacataggtatttttaaactaactgtatctgcttgtttttgcttttttaaatgcagttgctagaaaatttaatatacatttggggcttggattatatttctgttaaactgcactgctctatggcacttcttgtattcattccacaaatacattttgcacatgttccttattcttggtactatttaatgggttggacatacatccatgatctaaacagataaaacataatagcacaagagattatacagaatgtttgtggtacaggaaaacgtatatgtacacatgataggagctaaaaagaataggactggttaagagaatgtggtgtgtgagagtacaggtgcagggagctgcagtgactgggattacaggtatgcatcaccatgcctggctaatttttgtatttttgtagagacggggtttcaccaatttggccaggctggtctcgaactcctggcctcacgtgatccacctgcctcagcctcccaaagtgctgtaattacaggtgtgagccaccgtgcctggccaacatttatcattttaaatactcatctgcaaaaatgtttccaagtggggccacttccccacccctcatatgacagtggcagtgatataccatatacatggttattaaaaagaatctggagcaacaatatgaatgtcagacaaattaggcttcaagagcatttccctccatcttacaggggataaacccaaagaagttatattaagattccaataaaagaatgcaagatgactatctgtgtaaaaatgtaatcaatggggagcaggtgcacctccaataatattagacaaaatatattttacctaaacagcattactaagtataaagtagatcacttcaataagaataacaattttaattttgtgtatacatattcacactttcaatatgtatatagtatacacgggtagaatgataaacagatatagaataatcctccactcttgtgggaaatctgttcaatagtctttcagcaattaacagaataacagagtatcagtaaagatataaaaaattgaccaaagcaattcatattcttgacttaagtgccctagaataacaactcacacagccattgaagaatccccatcatcctatctcaagcatagaggaaacacatagcatacatatgtagccacatagcaaacacagaaatgactatcaacaaagtggaagagtttaatgcacagattaagttatctgaatatatgtacaatgagttataaataataaataattgagccaggtgaagtagtacatgcctgtaatcccacctacttgggaggctgaggtaggagtttgagcccaggagtttgagtctggtctgggcagcattgcaagatcccatcccccaaataataaataaactaactaagtaatcaataattgaatgagaaaagttagctcatatttcaatatgttcaatcttaggatatatacttctaggcaaccacttagtgacaaaaattctgtagaaatccatcattgaaagttcattatgtaaataaatgtgaagactagataagaaccacagaacacaatgacattggaaaaaatgccacagtaattctttgaaaaaagaaatgcaggcctggtgcggtggctcatccctgtaatcccagcactttgggaggccgaagtgggcagatcacaagtcaggggttcgagaccagcctggccaacatagtgaaaccccgtctctactaaaaacacaaaaacaattagctgggtgtggtggtgggcacctgtagtcgcagctactcgggaggctgaggcaggagagtgctttcagagaaacttcttgatcacaaggggaaatctgaaagttgtcagaacaaaatggagtcacttatgttaagataaccctgacaaatagagccaggaaggccatgaagagagggctcttatccttgcatgcctgaagatgaaaaagactctacaaaacccacaaccttacataaaggtcttcacaaccttaaaaaaatatatatttctgcaaggaatgctgcccagcaactgctggtccaacctaggactaatgtcacccttgttactgatctttgtagccaaggaaaattctgttaaaacaatatgcaatcctccccatttctgtcttcctttatctccctgaatatacacatagtttaatacggcatgtctattcccaattgcaatgctctattcccaaataaacattgtttccggctgggcgcagtggctcacgcctgtaatcccaacactttgggaggccaaggcgggctgatctcgaggtcaagagacggagaccatcctggccaacatggtgaaaccccgtctctactaaaaaataaaaaattagctggatgtggtggtgcacgcctgtagtcccagctacttgggagactgaggcacgagaatcgcttgaacctgggaggcagaggttgcagtgagccaagatcatgccactgtactccagcctagccacagagcgagactccatctcaaaaagaaaaaaaaattgtttcccttaggaagctttcatatgtttgttagttaggttaacacttctaataattaaagttatacagttacagtgtaaaattattagtattaacaacataaacattggtataaaaattattattacagaaattaaaacaaattgagtgtgagagagattattaagactgtccaagccaagtcactgaagtcataaatttaagttatgacaggatgccgagcttccagagggttttgtttttaacaagggaggggccctatttccccttctgacacgctcatatgaacttctcactttgtcgtactccttccttgctgactaagaggaacagaacacagagcagcctggcggtgtcctaccaacaagcctccgtttctccttcctgtacactagggctcctgaaactcacctggtaagcgctccagaaaagcagcaggtggtgactttagggtaggacgggccaaatgggagaatccccttaggtcggtttctctggttctcaacttcttttgaaataacgctcgcagaggaggtgggctttctgagaactgagggaagtaagct

SEQ ID NO: 1557 - DNA, 32978 bp, Homo sapiens
tgtgtgcctttttgttttaataacattaacctatttttttatttttgtaaatttatgaagtacattcttcaaatgtaacaatttagttctacttcaagataaggtatagacaactgcaaaattccactgtccttacgatcacaatcatgaagaggatggagctgcagaatctgagcatataaagacttttatgaattctaacgcccaaccccaacttgagcattcattgcgctggtcctaattcacattcaaacgccctgagaatggagctaacaggatacactgcacccaatctcataggcacacacaggatagatccgaataccactgcaaagacttttaaaatgagctgatattaagacctcagttcacagaaagccaaataaataataaacatcttctgttggatacaaataaaacagagtctcataagataacattcacatttcgagggtacatatcggaactactgagaatacaaggatgagctgcaaaaatctccacttgtctggcaaatgacaactcagtggacaccaaacactgaataacatgtacagtgaaattatctgacaaagactttaaaagagacattataaaaatactcaaatgaggccaggcacggtggctcatgcctgtaatcccagcactttggaaggccgaggcgggtggatcatgaggtcaggagatcaagaccatcctggccaaaatggtgaaaccctgtctctactaaaaatatttttaaaaaaaaattagccgggcgtgttggcatgcacctgtagtcctagctactcaggaggctgaggcaagagaatcgcttgagcccgggagacagaggctgcagtgagctgagatcacaccactgcactccagcctagatgacagagcgagactccatctcaaaaaaaaaaaaaaaaaaaaaaaaatactcaaatgtgccaggtgtagtggcctgtaatcccagcactttgggaggctgaggtgggtggatcacttgaggccaggagttcaaaaccagcctggccaacatagcaaaactctgtctctactaaaaatacaaaaaattagctgggctgtggtggtgcatgcctgtaatcccagctactctggaggctgaggcacaataatcgcttgaaccaggaggcagaggttgcagtgagctgagatcgcaccactgcactccagcctgggtaacagagttgagaccctgtcttgaaaaaaaaaaagctcaaacaagcaaatgctgacacatttgcaggaaaatagaatataaggcaagaaatttaaaatatagagaacaaaatggaaattttagaactgatacatacagtgaccaaaatttaaaaggtggtgaatgcactcagtgggacgacacagataacaacaggtgaacactccagcaaatttgaaaatagacaaattaaaattacccaatcagaataatggaaaaaatgaaaagatgttctaaataagtagaatatcagggacatttaggaaaacataaaagtctaacatttccacaataagagtctcagaagaggaggaaaaaaacaaaatataatattgattgattcaacataaatactatggtttatttctagatggcaaggaaaatcacatgtaagaggtttccatttaaaagaattccactattcatcaaaattttcatctattctcaagactgttgatttcaaactaggtttagagtagcaaagcatatgaattttacagtagaagacatgagaaggatataaaagtttgttttctgtattctttcaaaattcttattttgaaggccttctgggcatataagctattggaacttgtcatcacttaaactatttcctataaagatgaaaatcaggctaataaaaagtatttttagaaattaggctgaaaacctctaagtttggtaaaagacataaaactgcaaatttatgaattggagcaaattccaaagggaataaaacaaggaaactcatccccaacataatgaaatggctaaaaactaaagataaataccttgaaatctgacagaaaaatgacacactacatacagggaaacaacaatttgaatgactgcagatttctcatcaggaaatacggaagctaaaaggaaactgctgaacagaaaacaatgtcaactaaaaatactacaagcaaaaaacatcactgagaatgaaggtgagaaaaagatgtcctcagaggaagcaaaaaataagagaatctgtacctatcagaaccactctaaaagaactaaaaaacgtctatcagaggaagtggaaatttgcagaacgaaatttggaaaataatgaaggaagagcaacagaaatggtaaatatctggaaaaacataacagattactcttctcatgagttttttaaatcttctgagtgattaaaagtagaaaatatataataatttattgatgggttttaagatacagaaagattatgtagaagataactatatcctagatgagaaaaggtaataggatctaaatggtgataaagtgcctagattccactttaagtggtacaaatgtgataacagtagaatagaaaagacataacaaactggctgactgaggataaatcctaacatattaataattacattaacgtaagtaattgaaatcttccagttaaaagagactatcagaatgggttcaaaatacaccataaaaaaaactgactcaaccagatggtgtctactaggaacttgttttaaacagattaaacataaaaggatggaaatatgtgtgccacgaaaacattaatcaaaagacagctgaaatggctacaaaatgacagagtctatggtagaatccaaatgtcagagttggcttattttttgtatggtacattgccaggaatgtctgtctcagaataagctgaattaccctcattttctttttggtggttctgtggagttgatttaccacatttcatctcagtattccttggagttgaccatgaacatttaacccaacaactccttgtagcaggctacacaccagtgggaaaatattttctgctcatgtttgcattttctcccatttttgtgctctctttcagcaaatacatttacattgttctaataacagtagccatagataaagtgttaaagtcctaacatacaaaaaaaaaaaagactgtcatcatgtatgccttgagtgtcctcagctgagaagcttttgttagcttttctgcttttagttatgagaaggtgatacttcaaacggagtgtccataggaattatttttcacattaatcaggaaaagttgcctttccaggccccatccttcataaacacacctatccggatgtcctttatcctgggtcttcaagaatcatgtcaatggataaaatagtgatatatcaagcaatggttggaaaaaatttaaaaggaatattactaccttcttcagacattcttgaggaaaatgcatgaggatacagtcaataggtacatgccaggttacaagtctgtcctgaaagcctgtgtgatagatgttacccagtcttcttctgtcttgaacactgaaatcaatgatcacatttctgtttatccatttccaatgagaacgctggattctctcttccagactacctaactgactcattttacaaattctgctgtctaagataggacacgaggtaagggtccctttcactaatgcttctgaagagcacgtccagggccaggtcccctttcttctccaccatgctcagcaaggcctcattcttgctctgccgtgtcttttcctgctccaccagctccttctcattctcagtaagaacctcattgtcttggagatcatcgagcacccctttcaggtcccccatcctggcttggagttgccggtggttctccttcacaaaggctgcacctggatgaaagggggagtttcagactttgagaatcgttcacttacaggattcaggatctataccaagcttagagtcaaaattcaggggtgggagattgctccttgtgtctgtagcttaatttgtggacatacaaaatcacacacattcacagagcaaatataccctttgcagtatcaaatgcattgaggtgtctcaaataatgtatcttcctcagtcctactcctctcatccatttcttgaagcctgtttcttcctagttggtgtttttcattgaaatcctagacagagctctatcttgctgtacatacatttatatataaatccctctaacaacgaaacacaaatcttctagttcatacattgtcagaaactgtgcatgatgctagaggtatggagaaggattcagctggatccccaaagcttagctggcagagctatgaaagaagagatttaactggagacatacaatgcatagaaaaggaagaacaggggaaaagatacagacttttttccatcatgtagactcagggtttacgttgtgccccatataatgtctgtataaacttggccaaatcatattacttccatatcacgtggtttagaatgcatggaggttgaggtgtgattttgactcaagacatgttctggaccagcttcctgtagactgagctactaagctttgatttcaacgtgcaggcaacaggtgctatattttgctccacatcctaaacattatatttaggaagggtagaagccttttgttggtgctgctcagcctgcagtcaccacctacagagatgttctttgatttattttaggacgtcacctttatctgattcttaaccaagctccttagctgatcctcattgcacctccagatgtgaggcatgatttctttttatttaatctgcctcaatggccttccaggcaacaacagctaggaaatggcatgattgccatctcagaaggtgctctcttttttctcccagtggtctgttttgagacatgagttcggaaacttacactgtgtggagcctgacaatgaagccaacaatatggaaggcgggacgaagacatggagaaacattcctcccttgtgatgttgtttgagcccatgaatcagcctccctggagtcagtcccacatctcttccttgaactcgcctgagccatgacactcttgataatttcactccatttaagttggactttctgtcatttgccacacaagactttacacagatccagaggacattgcagattgctgccttgggtgatttttaaaattaacgtggacatgaagtcatcaggagacaaggagttccaaacctggatttattgcttactagatgatggaaacttggtcctctcagtgttaactctattttatttatttacttatttatttatttattttgagacaaagtctcactcttgtccccaggctggagtgcgatggcacgatctcggcttactgcaatctccgcccctgggttcaagcgattctcctgcctcagccccccgagtagctgggatcacaggcatgtgccaccacgcccagctagtttttgtatttttagtagaggcagggtttcaccatgttggccaggctggtctcaaactcctgacctcaggtgatccacctgcctcggcctcccaaagtgttgggattacaagtgtgagccactgcacccagccaactctttatattaaataatgtaaataattttttctctgctatatactaattccagtgtccttaacagatccttggctgatatctgctcttcacttttacaacagccccaccgttccccacttcctattcattcccaacccacactcaatcatccacgctgttttgaagagccaacacattgttatccatcctttaatagttactcttgcctttccgtctaaagtccaaaatatttcaacttttattcttggactttcaactgccagctcttgactatccttctcatgtcacctttactctgtccctctaacagtttaattcacagccatatcaaactactttaacttagagttccccagacgcaagatattaaatatttacccccaataatttgctgttgtatgctcttttgtgtctacatgatgtcctcacgcccttctgggactaaatcatactcattgtctgtatttatgacatcagtcattcttggcagatgacaaggatggaaggaatggagccttgctgagagatgctgttacagcaggcagctcgtcagatatgagcagggcaggagaggactcctcaccccaccagaaatgtcaggcaaccatcaggtgatggtcaggcagttgttacaccgtctctctaaaataataattggttgcagccggcaccagggaaaggccgtctcctgacagagagaaaacacctgaaactggtgatcagcagcttcccaataagatctcgggaactgggccagtgggctcaagaatgtgcattaagagcagagtttaactggcctataacctcttacggaggttgagctggtaagggaagaatgcctcaagtgagcatgcgtatgactccaagaaacacactgcgcatgctccccttccaagcccctgcgggccactatgcaggcgaccagcccaccccaggggaagaatcagggaagaagggatgcaagaccccggaagtgtgccaacatattaaaccccaagtcaaaaggtcaaaccgtgcacttgtctttcaagtcaccccctcggccgtcttccaagtgtactttcctccttcctttcattcctgctataaagcttttttttttttttttttttttttttttttttttgtagaccgagagtcttgctctgtcgcccaggctggagtgcagtggtgcgatctcagctcactgcaacctctgcctcccgggttcaagccattctcctgcctcagcctcccgagtagctgggaccacaggtgcccaccaccacgcccggctaattttttgtatttaagtagagatggggatttcactgtgttgcccaggctggtctcgaactcctgagctcaagcaatccacctgcctcggcctcccagagtgctaggattacaggcgtgagccactgcgcctggcctcttgctgtaaagctttttaataaactttctctcctgctctaaaacttgcctcggtctctccttctgccttatgcccctcagtcaaattctgtcttctaaggaggcaagaattgaggttgctgcagacctatacggatttgctgccagtaacgttctggtgccatgtcacttggataccttccactgtcactcaaagaccccttgatgtctcatacatacccttggctttaatgtaaacatttcacttacctgagaaaggaggaggggctgatgcagctacaagctggagatccactacaaaagagggaaaaattatatgatgagatgagataaatcatgtacccttatttagcttttctagtctttgatgcaaccaactgaaataatttaattctacatatgtcataaggctcttgttttgcacactaatacactgaggaaaccccattaagttgtgggtcactcactgacaattcagaaaaggcatcggaggaagaaacacatttttccaatttctttcaacttgcaggccaatatcttaggaactatggggctacaaaaacatatcatacagtgctacataaattacagtcaaagtgttttagacatgaaataacaacattacatgagttaattaaaacacgtgttttttggatgtgattgtaccaagactgttgatggtgcagaaatttgggtacccttataagttgatagaagatttgctaattggagctaccattttggaaaataattaaaaaaatttcccatgatgccttcaatgtggttttgcactttcatctagactccttgatgttttcaaagttcagatgaattttgcaacatgccccccccaccccacctttggcagcagctcagtcaccatgtcaccaagacagaataaatatgagcttcccatctcctgtgaggtctcacaattgagtttctggtcatttgacttctgggcagaacatgagctgccttgaaccagcatactcatccaagacccagccatccacaatctcccccatttcatctagaatttgctatcaaaaaaaaaaaagcatgattgtgacacctggaaaaaatcttttttaaataaaaaagtaaacaatgtaaaaatattctgatgtttacagagaaatggagagtgtggtggcatttgcttactcaaaatatgtattgcatgttggctgtgaactagattgcattctagccactgataatgcaggcaatggggaatccgacatctgcacggcttcttcgcatattaaacatcacaaggagagctaagaagttgcacaaacaaaactctgacaatctgagatgctaagacattttaccgactggagggaggaggcggggagggtgcatgtggaggtgcactcatgagatgctactcatgtggagatgaggcctgggtcggctgagcatcatccaaccctgcaatgtgcctggaaactccaagtgcagtcccagctcatgtgcaccgcctcaacaagagggcagtttgcccagagaaggggaggcacagccatgaagctgatcttgaactctagacaccattgcagggaaaggaaggtgatgggattgtgaggattcagtggaggaaggaagatcagtgactgaggaccacaaagagcagacagtctacaccagtggtccccaacctttttggcacctgggaccggtttagtggaagacaattttttccacggactggagagggaggggatggtctcaggatgattcaagtgcaatacatttattgtgcacctaagttctattattacattgtaatgtataatgaaataactatacaaacaactcaccataatgtagaatcagtgggagccctgagcttgttttcctgcaactaggtggtcccatctcggggtgatgggagacagtgacagatcatcaggtgttagattctcctaaggagcatgcaccctagatccctcgcctgcacagttcacaatagggttcgcgctcctacgagaatgtaatgccaccactgatccgacaggaggcagagcgcaggcggtaatgcaagcaatggggagcagctgtaaacacagatgaagcttcgcctgctcaccgtccactcacctcctctgtgcaacccggtttctaacgggccacagaccggtaccagtccctagcccgggggttggggactcctggtctacacagtcaacactgtgacaatattgccccaaactactaaaatacaacagcagcaacaggcaaaactcagttgaaattgttgaaaaccattccacaacatgtactcacacatttgttcaactatgtccttcttcctgggcattcagtttggtttcatttttttcccaccacagacaatgcctcaaataatatcactgcatacaacttatcttcatatgggtgcttttatgttatagtatggaattctaaaagtgactttttgttcaagagacttgttttaaaattaatctgtgcccatacaactacataaaaggttaaagcgatttatagctcctatgcaaatgttaatatccttcccttcatagagcttcattgaaatttttcatgctgtgttacccaagacaaggatctgctactattgaagatactgatttctgcatcattgtagttattcaaacagagcatggcattttacaaatgtattggagatataaatgtatctccagagattcaaggaactatcaggagatctttggcaaattgtctgggagtttctaaactttaaaaaattgtgtttatgatgttgagcttctgtgaatggataaaacattttccagaactttttaacagattacctcagggaatatgacaccccgaaaatgaaaagcatgagtatggaagaaatgattaaattgtgaagaaagtggaactaaatagtccttatgtttcttctgactcttagaatcttctgttctttaccccctaggttcgagggtttccacccctctcccaggccccttgagcatttcacttcctagagatgaacaaatgccaccattgttgtgttatcacactgataatacactgacaatagatttctcttttttttttcttttttggcaagaacattttattttattcaaactattttttttaatttaatttaagttctgggatacatgtggaggacatgcaggtttgttacaaaggtaaacatgtgccatggtggtttgctgcacctatcaaatcatcacctagatattaagccctgcacgcattagctatttatcttcttctttttttttttttttttttttcagatggagtttcgctcttattgcccaggctggactgctgtggcacaatcttggctcactgcaaccccctcctgggttcaggtgattctcctgcctcagcctcccacgtagccaggactacaggcatgtaccaccacacctggctaattttgtatgtttagtagagacagggtttcaccatgttgagcaggctggtctcgaactcccgaccttaggtgatcctcccccctcggcctcccaaagttctgggtttacaggcatgaggcaccgtatctggccttttagctatttatctagatgttctcccttcccacatcacccaaaaggccccagtgtgtgttgttcccctccctgtgtccatgtgttttaacactgacaatagatttcttttcttctctgggaaagaaccataaacaagatttcttctttgaaatccaaggatagaggtacatgatggatccctgtctaaaaatgccagcctcgcccactcacctacctggcttcacctcagtatcccacaccaaagtcccatgtcttttttcagtaatctcaagttgaatgggttccttcatctgcccagcatagaattttgagaagtgctgaatttctccagggctcctgtaggacaatttcaactcctagaggaaacacatcagttgacttgaagcagtggagggtggaaaggcccggctccctacagtgaactggccaatggaacttaacccgtttcctgtgcaatgtcatggctggttgagtgggaaacagagggagagaggtaaacagctctttacatttacaatgttaggaaatgcttttataccaggaagggaagaataacctagctgtcaacaccacatgagtcagagaaaaactatctgagctaccaactgaatacaaacgtcttagattttgagggttttgaggcccctcattaatgatgcgaccagctcagaatccgagattctatagagaagcaagaaagcttccaaagcagccccatcaggtctctctgagcctcgctgggaagccggggtcagataagccatttcaggtccctctctgttttgcacccagtctccccaggattcctaaaaaaagctgccctggggagcaagaaagccccttatgcaggacagaattaggaaaagcttagctcatgcaaatctctagtttcttcagaaaacaagccccccgacccagctcttggaaaatagggatttaaaaaattacaaagggtgagattgttggctggaatctttttaaatggaagatgactctgaggagagtttacctcgctcaagatcatcacctctagggcgggcgcggtgactcacacctgtagtcccagcactttgggagactgaggtgaccgattgcttgaggtcaggagctcaagaccagcctggccaatatgttgaaacccccatctctactaaaaatacaacaattagccaggcgtggtggcaggtgcctgtagtcccagctactcaggaggctgaggcaggagaatcgcttgaacccagggaaagaaggttgcagtgagcagacattgcgccactgcactccagcctgggcgacagagtaagactctgtctcaaaaaaagattatcacctcaggttgcaattgccacttcttatctcacatttactatgttgtatcattctggatgaaataccctgcattttatttatttatttctatatcagcaatgtttatggaaggttctgcaacagccaagaatgtatcttgcctgaaggacaaccaaacttctggggaaggcagtccctgcttcatattaattgctgtggagtttatcaaggaaactgggaactaaaatcagagcaaggttgggcactttattaaattcttatgctctagtatacttagaaaaagatcactgaactgatgtctgcaataagcttcacatcttgttgtctatatggctggaaaaatcatttttcctattttagccttagtgtccaaaaaggagacatgtaaatactgacacctaaccctcttgtttctcacctcttccaaggtccgcaaacaggaaaaagccatctacgccaaaacaataacattggtccgtcccattctgaattaaagaccttgaaatcactgggatgtgttttcccattaaaactggaaaacaattaaatcttgatactttgttctagagatggtatattgtgctggacaacctcatctttattttagagaacatatgctgtgagacatctttgaaaatctatttggggccaggtgtggtggctcgagcctgtaatctcagcactttgggaggccaaggtgggcagatcacgaggtcaggagttcgagaccagcctggccaacatggtgaaaccccgtctctactaaaaataaaaaatcagccgggagtggtggtgcatgcctgtaatcccagttactcaggaggctgaggcaggagaatcacttgaacctgggaggcggcggttgtagtgggccaagaccacaccactgcactccagcttgggcaacagagcgagactccatcaaaaaagaaggaaagaaagagagaaagagggaaagaaaggaaaggaaaggaaggaaggaaggaaggaaggaaggaaggaaggaaggaaagaaagaaagaaaaagaaagaaagaaagagagaaagagggaaaaaagaaagaggaaggaaggaaggaaggaaatctatttggaaatatactagctttaagttggttaatactctttgaatcagtaatttcatttaggacactctagccctgcaggaaaaatgtaaaaccatatgaatggaaagacttcttgccagggcacttcttgggagaaattacatgcgactaaatgttgaataatcatgaaataatgaaaaaagctctagggatttcgctacatggcatatcatgtcccagtaaatctgtatgtaggaataatttaaattgcacagaattatatagtaatctccatttaaaaatatataaaatgaaatatataacataaaatcagctcttccttcaactaccttaacaaatacatattaagtgcgttagttaggcaagacatcaggactgaagataattataacagggaaatggaaatttcagtttgggaaactcaatgtgtagttttaacctaacataagtatgtcaaatactaaaatgttacctctgccttagggtcttggaaatatgcaatatgattaatactatttttctataatttcaatttttttaaagggcatatttgtgattaataaaagaaaaatgttgcattttgctaagattcttccatttgtttcagaaatataaaacactctgaaacctgctgagttgggtttgaattctactaaccttgggcattactttcaggttagcagaattagacacaatataactggaaccaaagttcaggggttccattgggggcgaagtctgcaggcgcacaccatggaagcgatcttcctcatcatctatcgcctaaggaagaaggggcagaaacattagagagcacaaaaaatagtaaagcaagtagtggcataaaaagttatttatatggtatattaagtagcacgtaggctatgattcaattgatataaagattaaggtattcaactgatataaagattgtgataggtagatacacagatatgaatgaatatgtctctatgcacaaagagacatattgatgaaattttactgaaagatatctcagggccaaaggatttcttgtgaatgtgaacttataaattcttgtatagtttgcttttatttttacactgtggaaagattggctgcgtacttatgaaagcacaggacagaaggacttctttttggtgcctcagcagagaactggtagctcagctgtgtctgtgaacacgtctatgatggacaagggtagagatgttacttctctccgtcacagggctgctgtgagatgctcaatcacctgaccaccagcgagcagaaacagtcacctctgcgaggcccagcagccacagcagaaagcgagacctcaaaactatctctaagcagccaggcacggtggttcacacctgtaatcctagcgctttgggaggccgaggtgggcagatcacaaggtcaggagtttgagaccagcgtggccagcatggcgaaaccccgtctctactaaaaatataaaaattagccgggcgtggtggcgggcgcctgtaatcccagctactctggaggctgaggcaggagaatcacttgaacccaggaggcagagattgcagtgagccgagattgcgccactgcattccagcctgggcgacagagcgagactctgtctcaccaaaaaaaaaaaaaatctatctgagcagccatcaaagacacagaatggaattcaaacaaaacctttctacctttgggaagtctcaggtacaactcaatagagactttgtagaattaatgagcaaggaatttatgctaaaaacaatgactgtcagtgatattattagtccagctgatcgactcccttgcaggataatgaccaagagggacacaaggggactttggggaagctggtgatgtcttgttgcctgttctaggtgctgcatatgtgagtgtgtcaactatgaaaattatgaagcaataaattatgtacatatttcattaaaagtagaggccaggtgcagtggcttatgcctgtaatcccagcactttgggaggccgaggcaggcagatcacctgaggtcaggagttcgagaccagactggacaacatggtgaaaccccatgtctactaaaaatacaaaaattagctgggcgtggtggtgagtgcctataataccagctactcgggaggctgaggcaggagaatcgcatgaacctgggaggcagagtttgcagtgagtcgggatcgcaccactgtactccagcctgagcgacagagcaagactctgtctcaaaaaaaaaaaaagaaataaagaaatgtcagcagatctctatgaagaaaaggatggcccatggagaaaacctgaattgggcctgggaaatcaaataaaagaaaaatttcatattgtattgagcaaagagatgaaactatgatgggggtaaggcagagaagggatgtggagaactatccaggaggcatcacatatatgtttagaaaaagaaccagtttccgaagggtcaaaagaaactgatgggggaaagaaataacatatcataccatctctgatgaacaattcttttacatgaacagatatgtttaaattaaattatagtaataacagattagaactaaatcaccaaataaatccatatcacattgctagggttatgattacggacagatttctgtaggtgttgagagacataccactggattaattttcttaaccttctttatttgttatagttcttatcatatgcacatatatttttcctatagcattccatgtaatatctttggttgtcatgtttttgcctcttttgttcactgatgtatcctcagcctctaaaatagtgtctggaatatataaggcacacaacaaatatttattggatgaataaatgggtttccctggaacagtactgttgaatagaaatgtactgcaacccccaaatgcaatttttttttgagatggagtctcgctctgtcacccaggctggagtatagtggtgtgatctcagctcactgcaacctctgcctcccaggttcaagcgattctcctgcctcagcctcctgagtagctgggattacaggcgcatgccagcacgcccggctaatttttgtatttttagtagagacggagtttcaccatgttggtcaggctggtctcgaactcctgacctcaagatccgcccacctcggcctcccaaagtgctgggattacaggcgtgaccaaatgcaatttttaatttcatagcagccacattttttaaaaacagcaaagagaggcagatgaaatggcttttagtaatgtatttcatttaactcacaatatcatttaggcatgtaaccaacacaaaaaataattgctatttatgtgcttcccttcatattgtcttccaaatctgtgtatgtgtattaatatgtgtattaaaacttaaatacttaagttttagagtacatctcaactcacatactcaatagccacatgctattgccggccattcaagcctatagctggccagtggttatagagttgaactgtgctgctcttgaaatagggcagggaagttctcagtgcaacaatagatatttagagtttgattatggtttgaagtgaagaagaggtttctcctctcttcttcccttatcctaccctgaatagggaagaagcagacagaccacttttcattcaatgggtcaacaaaatttcaagaggtacctacaacaggcctcaccttgtgctttttttttttttttttgagatggagtctcgctctgtcgcccaggctggagtgcagtggtgcgatctcggctcactgaagctccacctcccaggttcagccattctcccacctcagcctcccgagtagctgggactacaggcacctgccaccgtgcccggctaattgtttgtattgttagtagagacggggtttcaccgtgttagccaggatggtctcgatctcctgccctcgtgatccgcccacctcggcctcccaaagtcctgggattacaggtgtgagccaccgcacccggccctccttgtgcttttaactaatttatgattaaacagaaatggtcctgcccatgatatagagtacacaatttacagagaagcagatcataaataaatagacatgtgaccacaacagagggaaagaagagggtacagtgatcaagaacaatgggagaactggagggcacggtggctcacacctgtaatctcagcactttgggaggctgaggtgggcagatcatttgaggtcaggagtttgagaccagcctggccaacatggtgaaaccccatttctactaaaaatacaagaattagtggggtgtggtggcgcatgcctgtagtctcagctactcgggacgctgaggcaggagaatcgcttgaacccggtaggcagaggttgcagtgagctgcgactgtggcactgcactccagcctgggcgacagggcaagaccccttctcaaaaataaataaataaagggagggatggaccagactagagggcctactaaaggctttcggaagcagaaatctttaggcaaagactagaaagagactagaaagatgagcaggagccagtcttgcaagggaaacacaaagggtaagagcccagaagcaggaattcttggagtatttgagggatgaaaattcaggacagaagtgctggaacataatgagtgagaagagagtgataggagatggataactgagatgttctagggtcacaagaagtcatggcttcagctgggcacagtggctcacacctgtaatctcagcactttgggaggctgaggcgggtggatcacctgaggtcaggagttcaagaccagcctgaccaatatggtgaaaccgtgtctctactaaaaatacgaaaattagccgggcatggtggcgtgcgcctatagtcccagctactcaggaggctgagacaggagaattgtttgaacctgggagacggaggttgcagtgagctgagatcacgcccactgcactccagcctgggggacacagcaagactccgtctcaaaaaaaaaaaaaaaaaaagccatggcctctaggccatagtaaattatttgattcatgttctaagtgtaacgtgaatccattaaagaatctttggccaaagtgtgatgtagtaatgtattttttaagtgtattagaattaaaaaattttaattttttttctttccaacatttattttatttattgatttatttaagacagagtttcgttctgttgcctggagtgcagtggcaaaatcttggctcactgcaacctctgcctcctgggttcaagcaattctcatgcctccacctcccaagtagctgggattacaggcatgtgccatcacatccagctaattttttgtatttttagtacagatggggtttcaccatattggccaggctggtctcgaactcctggcctcaagtgatctgcttgcctcggcctcccaaagtgctgagattataggcatgagccaccatgcccagccccatcatttattttaggttcaagaagtacatgtgcagatttgttgtatgggccaattgcatgtaatgggggtattacttattttgcaaaaaatctccctgttcctagattttaaaaataggtggtaaatgaaaaacaatggaaccagtgagataagcttgaagactttatccatatttctagcaaaaatggcagtggatggcactaaagctggcagtgaagctgaacggagtaaaactggttcaagttatgctatgaaaatgaaaagaatcaaaattgatgagatgctggatgtgggaaagaaaagaaatcgaggccgaggggggcagatcacttgaggtcaagagttcaagaccagcctggcaaacacggtgaaccctgtctctactaaaaaataaatacataaataaaataaaaaaatacaaatagctgggcgtggtggcagacaccataatcccggtgaggcatgagaatcacttcacttgaacctgggaggcagaggttgcagtgagctgagattgcaccactgcactccagcctggtgacacagcaagactccgtctcaaaaaaaaaaaaaaagaaagaaaagaaaataagtggaggaattaaagatgaacactagagtatggcttgaatgactcaatgaaatttagtctctaccctgaatggggaagagagttgaataaatcgcttaaagggagaaagttgagtcaatatatacaattagatatgccaaataaacactcatatggagaggggaggttggcggttccaagttggagctctggagaatgttcaggactggagatatagactgagaaatcctctgcttgtggggaattcagttacgagacgaagaattcatcaagtccgtcagtgaagacagaaaagagaaaggagagtccaagattcagccctggaaactcaatattcagagaaggtttcagagcaagaacctgcagaggcgatttgaggagagactcagaaaagtcacggagatgccaggagcagtggtccatgcttgtaatcccaacactttgggaggccaaggcgggcagatcacaaggtcaggagttcaagaccagcctgtccaacactgtgaaaccccatctctattaaaaatacaagaattagccaggtgtggtggtgtgtgcctgtaatcccaactactcaggagactgaggcaggagaatcacttgaacccaggaagcagaggttgcagtgggccgagatcacaccactgcactccagcctgggtgagagggctagactccatcacaaaaaaaaaaaaaaggaaagaaaagaaaagtcacagggaaattgggataatatggtgtcgcaggatcatatagagcagagatccccaacacccgggccgcagaccagtaccagtgtgtgagctgttaggaatcgggctgcacagcaggagaggagcagtgagggagcaaaccttcatctgtatttacagccactccccatcactcacattaccgcctgagctcctcctgtcagatcagcagtggcatcagattctcatacgagcgtgaaccctgctgtgaactgcccatgcaagggatctaggttgcacgccctttatgagaatctaatgcctgatgatctgtaagtgtctcccattacccccagatggaaccatctagctgcagaaaaagaagctcagggctcccactgattttacattatggtgagttgtgtaattatttcatcatatattacaatgtaataataatcgaaataaagtgcacaataactttaatgtgcttgaatcatcccaaaaccattcaccaccctggtctgtggaaaaatggtcttctgcaaaactacttcctggtgcctaaaaggttgggaactgctgttatagaagagtgtttccaaggaagagcgtggtcagtggaatagcattccactgagaccccaggtaagaatgagttgacacaaagtcactgactgggtgacgctaaacagagccattctaaggaagggtggcaaggtcatccacacagagagatctgggaacagagtgagaactgaggaatatggagacttcgggtacatggagctgttgatccattcattgagaagcataagggaaaaattggaagtatgactgcaggagggagagcagtcaaggacagcatttccaatgtgggggccattctagattttggcgggtggaagggagtgatgccctagggtaggagagattgacggtggaggggaaagaggatgcctcgggtgtggctcccacataagggaagagggaaagggacccaagactcatgttaagtagtgtccttgtgtacgaagagggaggcggccgggcgcggtggctcatgcctgtaatcccagaacttcgggaggctgaggtgggtgcatcactttaggtcaggagttcaaggctagcctggccaacatggtgaaacctcacctctactgaaaatacaaaaattaccaggacgtggtggcacacatccgtaatcccagctactcgggaggctgaggcaggagaatcgcttgaacccgggaggcggaggtttcagtgagccgcaattgccactgcattctagcctgggcaacagaacaagactctgtctcaaaaaagaaaaaaagaaaagaaaagaaaaagaacaaggaggcttcttgggtttcagaggaaagaaataggtgaagacgggccagaaacaggctcacagagctgacagtgaaacaatgaggtttttccatcccattttgtttctagtatatcaataaggtatgaagcaagtaagcatatgagatttgggaatgatgaaagaagaggcactaagtgaaggataggaaaagggtgggctcagaatgaaaacagaagttatgcaagaattcactggaatgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtgggaatatgagcctttaataagtgcattagagggagatgctactgaacaggaggagggttactccagagatgtgagtgtgcctgtcagtgtaattcacatattatccatttaaaatttggtgagaggccaggggtggtggctcacgcctgtaatcccaacacttcgggaggccaaggcaggtggatcacctgaggtcaggagttcaaaaccagcctggccaacatggtgaaaccccgtctctactacaaatacaaaaattagccaggcatagtggcgggcacctgcaatcccagctactcaagaggctgaggcaggagaatcgcttgaacccgagaagtggatgttgcagtgagccaagattgcgccagttcactccagcctgggtgacagagtaagactctgtctctaaaaaaagaaaaaaacaacctggtgaaaaaatctctgcatcttctctgtcagctggtcccccaaaatcactaactttctccttcttgagagccagaaaagggaatttcctttttcagtagcactgaatcactactgaagatggttagggaagcacatagctccagagtcagcaccttggatgaacctcaggaagggtgactcctgcttctgtccatgaaaaccatgccttgccctttctgttccacgaggaactggaggggccaaggggataacctggaaatataatcgtcatcttctctggtctcctaaatcactcagcttacctttgttagcaaggcgtcgctggggacaaggtacaagtggaacttaatatcttcggggtgggggtgataatagatcaatgtgttggaagtgatggggatggagaggcgagtcccactggcgatccgcagcaggatgcccatcagagagaagctggggctttccaggacagcatagaaaggctccacccgggctggatgctccaggaccatcccttcattcttaaaatgggcaacgagaaaccaggagacgtccacctcacctgctgcaggagaaccacaacagcagtgagacggcacgcaccccagcggcccccacagcctccgctcaccccacattaccttggagggagatgaagtgggggaggtggatttcggcgacagcctcctctggctctgcagtgacatcaaacaaggggccgcccaccagccactgttcatggtgctgcaggtccagggccaggtgctgactccaggaaccaaacgcaatcgtcactgtgacctcatcccttaccaggaagccgaggcctgtggctgaccacagataccagccagcagtggggaaccaaacgctgaaaggagccagagtgatgtcatgacgggagaaccccaggacttggatttaagcagcgatgtgcagagggaggtgggatttgaagtgaggcaaggttcaggacccatctgcgactttcactacattagaaaacgctggggagttcattaacctctctgggccccaatttctctgcattctatatatgttgaaattaaaataccaacttcacagtgcatgaaataaacatattattgatgaaattttagctatcataagggatggaaccgatacgcttccttttgtatttatatttttatttatttatttattttgagacaaagtctcgctctgtctcctaggctgcagtgcagtggcgagatctcatctcactgcaacctctgccccctgggttcaagagattctcctttctcagcctcctgattagctgggactacacgcgggtgccaccacgcctgactaatttttgtatttttagtagagacagggtttcgtcatgttggccaggctggtctcgaactcctgaccttgtgatccgccctcctccacctcccaaagtgccgagattacaggcctgagccaccacgcctggcctacacacttcctttatatcagagtggttttcaaatcatcagcatcttccattcttacctgtatctgtttgtgctcttatcaatcaactcaacatccacatttccttcaggccccagaaactgacgatttttataatcttcttcgatctcaaaacagactttagaagcataagaggaaactatttgattctcttctgagcaaatgtctcctgaaaagaaaatactagacatgtaagaggtaaagggttggaagaggcatggcctgaaggactcctggaggctgaattgcacaggtgctgttgggatacagatatcgaatgagagctgagagtgaccagaatatgcagtttcgcttctttgaatccagacaaagaaaggcacaagaatgttccttgtcatgactaaacgtatacaccaaattccataagactttctgggaagccaggctggacagctttggtgggaggcaccatttgctgaggactggaaccaatgcacctacatttctactggtccgaaatagcagaagacactttctgctggtgaggaaagtccaggtcagaaaagtatcgaactccaaagatgcagaggcgaaagagcgtgcatccttcctaggccctgctgctgtccccagccaccaggaccacccactgactcccctgagcatttccatgccccagcagtgacaggcttacatgtccccatttaaactgcacagtgcactgtggcaaaggtaagggaaagcactcctgatctgcacaaaagactctaaattgtcttcttcacataaaatcacagaacatttccatcaatccacacgcccttcactcctctccctattagcccattacctgaatcttgtccctctgaagattcctgctcttctgatacactggaggttgggatccccatgttacaaaaagatgaaaaacatcaagaatcagttgatgaagatgaagacgatgttattgaaaactagagctgcactgtcccgtagagtagccgctacccggatatgctatttaaatttgtatgaattaaacttaggtaaactttagtttctcagttgcactatccatatttcaagtgctcaacagctacatatcactcacggctataacactgtgtagcagagaatggaacactcccgtcatcacagaaagttctcttagactgggcggatctagactatcaagaaatagaagacattttgaatgaagatatttttatccacatttataaataatagagataacacactcccttgagccaaatgtgtcttgacatctctccttcttctctttgtattatgcccacgttcaatgtggacacagccagattctctggcttaaattgattgctccgattggtatcatacgatgtcggaatcaaagactgaagcagtaattcaccaatgcgtaaaatgtatgcatttatattccaaggtaattccaaacttgaccacacctgggaagctttaaaaaccacccaataccaggtcacagcccacatcaattgaatcagaagtctggaggtggcaccaaagcatcggcgctttcaaagcctcacaggtgattccaatattagccaatatgggttctatgacatacagcgtgagccaatggttcgtcatgcctctggagagaaacctgccctaacacaggtgataccttctggagcaaggcaaccaactccatcaaattctctgcctttgatccattccttgagatatctgtttatttcgacgtgaaagagaccagcagagaaactgacacgtggattaggtttaaaaagaacaggtacctagagaagtgggatgaagagaaaggctttacagcgcttttctcggaaggattctgtgggcaagccaagcatggagagacccctgggctgacatcctaagactggttgctgtctgcggctacacattttgctatggattcgggtagctacaggcaaagcagcaagagtaaacatgccattttatattctctttcctggtgcatgtgcatgctggagtctgcctgctgaggaggggtttagaaagtgggaggaacccagcgctgaactgcagacagcgcatcccagatcatgagagctgacggttccattttcagggcttttgcaaccaagttgttcaacacaaccattagtctaaattaaatgatacaagctaacatttaaataaatcatattaaaaacaaaagtaatacatattaaaacataccaatttccagtcatttttctacacttttcagcagtctatgcccttgaggttatttatgtctcttgtatctgtgtggtgaaagcaggatgacagacttctgcatgtgttctttcaactccctcatcaggggcttcacgttggtagtttgaaatctgccatgatggggatattcaacccttggaaattggcataccctacaaatagacgcattctcccctccccggtgttaaacctcaggaccccactgtggccttcagcctcatcatcagccagtttcctagagaattaggttggttttatgtattgagtaacagcttaaccaataacccactggtcttcgattgcattgctcattgcctttttgtgtataggttctctagacacctccatggaagaaaacctcattgcttaaggtttgtttcaaaaatttctggattcattgctagtattgcataagctcattcattctcccctgagttcgatgaaaaacacccaaattcctctaattctcatgttcctctgtgatattgagacacagcgtccaatagttttccaacggaatagcttttcttacctgggaatgtcccccccagatagttgacactcaggaacagcacggaacaataatggctctgcctctgtctcatcatcttcttggaaaaaatgtgagatgtcacaaagggtctcagaaacacagggtagctccctgtataccctggaaaacaacaacagaatttttactatgaatataaggtaggtgcctgatgatagcataggctgtgcaggaagattttatgttaatagccatagactcaatattttatcttagggaagtcattcctcaggcccctacgactccatctcacctctcagactcccatgactctttcttacatctcattatgttaaatttaactggctctctgtttcccactatatgctgctctttccatcctaggaagcagacgtcagtcagttctcaacatctagcatttgccacaaacattggtttcataataggtcaacaagtatgttgacctatataaccttgctaagaattttagggaaaggatgagattcctaatttgtagtctcccttcatccataattggtgcccgagagaataggaccctaaaatgattgggattgcagggcattagtgagattgggcatgttttataagaacccatggaacagttatctcctcttctcccttctgcctgcaaatggtgagaggggttgcataaagcaacaaaaatgctcacagaaaaagaaaattatggatattgtacacactttcttttcccatcaaggatccttattcagatatggaacatgagagtcctatgctagatccttttctcttcttcatttttgaaggcttggtgctgtcctcctatggctggcaggaatcaagattgaggttaggagtgatggagtgtcctttatgccaagatattcaatggccaatatgacagccactagccacacctgcctatttacatttagttttaaattgttaaatgtgaaaatcagttcctcctttgaagtagccatatttcaagtgctcaaaagccacacgtggctcttgcctgccaccatgtaagacatgcctttgctcctcctttgacttctgccatgatggtgaggcctccccagccacgtgaaactaaaagaatttttctgggtaatggacataggcataggacgtctggcaacaaaatctgctttgaagaggactccagggaatagagatgaggtctcaggctggtcttgaattcccggccccaagaaatccttccaccttggcatcccaaagcactgggattacagtcatgagccaccgcacccagcctgagcattactgtttgatagatattcccaaatcactctccacaaaaggttacaacagtgaacacttccatcagctgaatatctgtgaaagcaattgttgagagattttgaagtaagttcaaaaccaaactgtagaaaaaaatcattgacaaaaaaggaaagcaaaaaaaaagaaagaaaataactgaggaattattactgaagacaacttttgtctaaaaaaaaaaaagaacatttgtttgcaatgtaaaatcgggtttcagctggaaaattaagcctgttaaaaacatcaacaacaagagcaaaaatcctgaatattttttcagcaattctgattaaagtatgtatgttaaaaaaagaaaaagccatgtgaggccagtggctttcacactggacaccacagacagggaacatttccatcctgggtgagaactctattggacagcattgactttagaacctctgctgtagtccagttgaccagagggtcctgccttgggctatctgccattggtttcatttctatttttatttttattttttaaattgagacagagtctggctctgttgcccaggctggagtgcagtggcatgatcttggctcactgcaacctctgcctcccgggttcaagctattctcctgcctcagcgtccccaatagctgggattacaggcatgcaccagcacacccggttaattttttatatttttggtagagacagggtttcatcatgttggccaggctggtctccaactcctgacctcaagtgaaccacccgccctggcctcccaaagtcctgggattacacctgtgagccaccgcacccagtctgggataggttttattaaacaaagtagttctttaagctctaccatccatggtccccggcgtgcagcactgcttttaaaatatcccatgttaaatgggtgcatggaccaagcaagactgaggaattcctgtcctcattagcagtgcttttcagcctgtgaaatatcaccctgaaataaaatctatacctgagttaacagtactgtatcaacatcagtttcctggtattagcaatgactgtttgtattgggtcattctggtttttttgttttttgtttttttgatggagttttgctcttgttgcccaggctagagtgcaatggcgtgatcttggctcactgcaacctctgcctcccgagttcaagcaattatcctgcctcaagcctcctgagtagctgggattacaggcatgcgccaccaagcccggctaattctgtatttttagtagagatgggggttcctccatgttggtcaggctggtttcaaactcccgacatcaggtggtccgcccctctcagcctcccaaagtgctgggattacaggagtgagacaccgcgcctggcctgtattgggtcattcttgcattgctatagaggactgtctgagactaggcaatttacaaagaaaagaggtttaattggctcatggtgctgcaggatgtacatcatgggaccagcttctgcttggtttctgggaggcctcagggacgtttaactcatggtggaaggtgaagtggaacaggcctgtcatatgatgtcagcaggagcaagacagtgaagggggaggtgccacacacttttaaagaaccagatcttgcatgaactcagagtaagaagccacttatcaccaaaggaatggtgctaaaccatttatgagggatatgcccccttgatccattcacctccctccaggccccacctccaacactccatcacatttcagcatgagatttggaagggacaaacatccaaatcatatcgctattgttacaggaagtattatcggctgggtgcagcgactcacgcctgtaatcccagcactttgggaggctgaggcaggaggatcacttgaggtcaggagtttgagaccagcctggccaacatggtgaaaccccgtatctactaaaaatacaaaaattagccaggtgtggtagtgggcacctgtaattccagctacttgggaggctgaggcaaaagaatcgcttgaaccccagaagcagaggttgtagtgagccaagatcgtgccactgcactccagcctgggcaacagagcaagacttcgtctcaaaaaaaaaagaaaaaaagtattatcgtgaggggaaacttggtgaaggctacatgggaactctgcccttctctcccaactactttatcattaatattgttattattttttttgagacaaagcctcactctgtctcccaggctggagtgcagttgcacgatctcggctcactgcaacctccgcctcccaggtttgagcaattctcctgcctcagcctcctgagtagctgggattacaggtgtgggccactatgcccagctgatttttgtatttttagtagagatggggtttcaccatgtaggccaggctggtctcaaacttttgacctcaggcgatccacctgccctcgcctcccagtgtgctgagattacaggtgtgagccactgggctcagaccttttttccctacttcttatgagatacaaactcttttgaaataaaaacttaagataacaaagaagaaaagtaacatatatactaatttttatgcaaataacctgcatgtctttgcttcttatgaatgtacataaaccaatggagcaaaattccaaatctttaattttttcccaacaaatagatgtcccttacgtatcatttgtcacacaggcctcagcctgaaaaaaaattccagtttttgtgtattgcagttcccgtatgctattgtcaaccaacagtttccgtgatccttgtagtctaatgagtttggatgcatctatgttcctactggatccactgtccctgggaaaacacaaatggaattggaatgtgagcatgtcagaggagctcgatggtgggacaatctcctcactgtgatgtagcgaaagtagcccgatccttagagatatccatccttagacatgcccatccatagagatgccatccttagagatatccatccttagacatgcccatccatagagatgccatccttagagacatccatccttagacatgcccatccatagagatgccatccttagagatactatccttagagatgccatcctcagagatgtcttagagatgcccattcttagagacaccttcttcgatgcccatgctagaataaaataccattcctccacatttttattgaactaactgcattgctgttaccacttcgtagacaatgatcttatctcaggaggcatgcctcctttgattctcaatccctgatgttcatcacggtctgtcacacttggtgatgctcgctactggcttctgaaaggatactgtgtttttgtaaactataggagcataacaagggccccactcttctatccttcgttggtcctaaacaggagggaatgttaaccagatgaagttgtttgcacaacactgaatggactgagcttatttgaaggtaggatctctttatttagtgtgagcgtgtcagggatgatggacactagagtgatctgcattcactgcctttcacagacatcactcagcagtgacagacctgtcaaagttgttgcttaacctctctgagtatcagctttctaatttgtaaaataaggatacagtactctcgtcacaaatccttgtggtgattaatcatagaaggctaaaattacttagcgcaagagttggaaacactgggttcccaaagcaaacaattcgtcctagtccgtggtcttttatgcatgccagatcatctgtctcagtcatttcagacttttttttttttttttttttgagacagagtttcactgttgtcgcccaggctggagtgcaatggagcgatcttggctcactgcaacctccacctcccaggttcaagcgattctcgtgcctcagcctcccgagtagctgggattacaagtgcccgccaccatgcccagctaatttttatatttgtagtagagatggggtttcaccatgttggccagactggtctcgaactcctgacatcaggtgatctgcccgcctccgcctcccaaagtgctcggattacaggcgtgagtcaccatgcctggccaaggttgctatttttaaaacctatggactgagaagcttgtgaacaatataaatgtatttgtcacagctctggatgctggaaagcccaggatcaaggtgctggtagatcagtgtctgctcctgattcatagagggcagacttcttgttctgtccaagcatggggaaagagaaaggagctctccagggttccttcatgagggaactaattccattcatgagggcgctacctttatcacctgacacctctcaaaggccccatctcctaacaacatcacattggaagttaggatttcaacatattaatattggaagaacacaaacattcattctgcagcagtgtctgaattgcatacatgaaatatttggtcagattaatttgttttgagttccaagacaatgtaaaacagtgcattcattttctacaaatgagacataaacctggtgctgatgaggagccactgaaacacacagagggagggcttagtgagtcaggctgcttggttctgctctgatctgggcgccatgctatgggattgtcaagagcgtggtcaaggccataggcccatgcatcaaggaaagagctggaagaacagccctagactcgcttttgctcaggtatgaagttgccatggtcagaatcaaggaaggagagagaaggtctaaaaaggtcagaaacagggaaggagagagaaggtctaaaaagtacacctgggccaggcgcagtggctcactcctgtaatcccagcactttgggaggccgaggtgggtggatcacctgaggtcaggaggtccagaccagcctggtcaacatgatgaaaccccgtctctactaaaaatacaaaaagtagccaggcgtggtggtgcatgcctgtaatcccagctacttgggaggctgaggcagaagaatcgcttgaacccaggaggcagaggttgtagtgagctgagatggtaccagcgcactctggcctgggcaacaaaacaagactctgtgtcaaaaaaaaaaaaaaagtacacctgggtgcccatgggagttttcccttcattcatgcagagatgggtgaatgaataaaatgtgagcagaacctttcttccagaaaacatccatggtcctctgtatctcatgaactataacgaaacacagaagaatcagccatcaggagccctcacagagcgcaaagtcactcaccgtctcggcagctcttcctcactgctgctactcttttctggacactcctttttttccatttgtcaaatgtggtatttatgtctttactgtatcttttttacc

SEQ ID NO: 1558 - DNA, 32978 bp, Homo sapiens; identical to SEQ ID NO: 1557

SEQ ID NO: 1559 - DNA, 1586 bp, Homo sapiens
gtgatctctcagcagaatagatttattatttgtattgcttgcagaataaagcctatccttgaaagctctgaatcatgggcagtgagctcagtggtatctggaggacagggcactggccactgcagtcaccatcttctgccaggaagcctgcacctcaggggtgaattctttgccgaaatggattgccaaaacggtcaccagcacatttcccaggagctgttgagatgaaaggagacaataaagatgaacccatagtgagctgagagctccagcctggcctccagataactacacaccaagcttccacccagaatcaagcctatgttaacttccctcaaagcctgagattttgccttcccattaaatgcaggtagttgttccccttcaagcactagtcactggccataatttaaatcttgctatcttcttgccaccatgaaccctgtatgttgtaggctgaagacgttaaaagaaacacacgctgacacacacacacacacgcgcgcgcgcacacacacacacacacacagagctgactttcaaaatctactccagcccaaatgtttcaattgttcctcacccctggacatactttgcccccatctggaattaaaggatataagtttgtaatgaagcattagcagcattttatatgtgtccagctgatataggaatagccttagcaatgtatgtttggccaccaaagttccccactttgactgagccaatatatgccttctgcctgcatctttttaacgaccatacttgtcctgcctccagatagatgttttaaaacaacaaaaatgagggaaagatgaaagttctttctactggaatctaataaagaaaagtcattttcctcatttccacctctcttttctcaaagtcaaaattgtccatctagatttttagaggcactccttaggccctaaaacattaccactgggtctcagcccagttagtcctctgcagtttcttcacccccaaccccagtatcttcaaacagctcacaccctgctgtgctcagatcaatactccgttgtctaagttgcctcgagactaaaggcaacagggctgaaacatctcctggactcaccttgaagttctcaggatccacatgcagcttgtcacagtgcagttcactcagctgggcaaaggtgcccttgagatcatccaggtgctttgtggcatctcccaaggaagtcagcaccttcttgccatgtgccttgactttggggttgcccatgatggcagaggcagaggacaggttgccaaagctgtcaaagaacctctgggtccatgggtagacaaccaggagcctgtgagattgacaagaacagtttgacagtcagaaggtgccacaaatcctgagaagcgacctggacttttgccaggcacagggtccttccttccctcccttgtcctggtcaccagagcctaccttcccagggtttctcctccagcatcttccacattcaccttgccccacaggcttgtgatagtagccttgtcctcctctgtgaaatgacccatggcgtctggactaggagcttattgataacctcagacgttccagaagcgagtgt

SEQ ID NO: 1560 - DNA, 57069 bp, Homo sapiens
gccgccgccgccgccgccgccgcgccgcggcttgagggcgggaggctgggggagggtagcggagccggcgccgccgccatgttgggtctgaagcggctgctgtaggcgccgacggagcgagcgggcgtgcggagcgggcgacagtggcgtgggatctgcctctctgcgagcagctgggagcggcggcggcggcgccatgagcgggggcaccccttacatcggcagcaagatcagcctcatctccaaggcggagatccgctacgagggcatcctctacaccatcgacaccgaaaactccaccgtagcccttgccaaaggtacgcgggaccgggcctcagggtgggggccgagccgggcgccgctcggggctgctccccgctccggcccgcggcctcctcgttccctcccctccctccgtcgagctccgggaggcctctcgcctcccttctccgggccccggcgtcgcgggccggaccgcggcctccccgcggctccctggtttccgccccccggaatgtccgcgcctgaagcccggggaactacgggactgagtgcgcggcgggcggccctgaagtccgagaacgggccggagaacacggagaaacgcgtcttccaactccgaaattcggggcttctgccgtcttagcacaaaacaaagccggagtattcaaagaatttttccgcccagcttgagttcatcgcggatgcgttgactacacagcacccattttctcactttgttcatttcaattcgtggcgatcttcctctggtgaactcttgagtaatgtgctaaaactttgggtttgctctgcgacgcagacattctcgaaatgccatcgatgccgtggagcagatcccatctccctcggctcatcctctgttggtatttacctgttaaaccggaatcctcaaagcctgttgtgcaaccacctcattagggcgcgtggtaaaaatgcttgctgctgccccgacgcccctgtttctggaaacgggttcaagcttgatccaggatccttcttgaccaggcaagcttgacctttgatccaggctcagtgggcgttgactgatccctctggaggctctctgggaaagggaattcggccgagaaggaaggtgcccctacccacagtgttaatatttggcatccctagagtctgtgtgggttttgtttccgttcacacgtgcagggcctttgctccgccaggaaaccagaaagaaaataaactttagctcctgaatcttaaaggaaatctcacaacagtgtaaaatactttgagggaagctagataacctaggtgattttcccagcacttctggtagaggtgggaactgcatagcatggttagggaccctgtggataggttaggtccaaggataaagaagaagattttcgaaatctgtaaaattttaaaaatcgttaacagataggggagtggtttcacgggatcaagtatttaataatatttcttggatgctctggtaaatcctttatttatttatttatttatttatttttctaagatggagtttagctctttttgctcaggctggagtgcaaaggcaatgatttcggctcactgcaacgtccgcctcccgggttcaagtgattctcctgcctcagcctcccaagtagctgggattataggcgcctgccaccacccctagctaatttggtatttttagtagagacggggtttcaccatgttggccaggctggtctcgaactcctgacctcaggtgatccacccgcctcggccacccaaagtgctgggattacaggcatgagccaccgcgcccagcctctggtaaatctttttaatagccctggtgttgggacaaatcttatacctgggtagggaaccttttgatgttacagaactgtacaccataaaggagtagtatgagatggtgatagttgcacaactctgcaaatttgctgaagatcattgaattatacactttttaaaatcaccaagtctaattttaaaagtagtatgaaaaaccagggagtacccccacatttccctcttcaccttgtgaaacattatgcagtgacacattacctcattaaaacacctgtagacttggcggttagaaatcggctataggatgtatgatggatggtatttggtgtttattaaagactttcccagtgatgcttcttaagtaacttagtttttgcttggccttattttgaatttatttttatattttttatacaatagttacttagctgtatagtgtttttctggctttttgaaattatgaaaaagcctctctttatgaaattatgaaaagtgctgggtgagagccagatatgggttgaaaataatttctcattaaagtggtttaataaatttgttttaaagtattgctttacctaatctgaatttaaaagtgtcttgccagcttagtgactcaataagttggctgtgttacctttattcctcacaaagaaaaaaaatacatttgaaaattttaaagtatttttgttcttttttaaaaactacgaacatatccttttatgcaggaaccccaaaagtctacattttaacaacccacattttaaaaaacttttcagcagcttttagagtcagtatttcattagtctgtaatagttaaattcatatgacataatgacataaaatataaatttgttctttgtgtcatgacttgataaatatatgaatatagcagtgaaaaatttttttaatcattgaatttatgtttgtactcatggctttgatatttcatcccacatcattatatgctttttctttttcttttttttttttctttttgagatggcgtctcactctgttgcccaggccggagtgcagtggcacaatcctggctccctgtaacctctgccttccaagttcaagcaattctcctgcctcagcctcctgagtagctgggattactggcgcgtgccaccacgcttggctaatttttgtattttttagttgagacaggctttcaccatattggccaggctggtcttgaactcctgacctcaagtgatccacctgcctcagcctcccagaatgccgggattacaggcatgagccaccgcacccggctgctttttcttaagcaacatgagttaaatgtgtaaccagtttggggaatttgattatgttcgcaaaaactgacattatcaaacctttatatattagtctacatgatattatctaatcgaaaactacattataactgtctagtcaatactggacacatttcagatttcaagattagaagcaaggagttcaatcttaaaattttaaaatttacatgacttgttgagtaattcgatatcagaaaatttcaccttccatttcaaaatttgaacgaagaatggtagtctaaaagattaaagccaaaagtgtttgttttgttttgttttcgtttttttttgttgttgttttgagacagagtcttgctcttgcccaggctggagtgcagtggtgcgatcttggctcgctgcagcctccacctcccgggttcaagcagttctgccacagccttccgagtagctgggactacaggcgcccaacacagctggctaatttttgtattttgagtagagacggggtttcaccatgttggccaggctggtctcaaactcctgacctcagatgatccacccaccttggcctcccaaagtgctgggattacaggtgtgaggcactgcacccggcctgaagccaaaagtttattcatggaatttataatacagtgtgtatttggatgtagagatccctgttactgtttttaaactatggattaagagttaatctctttgagtaacagtcttagcattctcttttgaacttttttttttttaatttctcagggagagtgttattgggaaacctaactacacaggctgaaaagatacataagataaaaatgaaatatttttaaacaaacatctttgtaaccaccacccagggcaagacagacattgccagcatcccagaagcctcccaccacctatattttcccatcacaactatcaccatcttaatttaagctagatataaatgttcttctgacatttatagttttaccatataagtttacatctctaaataatagagtttaattttgcccatttttaactttatgtaaataggattgtgttgtatatattttatttttagcttttattgtttcataatattccatcatgaatataacacaagtttattccttctgccattgttttggatattgcatttagattgtttgcagtttggggctattataaacaatgcttttatgaacatttctgtttaagtgcactggtgcatgtttatttcgttttcttgagattatatacttagaatttgaattgcaagaacatggggaatgttggtctttatcaggtaatgccaggtagtttttcaaagtagttgtttagtggtttttacttcatttattagtatgtaagagttcttgtttcatatcccttaccaacaaccgtacgtggtatcatatatttcaattctagccaatcctggtgggtatgtagttgtatttagttttaatcatttccctcattactaaatggggctgaccagcttttcatatctgggtgtttggatttcatttttcataaaatgcctttgaaatcttttccttttttaaatcgaaacacgtctttttctagagttctgtattctgaatatatctccattgttggatgtatatattgcaaacattttttccatttagtagtttctttaaattaacagaagttcttcattttaatgtaaacatgttcatcagttttttatggctagtgtttctttttttaaaacatcatagagatactttgattatctttaaacctttttgtgctttgctttttcacattgacgtttataatgcatctgaaattgattttgtgtacaatgtgagatattcagagctttatatttagtaagggattcacttggtttatattgtccatattataatttagggcttggatattataatttaaatatatctggaactataaactactcttgaaatttttggctatttacatttgatgtggtatataattagggtaaccatatggcctagtttgccctggtggaaagtccttgtttgtgcctgctctggcataattattaaaaacatcccggctgggcagggtgactcaggcctgtaatcccaacatttccaaaaggtcaaggccggggtattgcttgagcccaggagttcaaaaccagcctcggcaatacagggagactccatttctacaaaaaattttaaaaagtgcattagccaagcatggtggcatgcatgtctgtcgtcccagccacttgggaggctgaggcagggggattgcttgagcccaagaggagctgtgatcatgccactgcactccagcctgaaacatagaacaagaccttgtcttaaaaaataacaatgatagcctgtaatcccagcacttcaggaagctgaggcaggcgaatcacctgaagtcagaagctcgagaccagtctggccaacatggcgaaaccccgtctctactaaaaatacaaaaattatctgggcgtgctggtgcatgtctgtaatcccagctacttgagaggctgaggcaggagaattgcttgaacctgaaaggcggaggttagagtgagccaagatcacaccactgtactctagcctgggcaacagagcgagactctgtctcaaaaaaaaaaaaaacacaaaataataataataatctgttttctcttttgaaaatgtttcagtgtggataagttatcacaccacataatcaaaagcctaattgcagaggtgctgtgaaatggtcgatgtgccttattttctgctagagatgtcacagactagctttagttctagaaagtgaaacaggtaagtttgaggggctttgatcctcggaacctaagcatatgtcaagaagtcataaaggcaacctagaaaggctttgatgtcaatctgctatgtatgtttatagatgatctgtgttgcagtttgtttctgcagtttgttgcagtttgtagtctgtgtcacagctctgaatttattttcttctcagcactgatcatgacttacacttaatcttctttgcttatttgcatatgtgtttattgtctgtcttcaccttccccttcacctccagactctgagctcctggtatgaaaggttgtttagttagtgagtaaatggaaatgatttagcattttagcttattgttcttgtagaagtatcttgggtatacctccaaataatgcttttccatgttcacaattgcatttccctataaaattaaattatcctgcctcacattaagaaatcttgaagaatttcagtgagtagggatgcaagaggatgaaatctagtgacataattaacattattggggaggtaaactctttgtgactcaagctcaattataattttcatttaaagtttaaaggaagcctccattcagggtgtaggaagaaattacacagtggtgacatgtatgaatattttatggaatagttccagttgtgtttgcacctacgtctataagtgagtaggatgcctaaataggctaaaatgaatgaaattcttataaaaaataaattcttacatttagttagcttacctggataatcattcaaatggaaaccaggttgctactgcactgggaaaagagactttatgaagaacgattatataagccacttgcctttaaaataagttgttcttaaaatcaagagattggtggaagaatagaaaaacaagtaaattgttaacagatttctttaatcatctgctaagtctggctcattggcataatttatctacttcttgatgttagtcacatagtcataaactattaccttattggagagagtggaagagctttgtgtgatggataaaatacttgcggggtgctttatttgatttcttgcattacttggggatctaaatctagcaattcacaaaattactatctaaaatgacaaagatctagtgaaacttcaagccacagtttctttttgttgccctatttagtgatgttgccagtacttggagccttggaaacagtttattattgttacatagtccgcagaaatacttggtaattctgggagtctgaagtcaggtgccagaaactgttcattttctagtaggggtaagtaaggtaagccatgattttctaagtcggaagtaaagaaaacagcataaaactgaagaaaaaaaatagtagaaggaaggaagtaggaagaaaaaagaaatcttatctgtgcatgatacatagcaggagttttgtatttaactcagtgccacagtaataatagcagtaactacagatagtttaacttgaatttaattattccgtgctagaagatgcttgctatagaaacaatttgtctttctctcatgatgctataaaataatatattaattagctgttttaaaaactagataccattgaagtaaattttgttgttgttgttttgagacaagagtctcactctgttgcccaggctggagtgcagtggcacgatcacagccttgacctccctgggctcaggtaatcctcctgcctcagcctcccaagtagctgggaccacaggcacacaccaccacacccagctaattttctgttttttgtagatacagggttttgccatgctgcccaggtcggtctctaactcctgggctcaagtgatctgcctgccttggcctcccaaagtgctgggattacaggtgtgagccacagtgtctggcttgaagtaagttttttagtggacaaagtgtgagttggtctgtaaaataatttattcccaagggccttattctagttttgtagggttttttgtttgtttgtttttttctggaagaaaatgcgacccaaaatgccagttggaatacttagcagctttttggtcttggacaagttatttaaccttagctttaacttcttcatcttttcaatagggatggataataatgcccatctttcagagtcattctgataattaaatgaggtgatataaaagaagtaactagtttaatgttggtgcttaatagagaatagctgtcccatgttatttcccaccacgatctccctctctgtctaggtgctcagtctctctagtagcccaactcagtcagtcattcacacctactgtagtctactgtcatcttactgcctttcactgtcctctcattcccctcataactttacttccttctttatcctgcttcaactccatgagcaaccacgacagtcagtacacattccctcagcccccaccccattcccctcttgctgtcttatacaagaaatcacaaccctgattatatcaacacagatgtgctgaccagcctcactctaaatttatgttcgctagcctccgcagtcatggtcacttcctagcagtcacactatacttccataatccatttcacttttctacatggctattccattcattttcctcaagcctccaacacctcccccatattcactttcagccccttaaccgtgctttctatagcagttaactgagaaaagaacagcaaacgaaagataattttgataaacttacccctcacatacccagttacctgcatctgttccccagacttctatgtttttttctgatcaatatggataaactgttcttatttctgtctaagaccacccttccacttgtgcagcatttgtcccctcttggtgattcaagaacattgctccagcagttctctactctcctcagtttttccttccctaacgtatctttctgtctgcttacagataggcagttatttcttctaccttaagaacaaccaaaaaaccccactgtacttgaactgaatttcctcttttctaatgattaccccatttctatccttccctttatagcgaaaccccttgaagaagttgtctacaccactggtgttcattcatttttgagccctgtttactaaggtttttattcctacatatgaagttttcttatcaaaattaccaaagatttccatgttaccaaatccagtagttagttcttagtctcattctacttcaccagtcagcattacgtggtacagttagtctgttctctgtgaagcattttcttaacttgatcgtatgccatttttttcctcatatctcactggttacctctcaatctccttggctgattgaacctgtaagccgccaaatgttgggagagctccagggctcagttatctccccttttctctctgtctgttaacatttatttaatcatctgcattcttttgatgatctcatccatctagttcctggtttcaaatactacctgtatatcactgactcctatctctagcctgaatttctcctctgaactcctgacttgtatatccattgcctctttaacatctctacttgtagggaagtctgctagaatctcaattcagcatgctccaaacctgttcctccatcagccttccccatctaatcaaatgacagctctattctagttggtaagaccaaaacaccttggagccatccttaattcctctctctctgtctcacctcatgtgatccgaacctatcagctctgctttcaaactagatgcagaatttgacctctgaccacccctactaccctggtccattatctctcactagtctattcagagatactcagattcctgtttcttgtttccaatattgacctctcagttgattctttctcctcctcccaattttacttgagtgaatctttgtaattaaaaaataaaatatatgggaaatgtaggtgacaaattttcttagtgaacctatgttttcttgtgcttgactggttggttggctatgtatttccaaattaagagtcttttttctgtggaactttgaagttactgctttttgttcttctaatattctggggttgctgatgccagtctgactctcagtcacttttctctctggaagcttttatttagaattctctattcctggaattcacaaatgtgatcacactggtttgttgttgtttgtttgttttttggtttggtttgatttttcctctgagtgtttctctgtggaccttgtgaatctgaagagtcaactctcggccgggcgcggtggctcatgcctgtaatcctaacactttgggaggccaaggcgggcagatcacaaggtcaggagattgagaccatcctggctaacatggtgaaaccccgtctctactaaaaatacaaaaaaaaaaaaaaaagccaagtgtggtggcaggcacctgtagtcccagctcttagggaggctgaggcaggagaatggtgtgaacccgggaggcggagcttgcagtgagccaagattataccagtgcactccagcctaagcgacagtgagactccatctcaaaaaaaaaaaaaaagagtcaactctctttaaatctaagaaatccattcattctctctacctctgacacgccctccctcccctctccccctcctctttctagctccatctcagataatttctatcttgcctcctgctccccagccttgttattgttgtttttaattcctcatggatgcgtttatcctccaccctgctttttcactcttatatcatattttcatatctgtctcttggttttatcatttggagattaaaatataaaaacagccataaggaagaatgcccaactgaaagcagcttagagagtcaacattaaatttaaaccattgggtaaagatagcaaactggacatgcttttacttttccttcctgttgataaatcctatcaaaactacgtgagagggacttttaaaaaatacataaacccggccgggcgcagtggctcacgcctgtaatcccagcactttgggaggccgaggcgggcggattacgaggtcaggagttcgagatcagcctgaccaacatggtgaaaccccgtctctactaaaaatacaaaaattagccagtcgtggtgttgtgcacctgtaatcccagctacttgggaagctggggcaggagaatcgcttgaacccaggaggcagaggttacagtgagctgagatcgtgctattgcactccagtctgggtgacagagcgagttcgtctcaaaaaaaaaataaataaataaataaacccataaaggacaaaacagatttggaaaggagacaacatcaacacagtttggaaggctgaaaagcaaatagatgagtttaaatgacttagcaaagttgagagccgcaacctaagtagtcagtgggaaaagccaagatgtaacttgactttcaccccaaactcctaaaaggctcaggagttgacatcaacaggcacaatggaaactagaagattgaagtaattgggatgaagggtgtaagttttgggttataagtttaacttattaacttttaactttattgggtataagttacaatactataaaattcacccactgtaagtgtgcggtcccgtgaaagttgtgtatccatcaccacagtccagttttctaacaattccatcaactcaagaagcttctttgttgatgtttagtcagtagctgcctacgacccccagtcctaggcaacctctgatctactttcttttctagactttcctttgctttttttttttttttttgagacggagttttacagttgtcacccaggctggagtgcaatggcgcaatcttggctcactgcagcttctgcctcccgggttcaagtgattctcctacctcagcctcctgagtagctgggatgacaggcatgcaccaccatgccagctaatttttgtatttttaagagacggggtttcaccatgttggccaggctggtctcgaactcctgacctcaggtgatccacctgcctcggccttccaaagtgctggaattataggcatgagccactgcgcccagcctttcctttgcttttaatatgtaaattattaaattgatttcctaatattaaaacattcttgcatttttagaaaccttaaatttcaaacaactgtatttctctatatcaattatcaattggagtaattagccattatctataatagattcattacatggagttcatggtagatttcagggagtcttgatcccctgaagttataagcaatttttatttacatacagaaacatttggggagagggttcatagatgtctttaattttccaagacccagataaatacaagctacctttgcttatgcctaagttaaaagttttaacatatcttttcacttttctccctttgtcccattttccaggttttatctaatttggggtttaggttacagattgttattattacattgcttctatttttagaatcccttaagagcagttttattagcaatgttgacttagataaaactgagggggcttttttgttttttgtttttgtttttcgtcagagacaaggttcttgaggacacaacatttaagctggggcctgacagatgagttagaattagccacatgtagaggctatctaggaagatgttaaggctatctgttatgttcagttacataagagagatcctttgtaaatgtgttttgctttgtaataaaccttctaaggagccagtattgttttgttattacatcactctctaaaatttcaaattgcctttttggttttataaggacaagatgggctcttaacaagatggctttggggttttttcagtcgaagatgatgtaacctctagagttaagtgcgaagaagttgattttgagaatatattgcagaaggtgcaaggaacgtcatctgggttatgacctctggaagtggaggtagttttttgtcattgggtcgccagtgcttggcatgtgatctgtgaggtgatcgagaatattgcagacacaagggcaggagtaatgcctctgttaggggtgttaagttcgtagtgggttcaggaagagatggtggaggctgagggacagatgttttcattcagtgcagtaatatttgctaacaggaagaaagtagtgtgggtaagggtgaagaaggggccagagaagagagtgcagatgtgcaaaaagtgagagtttgtggaagcaggccgtgatgtggttccaagagctggactgtcgaatcttatttttgtaaagctctgctcttaagtaaaaaacccagagtcacctttctaccatgctaccttcagggcctgagcaagagtactgcgttgtagaagaggtggtgctttttagtatttaagtaattaaaccttccttgttgtattaaatccatatataataccttattccaacatatctcagatagtttctgtatctcagatagtttcagcaagagtttgtgtatggcaccgaatggacaagagctgtacatatatataaatgtcagaaagagaagaaaaatactaactgtaactttttggtttcctggtttgctgcttttgcatgtagactgttcttaaatatgctgaggttgggtttgtttttcccactttcccattctatcaacatcagttgttatttactctaaacaatcattctttcattttatcctaagtgagtttcttttataatttaattcagttcccttggtattaaacactgttcagtactttggaagtagcttacttaatagctttttctgctgtgtgatttattcaagaaatattcaaatgtcagctatatgtagagcactgtgttagattctgtgggagttgcaaagatgatctagatacagatctttctccagatctttaaattctagaagggtagtatagacagaatgatagaatgctgtgtggttttcaaaggaagaacagattatttcagcccaggtggagttgggtgatggctaattttatgtgccaacttgactgggccacagtgcctagatatttgatcaaatattttcgatgtttctgtttaagtattttttgtatgagattaacatttaagttggtagattgtgagtagcctccatctgtgggtgggcctcatccagtcagtggaaggcctttaatagaacaaagactgacccctgagcaaggagttctgccagcctgctctgcagattttggatttaccaggcctccttaatcccttgggccaattccttaagtctctttctgtgtttgtatatgcacatctgatttattctgtttctctataaaacctgaccgatacctggaatcttcaagttgaaatttaggatagggggagagagaaaaatagaggacagaaaacctgatctgtgaactgagaataatgagctttgttagaatttaagtttgagtatgctgggaccaggtcttggagctgatacaggactgaagagttttaactttacatcataaatcttattctaagttttcatttgaacctggttttagtttcttaactttgtaagcgtcttttggatatttcagtgtttcatttgttgctctcaaattttggtattcaacagactcgtttctttttcttttcagttaacattagagtctaatttacaatttttagttcatgtcaaaaaaaagttcaggccgggtgtggtggctcacacctgtcatcccaactctttgggagtccaaggcgggcagatcataaggtcaggagatcgagaccatcctggccaacatggtgaaacccagtctctaatttaaaaaaaaaaaaatacaaacattagcctgggcgtagtggtgcacacctgtagttccagttactcaggaggctgaggcaggagaattacttgaacccaggaagcagaggttgcggtgagacgagatcgcgccactgcactccagcctaagcaacagaccaagactcggtctcaaaaaaaaaaaaaaagttcaggctttgggaaatttttttttttttcttttgagacagtcttactctgttgctgaggctgtagtgtagtggtgtgatcataactcactgcaacctccgcttctggggttcaggcaattctcatgcctcagcctcccaagtagctgggattacaggcgtgtgccaccacaaccggctaatttttgtttttgttttttcttaaattagagacagaggtttcaccatgttggctaggctgggctcaaactcccaacctcaggtgatctgcccaccttgccctcccaaagcgctgagactacaagtgtgagccaccatgcccagcctggaaaatgttaatagtgtcatttggagggtactagcttcacttaactatgtattttaagtatataatgtttatcatgcttaaatttagaacatttttggtattttataatggaggtattgtattgggaagtttgtcactacaacttatttctctggccttgtactatgattttatatacaagtattatatacactaacaaccagtttggcattaggatgatgtttgagcttaactaaatctggagactggattagatgagtgattttgccaaataatttgaccctgttttgttgttgttgttgttgtttgtttttttaatgcatgtgatgcatttctattaataaatctttggtgttatttcaagctagaaatataaaattgattctattttaagactaataaaattattagctgggcatcatggctcacacctgtatgtaattccagcactttgggaggctgtggtggatggatcgcttgagcccaggagttggagaccaacctgggcaacatggcgaaatcctatctctacaaaaaatacaaaaattagccaggtgtagtgtgtgtgcctgtagttctagctactcaagagactgaggtgggaggatagcttgagcttgggaggtaaaagttgcagtgagccgagatggcaccactgccctccaacctggactggatgacagagaagggacgctgtctcaaaaaaagaaagaaaaaattattagggcaatgtagcagcatgatgaagtttaaaatgtagaggacaaccacccctagtttccccattctccccaactacttttgtcattctctgtattctcttgtaggctgtatttgtaggtgtgtgcgcacatgtgtgtttgaagttgaaaattcacattacatgcaattaaccattatattgtgtacaattcagtggcacttagtgtagtcacagtgttgtgcaactaccacctctccttagtttcaaaactttccatcatcctactaaaatacccctaggcattaagtaatccctcttcatttcccccataccctgttgaccactaacctgctttctgtctccatggtttttcctatttcggatatattatgtaaaaggaatcatacactgtgtgacgttttgtgtctagcttcttttactcagcataatgctttcacgcttcactcttgatgtaacatgtatcagcattgtggtttttttatggctgaataatatttcattacatgtatttttaaatatatatatcatatatataagatatatagagatcataatttgtcttttgttgatgggcatttgggttgtttctaccatttggctgttttgaataatgctgatataaacatttgtatacaagtttctgtgtgaacataatataatctctggtactttgttttggcagccctagcaaactatattgtgtgctttatttccagtgtagtgcttagcccacttgctggactgtaacttccctgagggtggggacataaatataatgcctgcctaatattacttaaatattctaagcctgctgaatcactacattttcgttaattcatgataatccccaaaatatcccagaatcagatcagtatctattcagctacataatactacttaatagtagtagtatggcttactttgaagcctaatgctgtgtcagcttcagagattaagatgtcaggaaaccaatagtagtacttattagaggcattgcaagtggtatttagtgtttagtggaccttcaaatccaattcagtgatatcaaatccaagtaagcaaatagactgagctccttgagaataggaactggtttccctagcatctagcatagtacctgggacaggtggtgcccagcaagtatttgaaagaaatgggatgaaatgcaatgacatacggcacctatgttcagcttaaaactccagtcacattacctatgggtatttacattggaatgtgtagttgctgtagaatcccaaaatgaatactagaataacaatgttctttctcaaagtactacgtgttatgaatgaaaaaaaaaatgattagaacatagttcagattttgccagccagacaaaggcatttgtgctgtaatctgaggtatgccttcctgcactaagaggaacagggtttatgggaaaactaggattaggagcagaccatttgaaatctgtgcatctttgtaatttaagcactaatgtaaacctaataaaaagatagtagtgtgcttaaagataagttaaaatttttaaacaaataatttggtaaatttagaactttccctttaaaaacagtaaaggtgaccagaagtggtggcactactcagggctagctgtatttaactgttgttacctgcaaatgcaaaaactaaataacattttaggaaaaattggaaatgaaccaatgtgatttctgaatgtactgacataattcccttatttactgattgcatatgagctaatgtatgtgttgtagtagaatagttccagtagttctttaccttttctgtgcttatcatgcctccttcctttctactgttaatgttcaagttttaatcttccagacttctcatttgttctgtaacagtatcttctagccacgtgtgcccttctaatctctcttgtggaatttgttcttcacaatactacaagaattctattgcattgaaaaccccaaatcttattaagccagcctccatcattagagcatgtttctcaaactcttggtgtgtgcaaatcattcttattctgtgatttctattttcatgctttttcagtttgcttcatttgccatatgatagaggttttcttcagaccatattttggaaagtatgctcttagttttaaattctactatgggttatttccaagacccatagtagaatttaacaaattctttcaaataaaaaattttaaagccttcgcttattatcaactagccaaaaaaaaaaaaagtgtatcaagtgactcctacttgacatgatgagagatgaaagtgtaagtttagatactactactgtctgttgagtttcctctctctccattcattttaatctcccaatttttgttaaaatgttgtgatatactgttcttagtttgttacactttgtaactttgtagtcttttccagaactatttctattctagaaccaaagtaaattgtcatgtagacttctgtgttgaaatgaatttattgtccatttcttatctttagataacactttttttgagttattttgatataccaaagcataagtctctgtggcttgtagtggtctgttttttgtttgtttgttttgtttttttctggaaatacagtgaaagcttttgatgaaatttaggccttcatgttaagacatttctattctgttatatctttaattatatttttcttattcttttgtctatctcaggggcagcagttaactgttggatcttcataactatcatcttctctctaacctttttaatgctgtagtactttttcatgacatcttgtttaccttttctcaaaattattctcttctagtgatttggttttgctgcattgactgttgttgcatttattagttatgctgttttatttatcttgtgtaattttctttccttaattctgcatgctaccctttcaatgttgttttgatcataaaagtctatgctatctgtttttcttgtgaatgtcgaagcagttgtttcagaaaatttcttctattttctgtgataaatactaatactgaatgtatttcatctaccttttgaagactgtgtcctatcagggcaaactgctggtaatggaaaaaaaaacaaaataagtaaatgaagaccgtgtcctctttgattcttctcttcttctttactgccttttttctttattttgatacacctttttctttccttccatcattgcctccctcctttccctcttttcttcccttctttccatctttcctgtaaaatttttcttgattccctgatttttctactctttttttctttagtaggtcctttcagtacctgctgcttgccaaaacgtgaaatgcagattctctttttacttgactctgaattcacctggctaagctctgttaggccttaggaagcttaatagagcttctctaattttgtagaagaagggcctttgactttttccctctctgcttcaggatgatctcatctgctactttggaagcatgagactttatttgttttgatggtactgaggttaggggtgagattgatttatttgtaattagtcctttctcctccttatccttccttttggataaaggtaaaaatataaaatcctcctgcctgctaaagtactgtttggccatcagagaaagggagcttcaggtagggcattccgcagtccctgtccccatcttagcaagttgaagatgctagtcaaaatttctctggggggcaggagagggcagaggatacttacgtatggattctggggttggtctttcagtttcaactaactcattctgtacctgaatgatactatttaataaaatttcgtggtatgagtttgagaacttgtcatgattttagggatattttaacttcctttttgtttctttcctttagttttagggaaggatcttctgccaaactacctgtgccactgtctttcctggaagtctcataagtactagaaagaacttttagaataagagtgtaggacattatttacactgaaataacattctttttgttgtttttttttttttttttttttttggagtcagattgtcattctgtcacccaggctggagtgcaggagcgccatcttggctcactgcaacttctgcctcttgagttcagccaatcctcccgcctcagccacctgagcagctaggactacaggtgcatgccaacatgcccagctaatgattttttgtatttttagtagagatggggtttcaccattttgttgaggccggtgtcaaactcctgacctcaagtgatctgcccaccttggcctcccaaagtgctgggattgcaggcatgaggcgctgcatcagttctgcaaaaaaaaaaaaaaaaaaaaaaaaaaaaaaaaaaagcgtatgcattaaaaatactaagggggccaggcgcggtagctcacgcctgtgatgccagcactttgggaagccgaagcggatggatcacttgaggtcaggagttctagaccagtctggccaacatagtgaaaccccatctccgctaaaaaaaaatacaaaaattagctgcgcatggtggcacacgcctgtaatcccagctgctcaggaggctgaggcaggagagtcgcttgaacccaagaggcagaggttacagtgagccaagattgcgtcactgcactccagctggggcaacagaatgaaactccatctcaaaaaaaaagaaaaaaaatagaaatgttaaggggtttacttcctttagggtactctttaaatgaaatatgatgtttcatattctctatttggaacttctgtatggatgcagacattttcagaaatctcccaggacaatgaacctgaaacttatgtatttataagaaacttggggatttggttattttatttacttattttgaaatagggtcttgctgtgtcacccaggctgcagtgcagccacgcttcagtacagcctcaatctcccaggctcaagcgatcctcatacctcagcctccttatagctgggactacaggcatgcactaccacacctggctaatttttaaaaatgtttatttttttgtagagacagaacatcactgtgttgctagggctggtctcaaactcctgggctcaagcagtcctcccaccttggcctcccatagtgctgggattacaggcatgagccactgtgcctagccagaaattggcttaaaatgcagatttttggaccctgtccccagcaaaaagattcggtagaaatctttattcgtagccagtttactgtgttgcaggtggtccccagtttaactttgagtaatgctgtcttcattgttaaaataatcagatttaattatatggtagatattttaggtaactagggtatttcaagctgtcccatggggctgagtagctggcagctgcttgacttggcttctagaggacttactgctcagcaaggtaaatgttattaataccttcattgctctctgtgtcccaaaggtcaatacccaaactttgagattttgtagactggaggaatctttgtctcccactccttccccaagaaagacatgggttgctaatttttattttgtcgaatgaggacattaaaaataagttaaccgtgagccaggcacagtggcttaggcctttcatcccagcacattgagaggctaaagcaggaagatcacttgaggccaggagttcaagaccagcctgtgcaaaatagcaagacctcatctctactaaaaaataaaaaaagttagctgggcttagtggcacatgcctgtggtcccagctacgtgggaggttgagatagaaggatcgcctgagcccgggaagctgaggctgcaggaagccatgaccacaccactgcactccagcctaggggacagagacccagtctcatcaataaataaataatgaaaggacattttaacaccccactacaaccactaaagatacaaataaataaaaatataagaggaacacaacctcataatacagatagtcttttatattgcatatatttaacttcgggcaaaagccactctattttcctctttaaaaaaacttttttagctatagattaatgaatactttctcagacatttcagaactactgcttagtacttgaaatacaacatttagaatctggggtactacctgaatgtgatgagtagtcacacatctcatatcctttgttttcttgccagttcgatcctttggtacagaagacagaccgacagatcgtccaataccacctcgagatgaagtctttgaatacattatattccgtgggagtgacattaaagaccttactgtttgtgagccaccaaaaccacagtgttctttgcctcaagacccagctattgttcaggtaactgatggtaaatttgtcttggagtacaggtaaactccgcacagggttagccttggcttttttctctctagttgaatgttcatgtagcttatcatttccaagttactgggatacctgaaattactggataatgttctcatctaggtttttctctttgtatcataaattagaactaaggtaagaaacagctgaggaatttattatgaaatattttctaatttcaacaacaattaccatagctaacattgaaggctactctgtagaagtgctgtgcatataagataccctctgaggttggtactataattattctcacttttaacaagtgaggaagttcagatggagccacaatttgaacagatccaggcagcctgcttcagaatctaggatccgtgctaccatgctattgagatatggtttatattgcaaaccaaggcaataacagctactcttaggtaagattattaggcttaatggggaaaaaaaagcaaaatcacattgttctgcatatgttataatatgcagtgttggtttttgttttgtttttctttttctttttttttttttttgacagagtcgttggagtacagtggcgtgaactcggctcactacaacctccgcctcccaggttcaagtgattcttctgcctcagcctcctgagtagctgggattacaggcatgcaccaccacacccggctaattcttgtatttttagtagagatgaggtttcaccatgttggccagcctggtctcaaactactgacctcaggtgatccgcccacctcagcctcccaaagtgctgggattacaggcatgagccactgtgcctggcctgcaatgttatataataagaaaacacaaacatcaatgtattttaacatatttagatcagctcttaaatctcccaatttaagctttttaataaggaattgtaaattttgttgcagcataagctggagaaattctctactctcatctacccctacccttgttaagtcttattttggtgaaaggaagcctgaagtggaaatgtgaatctctttaaatggagaaggaagagacacattcttaatagagatagctccctacaccaaacactggagttaccttactgtctcttttatatggcttttgataattctccaggaaaccagttatttgagtaatcggttttatggaaggagaaaaactaagagagcgcatatgaaaatggtgttgaataacttcttccaatcatcataaacttctacttgatctccttattcattcattcagtagtatttacagagtatctggcatgtgcttaacactagtggtgaacacacagaaaaggtcctgccatcagtgagtgtatgtcctggtagcctttaatacacttcatgtttatattatgaaacagtttatagtaagataatatatgaagtatacatgtattaatatatgttatatattttatatgctttaggtttaagttaaagtttttataaaatgttcctcagcttaatgtaactataagtaaaaatgtaaatggttttatgtgggatatgtttgtttctacgtctgtgaatttaatagtaggcctcaaatgattgaaaataagagtaaaatcatacgtgagatttatatcaacatcagactaaaactcattattactaagtgtgatttttctcatatttttctttaagcaaagttactttacttaagtaactttaattctttcctcaatctataaaactcttaattcaaatggggagtttattgtagaaaaaagtatttgtaagtcacattgagtataattggcacattatagacagatactgaaatcaaaaggttgtttggctattttaatattaagtgcatattgtaattcattttatatctagtagttataatttaatagttttcttaaaagtaaaaatctggaattttttttttcgttatatacatgttgcttagagcttggaaacataactcatgattttccttcagtcctcactaggctcatcgacttcttcattccagtccatgggttcttatggacctttcggcaggatgcccacatacagtcagttcagtccgagttccttagttgggcagcagtttggtgctgttggtgttggtatgttttctttttcttttctttttttgtttttgtattcttcctttctttaccacaaaggtatagaaactcaacaccaactattagaaatgttgtttgatgttccttttgtaactttgttttatggtattcagaacacattttgatgatatcttaaagcctttattgatattagtgggtttttaaaagtcagctttcacagagtaacatttttttttactaggtaaaaaaaaaatggatatactaggtatatccaatatctaccaaatctaccaaattggatatactaggtatatccaatatctaccaaatcttattggtaattggttttgttttgttttttttaaagacaaagtctcactctgtcactcaggctggagtccagtggcactatcttggctcactacaacttccacctcgtgggtttaagcaattctcgtgcctcagcctcccagatagctgagattacgatatgcatcaccacacccagctaatttttgtattttcagtagaggtggagtttcactgtgttggccaggcaggtcttgaactcctgacctcaggtgatccacctgcttcggcctcccaaagtgctaggattacaggtgtgagccactgcgcctggcctggattttaattaataaatttttctttttaatttctttttctttttttttttttttttttttttctgaggcagagtcttgctctgttgcccaggctagagtgcagtggcatgatctccgctcactgcaacctccacctcccaggcttaagcagtgctcctgcctcagcctcctgagtagctgggattacaggtgtgcgccaccactcccagccaatttttttgtatttttagtagagatggggtttcaccatgttggccaagctggtctcgaactcctgacctcaagtgatccacccacctcagcctcccgaagtgctgggattacaggcgtgagccaccaagcccggcctaaaacatttaaaaatgtttattttaaacatacataagacatgcacacataaagatacgcatagcatgattgagggcttggtgttttgtttctgtaacactggatttgaaacgaaactataatgagaatgtatagcagggctgggcgaatgacaggcttgcttatgactggagggtcaagggctattgagtgcaaaagctggatgtaatcagattagctcagtgttttgtttttatagctatgcattttagcgtttaaaccatggtaaagaacagcttttaaaaaaaaatcgcttctcagccttttggctaagctcaagtgtaaaaaaaaaaaaacagctttaaatctcaagcttttgcccctaatcttttaaaatttcattgaaataattatcagtttactgtttcactgcaccacaaatttagtttcaggtgtatcttgaaactcattgatatgctaataagttttattaaaattgttaaattccttcctgtgaatatactttttatacagatgtgacttaagtatttaaatgttttacttattcacaaaataacaaagaatggcaaaaaaaaagcaaactaaaactgaatgagctgggcgcggtggctcacgcctgtaatcccagcactttgggaggctgtgggcggatcacctgaagtcaggagttcaagaccagcctgaccaacatggagaaaccccatctctactaaaaatacaaaattagctggacgtggtggtggtgcatgcctgtaatcccggctactagggaggctgaggtaggagaatcgcttgaacctgtgaggcagaggttgcagtgagctgagatcgtgccattgcactccagtctaggccacaacagcaaaactccgtctaaaaataaataaataaataaaactgaatgaatataaacagaaaccacagatgctattacatattaaattgataatataaccacacagagggctgggtgcggtggcttacgcctgtaatcccagcactttgggaggccaaggcgtgtggatcacgaggtcaggagatcgagaccatcctggctaacacggtgaaactccgtctctactaaaaatacaaaaaaattagccgggcgtggtggtgggcgcctgtagttccagctactcgggaggctgaggcaggagcatggcgtgaacccaggaggcggagcttgcggtgagccaagatcgtaccactgcactccagcctgggcgacagagtgagactccgtctcaataaaacaacaaaaaaaaccacacagaggaaaaaataattcaggtaacttttacactcttagtaggatatattctaacaacaaatagaactactaagaaaacttgactttgatttgtattattggtgttattatttatttatttatttatttattttgagataagatctggctctcacccaggctggagtgcagtggcacgatcccggctcattgcaacctccgcctcccaggctcaagccatcctcccacctcaacctcccgagtagctgggattataggcatgcaccaccactcccggctagatttttcttttgtattttttgtggagacagggtttccccatattttccaggctggtctcaaacttgtgaccttgagtgatccgcccatcttggcctccaaaagtgttgggattacaggtgtgagccactgcacccagccaggtgttaattcttaaactgttttgtatgtattataggaaagggcaaatgaataaaatacttatgttgggaaatagtgtttttaccatggagacggaagatataaatatggaatgggaaaggtgagaaagaaccctgtggtgctgaatgtaaatagatggtatgtgtatggactcattttttaaaaactggttatttcctagctctgttcgtagaaaggacctagaaacaatggaaaccccgtagcaagggacacatgtagactcagctcttagtttctaaataccactccccactaaaaggaacaagggcccattgaaaaacaaaggaaaagacatacttttttcatataaaaatgcctgctaataagtagaagcagtggtagataaagaaaattgccattttctaatctcagtataataattagcgaggattatcattagatgctgaagtcattgggtgaaaggtgttaggacagcatattaaggtggtcttaaagtatcatcccacaatttacaaagggggaaaaatgtacccttgtaacacagacatctggtggttaccaacttcgttgagtgctcaagtttagcattgccatgaacaattatgtgtctcctgttgtgatgattggggtggggggcaaaacataatatcacctttgtggggttcttgctgaaaatacagaatctaattttgaagaaatgggcttatatatccagaaggtgggttgttttgcgagacagttatccacactcttcaaaagattcaatattacaaagaatggagagaggcagcagaactgctttaggctggcaaagactgaagagacataacatccaaatgtaatatagaatcgaatactgggcttttaaaaagttggcgtgtttgtttcctgcaggggagaaaaagaaaacttaaaaagttggtgtgaagaacattttagggactactaaggaacttttgagtatggactaattgttggattttgttattattgttaattttctggttaatcatatgggaaagtgtttttgtttgggggaggtggttttgaagtatttaaaagtaaaagggccaaattgattttagcctctctaaacaaaagaaaaatgtgtatattaaggtataaagatggagaaacagagtgggtttggttagatgttaacagttgatgagtctaggtgaggaatatattgatattctgtgtactccttcaattttaacataggtttgacatttttcataattaaaaattaattccttttagacttactttaggtgaaatagtgtaactttggtccataaatttccaaatccagtagtaagatcaatgttatttattcatgttaaatcaagatatactgtatgttaactgtaacttagaatcctttcctggggattcaagtaaggaatgattgcaaattgtattatcctttttgaggctcctttgactaaattaaatagttaactgactttgagatcatcattatacttcttatgttaccatgaagtttatgtaactaattatgttaaaaaatttgaacaggatcaagcacgtagtatctatatagtaactattgcttctgccattcttcaaggtttactttttaatcagagtattttgtggttgtgaaatgcttttataaatattttaatctaattttaatattattgtgggttgttggtttattacttgggtgtcacaaaagtagaagattttactggcattttccatgtcagtagagtaatttttgcagggtcagattatttttgattaattgatttccatattggttaggataatttgtggagtggctaattagaaaactagtgttagaagttaccaaatgaggaagaggaaagctgtggcattggtcaaggtgacagatgtttttcagaaaaggaattaacttaaatttagcttgttttttgagatggcgtcttgctctgtcacccaggctagagtgcagtggtgcgatctcagctcactgcagccccctcctcccgggttcaagcgagtctcctgcctcagcctcctgagtagctgcggttacaagcatgtgccaccacgcccagctaatttttgtatttttagtagagacagggtttcaccatgttggtcaggctggtctcaaactcctgacctcttgatccgcccgcctcagcctcccaaagtgctgggattacaggcgtgagccaccatgcccagccaaatttagcttttgttggcacaaagtaaaccacattttaagctaggcctcttttcatttttggttcctagtattctgattttaaaaggaaatttaaatgaatctggatcacagtattgctatttgatgagaaaatttttatatatttacgttttcgtgtgttattactattgctttttatttttatttatttattttttgagacagggtctctttctgtcatccaggctggagtacagtggcacaaccacaggtcgctgcagcctagacctcctgggctcaagcagtcctcccatctcaacctccctagtagctgggactacaggcatgtgccatcatgcccagctaatttttgtatttttggtaaacacagcatctcagcatgttatccaggctgatctcgaactcctgggttcagtctgcctgcctccgcctcccaaagtgttgggaaccaccatgcccacccttattattgctttttagtaagtttttttttttttttttttccatttggttggttggtttggtttttgttttgttttgttttgttttgtttttgagactgagtcctgctctgctgcccagcctggagtacaaagacgttagcactttgggaggccatggcaggaggattgcttgagctcaggagttggagaccagcctgggcaacatagctaaaccctggctctacaaaaaaaaaaaaattaggcaagcatggtggcacactcctgtaatcccagctgctccagaggctgaggtggggggattgcttgagcctgagaggtagaggttgcaatgaaccaagagcacgccactgcactccagcttgggaaacagagccagactgtgtctcaaaaaaaaaaaaaaaaatcttgcttatagtgaaaaacatacaaattaaatctacactgagacaccatttctcactatcagtttggcaaaaactcaaaagcttgattatatgcatactcttggcaagtatgtgaagaatatatactctcatacattgagaagaataatataccaggtagaattaaaggactcactctgttgctgcccaggctggagtgcagtggcgcatctccgctcactgcaagctccacctccctggttcacgccattctcctgcctcagcctccctagtagctgggactacagacgcccgccaccacgcccgggtaattttttgtattttttttagtagagacggggtttcaccgtgttagccaggatggtctcgatctcctgacctcgtgatccgcccgcctcggcctcccaaagtgctaggattacaggcgtgagccaccgcgcctggcggacttttcttaaaactgatgcaaaaataattcttatgtgtaagagattagatcattactggccttaatttctgaactcttggaaaaattaaacacctcacaataaatgaagcatcaaaacagtatttccctgtgttaccattgaacagtagcaagagcttactgctgcagttagaaaaaggattcatagaaacagtgaaaggtatagattgaccagctatctaaagtaattctatagcaaggattacagtgaagaaacatggagcaattagatgttttttctgttatatttactccagttgattgtttaagtctcataatcttatgtgccagatggaggagtattggctgaatagaccatcagtgggtacattttagttgattaaatagccaaaccatattggaggatggttctcttaggtctccagtgttttgtagagactaatttttaatcactgagtgatgaagccttgaagagatgcttacgaactttacagttagcataaagccaggggggtgtttcaaccattatggatgttaaactaaggattattaaagatcagaccaggcacagtggctcacgcctgtaatcccagcactttgggaggctgagacgagtgaatcatttgaggtcaggagttcaggatcagcctggccaacacagtgaaaccctgtctctactaaaaatacaaaaaaaatgagccgggcttggtggcgtgcgcctgtaatcccagctactcaggaggctgaggcaggagaatccctggaacccaggagatgaaggttgcagtgagttgaaatcatgccactgtactccagcctgagcaacagagcgagaccctgtctcaaaaaaaaaaaaaagaaagaaagattgttaaagatctactttggtaaaatgtgaaggaattaaacattccagttaaaaggcagagagtgtcagactgaatttaaaaaaaaaaaaaaaaagacaaggcccaactatattatgtttataagaaatgcactgaaagtgaaagaatagaaaaaggtataccatacaaacagcaataacaagaaaagtgtgtagcatacgttaatatcagacaaaggagcttaaagatcaggatttcttccagaggtaaaggttgggggggcgttcttcgtaaagataaggatcagttcatcaagaagatacaacagtcctaaatgtgtaacttttataaaacagtatacccaacaattgcagaatattgttttaagtagacatgaactgctcaacaatatagaccaaatgctggaccataaaataagtcacactaaattccaaaaggaataaaatcatacatggtatattgttaaaccacaaaataaacttgaaattaataaagttaacttgaaaaatccccagataatttggtatcaagtaaacttgttaatcactaatggatcagaggagaatttacaagggaaattagagaatattttaaatctagaccagatgtgatagcatacacctgtaatcccagcactttgggtggtggccaaggtgggaggatcacttgaggccaggagttcaagaccagcctggggaacatagggagaccttgtctctgcaaaaaaaaaaaaaaaatttaagtagctgggtgtggttgtacatacctgtagtcctagcactcaggaggctggggtgggagacttgattgagcccaggaattcaagactgcagtgagctgtgattctgctgctgcactccaggaaaggcgacagagctagaccttttctctaaaaagaaaaaattaaattaaaaaaattttattttcaatttaatgaccagaaagtttgtgggtgtagctaaaacagtgtttagaaaaattttcatagctttaaatacatgtattagaaaacaagaattttcggctgggcgcaatggctcatgcctatgatcccagcactttgggaggctgagatgggcagatcgcttgaggtcaggagttcaagaccagcctggtcaatgtgataaaaactcgtctctattaaaaatacaaaaattactcaggcgtcttggcatgcgcctgtagtcccagctatttgggaggcggaggcaggagaatcacttgagctggggaggcagaggttgcagtgagccaagatgacgtcactacactccagcctgggttacagggcaagactttgtctcaaataaaaaggaaaagaaaataagaatttttaaaatcagtgctttaagctaccagtttaagaagctaggaaagggccaggtgtggtgtctcccacctgtaatcccagcactttgggaggtcaaggcgggcagattacctgaggtcaggagttcgagaccagcctggccaacatggtgaaaccccatctctacaaaaatacaaaaattagccaggtatgatggcaggtgcctgtaatcccagctactcaggaggctgaggcaggagaaacgcttgaacccgggaggcggaggttgcagtgagccgagatcacaccattgaactccagcgtgggcgacagaacaagactccatctcacaaaaaaaaaaaaaaaaaaaaaaaaaaaaaatactaggaaaaatggttagctgggcatggtggtgaatgcccttagtcctaactgcttgggaggctgaagtgggaggattccttgagcccagcagttcaaggttgcagtgaactatgattgtgccactgccttctagcctgggtgacagagtgagaccatgtctctaagaaaagttggtgaggacgccaggggacagctaggaaaaaaaatgaaagaaaattattccaaaagtagtagagggggaagaaaataaaaagataagagcagaaatcaatgaagtagaaatagattatattatcagcaaagtcaagagtttgttttgggtgggtttttttattttttatttttattttataagattgataagtccctaacaaaactgattaaggaaagaaagaacaaccaagcaagttgccaataccaggaatgaaagagtagacgtcagtatagaccttaaaagaataatatgggaatatatgaatgtcaacaaatgtgatagtttggatgaagtgggcaaatttcttgaaaaatagcaaaccaacacaagaggaaataaaatctcaatatctctatatcttctaatgaaattgaaacagtaatttaaaatcacccagaaagaaaattctagactgtttttactgttacattctaccaaacatttagggaagaaataattttcactaatcttacacaaactctttcagatagctatgcaccatgatgcatgcctgtagtcccagtaactcaggaggctgatgcagaaggatctcttgagcccaggagttcaaggctgcagtgagccatgattgtgccactgcactccagccaaggcaacagagcaaaaccctgtctcttaaaaagtaaaaaaagactgggtacggtggctcaaacctgtaatcccagcactttgggaggccgaggcgggcagatcacgaggtcaggagatcgagaccagcccagccaacatggtgaaaccctgtctctactaaaaatacaaaaaaaaaaaaattagttgggcatggtggcgcgcgcctgtagtcccagctgctcgggaggctgaggcaggagaatcgcttgagcccaggaggcggaggttacagttagctgagatcgcgccactgcactccagcctgacgacagagcaagactccatctcaaaaagaaaaaaagaaaattcagagaatacaggaagaggaaatatttgctgaccctataaccaaggccaaataactgaaataccaactgtgactggatcgttacaagaaaattatagatcattgtcccccatgaacataaacgtagtaatgtttattagatgtagaagccagcacttcagaagaaggattgtatatgatgacaaagatttatctcaggactgcgaagctgcaacatttgaaaatcagttgtaacttaccacgttaacagaccaggaataaagaatagagaatccagaaatagacccactcagatacttaaaacagagtaccaagacagttcaatggagagaaaagacattgttttaacaagaggtgttgcagcagctgtttatctgtggaaaaaataaaacttgacccctggcttaaactataaattaaaaataatttggaatagattatagacataaattggtagtagaattggagtagagcgaggggggtgtggcacgatcaggaactcacggaagagatttgctctaaccattgaatgcgtaatccagaggacaagcaatgggaggccaagccaggtgaggaaacacagagcagcctggagatgcaaatatacatcaaagtggctgatgtcttggtcatcacccaggaatactagaaataactggatgggttctactccccacagaattcttgaaagcgctagtccccacattaccgggatattgtgggaagttgtattaggcttctcctgagcttactggagctgcagccagactggactgcacctccaagggagtcccagtggctccccttgtctaagatactgtgctgctttctgaagccacatttttttttttttttttgagacagagtctcactctgtcacccaggctggagcacagtggcccaatattggctcattgcaacctccacctcccaggttcaagcaattttcctacctcagcctcctgagtagctgggactgcaggcatgcgccaccacgcccagctaatttttgaatttttgtagagacgaggtttcatcatactggtcaggccagtcttgaactcctgatctcgtgatctgcccacctcggcctcccaaaatgctgggattacaggtgtgagccactgcgcccggccctaaagccacattttaagagggataagaacaaatagaattcattaaattaggagtccaagaaaggaaggggagagtgtcctaaagaccatgtgaagtgagtaatggttgaagggactggagttgactaacctgaaaatgagcaaattgcaaggggcatgattgtaatcttcatgtgttttaggagcagaaggataaacttctgctgtgggctagactggtgaaaatatagaaaatgttgagagaagaggtaggttttattaactgaagtgaatagtttgaacttttatcttgaggacagtggaagccaccagaaggtctaaagcacgataatgttattacatttatattttgtaaagaatcactctgactaccatctttaggttggatttagaggttgtggaagggggaggtactgttgaaatatagtgaaaacctgcttagatgaaataccaaggaaagagcacagtatatcaaaagtgaatgatccctaagtactgtagaaacttagagaagaaatttgatataacctagtatggcagagaattgggccctttctagggacctttttactcatattgccagaactttttgcagctgctttaggcagaatgcagcctcacagtcctatcttaaggggaagcattgaaaccagagtccattgtctattgccttggaaatgctaaaaaagctcctcgtaaacctgtctgctgatttggctgtttgtccagatacttagtattagaatcactgaaccttaatgttggtgttgaatgtaccatttctgctacttctctagttggtatgggtccttgctgtcccatctgcataactgcctaggacagcactccatgtgttataaacattgcttgcatccaaggatagtggacagtatattggctcccccttcccctgccctccatattgccataaaattcccaaactattcagtacactttaatttccaagattattaatttgtacagatgctggggggagaggtagacaattaccatcattaaaatgctgcattactttatatcattgaataatgtcaaacattttttaaaatttttttatcatttaaaaacatctctttaagctggaagctctttgacatcctttggaacagaaacatcaaacagtggtaccttaccccaaagtagtgcggttggttctgcctttacacaggatacaagatctctaaaaacacagttatctcaaggtaagctatctcatccctaaaatatttccattctaaacttttatagtggtttttgtctttctgaatgtaagagcttttgcagcttgtaaatcgcgtgtataatttctatttggctcttttaaaatttttctccaaatcgctgtattgcaatgaatatattattgaatgactctcactatttagacttattacagttcttagatcatgaaactgaaatgctgagcattctctaagttggactttttttgcaaagcaattatataacttgtatgtaacacttaaatatatcaaattaggctcatactcaccattaaagttgagctatccaagatgaattggaaatatcatctgaaaaaaactgtattatgctgttaacattttccctaacatcctcacaggatggagagtagtggttctcagtgtaggctacccacaactgaatcatctggggtgcttcttaaaaatttaaatcctgagacttatacatcagaatccctggagcctgaggatttatattttaataagcttcttaaaggattgttttatttcttaagattctgctcttcaaccagccagtctcataattttaaatggttatccataccttttattcttatctttgtttcttccttttttcttaatctttttctttcttttatttacttattagagatgaggtctccctgtattgcccaggctggtctcgaactcctgggctcaagcgatccatttgccttggcctccccaaagtgttgggatgttgggattacaggcgtgagccattgggcctggctttttttttttttttaaagataggtctcactatgctgcccaaactgaaatgcagtggctatttacagatgtgatcatagtgcactgcagccttggacacctggccccaaacaagcctcccactttagcttccccagtagctggggctacagccttgtgccaccatgctcggcttttccttatctatttttatgcactttagaaatgggtatttttggctcattgctttatatgaatggtttttgttttgttttgtttttaagtaaaacaatgttgagtcatttcagaaagacctatagtcacaagacagtattttaaaaagctattaagggtaaaaattcaatgctaaacataatcttatgtatttcacttaagatattttgaaatagttcttactgttactcatattgattagcttaatttttttctttttttttttcttttaagatggagtcttgctctgtcacccagactggagtgcagtggcacaatctcggctcactgcaacctccacctcccaggttcaagcgattctcctgcctcaccctcccaaatagctgggattacaggcacgtgccaccacgcccagctcatttttttgtatttttggtagagatgtggtttcgtgatgttggccaggctggtctcaaactcctgacctcaagtgatccacctgccttggcctcccaaagtgctgggattgtagatgtgagccactgcgtccagcctacttgcttaatttttaaacattctaaagattgtttgtttgttttttgagatagggtcctgctctgtctcccagactggaatgcagtggtgtgatcatggctcactgcagcctctacctcctgagctcaggccatcctcccaattagctgagatcacaagcaagcaccaccagctagttttgtagggacggggtttcgccatgttgccaaggctggtctggaactcctgggctcaagtgatccacccaccttggcctcccaaagtgctgggattataggcatgagccacagtgcccggcctattctggaatttttagttaaatcaggaacacatgaaaaagaagcataaatattgaaattagcattattcatgaagaatgagaactaataaggaacttaaattaggcacaggcaaaatgtaaattaaatatacaaaagtcaatagttctggccgggcacgatggctcatgcctgtaatcccagcactttgggaggccaaggcaggcggatcgcctgaggtcaggggttcgagaccagcctggccaaccaacatggtgaaaccccatctctactaaaaatacaaaaattagccgggcatggtggcgtgcacctgtaatcccagctactcaggaggctgaggtgggagaacccgggaggcagaggttgcagtgagccgagatcacgctactgcactccagcttgggcgacagagcgagactccatcttaaaaaaaaaaaaaatttaatagtcctaaagcctaatccattgattatgtaatgaggagaaaagatgattacagtaatgcaaaatagaaattgtatacaaaatatataataagaaataagttggtcatactaagaaatatgaccaacttctatgataaataatgtaagacagggacataaaagttgcatgtaatggaaaaaacatatcttattgctagatagaagaacaagaacagtaccagcacttagggaggcaaagccaggatgatcacttgagcccacgagtttgagaccagcctgagcaacgtagtgaaacttcatctctaccaaaaaattttaaaaataagcagagtatgatggtggacacctgtggtcctagctactcaagaggctgagacaggaggatcacttgagcccaggaggccgaggctgcagtgagccctaactgcactacctcactccagcctgggcgacagaaccaagaccctgtccccccccaaaaaaaaaagatgttgggaagactttactcctcatagttaacaaatttattgcaaattaattaaaaatcaatgcaaatagaatagtaggagaacttagtaaaacagtttatctttaaaataaacatggaagtgtggctggacatatttgaaaaataaaagtaatgggtttactgacatgataataaaatgtagcaatgcaggaaaaaagaaagagatgaatagaaagcaataggcaggcagaaacagatccgagtataaataagaatttatcctgggtgcagtggttcatgcctgaaaccctaacattttgcgagttcaagatggaagccagggatttgagactagcctgggcaacataccaggaccctgtctctaaaaaaattaaaaattagttgggcgtgatgtgtgcgcctatcagcttgagaggctgaagctagaggattgcttgagcccaggaggttaaggtggcagcaagctgtgattgcggccctgcacactagcctaggcaacagagcaagaattcatcttaaaagaatttagtagatgataaaggtattattttaaattagtggagagaaggctgtctgttccaattaataatgttgcctgatcatttggagaaagtcactctagattctttccctcatactgagcaccaaaaaatatataaattttaaatagattaaaatgttaaaaattttgaagtatgtgtttattaaaagaaagaggtgtatttacataaagttatgacaaatgacaagtcctaagagtttgcatttaagttttatcaactaaaattgctgaatttcacaaaattaaaattcctagaattttaagtgtgataagattgtgaagatagctcaagggagtgtgtctataatatgcagaaatcacttctggatttattcctaataatgtatccagtatcacagtatcacctgtatttccctgtttataacaaaactggcatcatgatgattagtaggccttaatagtgaaaaggctttttaagtacacaacaaatgtttctgtacttgctccgattgccccattgcttgtacttctgtagtacttgtgagccataggatcttttctcaaaagccttgataaagaagttttataaacttataagatgatttaatgtagtaccataaaattaactgtagcagtaggctttttcaggaagacatgtgaaataaaaaaaattagcaaggtgtggtagcgcacatctatagtcctagctactcaagaggctgaggcaggaagatcattgggtcccaggagttagaagttgcagcgagctgtgattgcgccactgcactccagccagagcaacagaacaagaccctatcctgtccctaaaaaacaaaaaacaaaatgtgttttataagtgattataaaatgtttttttcataggccaaaacttacataaaccatgatttcccattataatccagtggaaaaattgtaatgcttctattagtggtaacttaattttgaaatgttaagtagattgtgcctgtgtcggtttctgggttttgataaatgatcatttatttggctaactttgccattaatggctgaaatggtattgcacatttgtaagtgcatactttagataatcataaattggggaaatattactaataaattatccctgaatcatctaggtacataataatgcattgtcagcactcaccagttgtttgacacctgcaaatatgcacagatggacagtaacatttgcagcatatttgggggatttttttacgtgaaatgagcattttttttaagcaaaacattatattttggaataattatgagatgtgagtgcctaagcagagatgtacagcaaacattatcaggacagaaagcatgatgggagcacccgatgttacattcttcagttcatgctgtgaccaggcgacctcataaaaggaaaaatataatgtataagtacaaaccccattttttgttttggctcttttatatttgtattttttgagacagagtctagttttgtcacccaggctggatgcagtggaccgatctcggctcactacaacctctgcctcccaggctcaagcaatccacccacttcagccccctgagtagctggggttacaggcatgtgccaccacacctggctaatttttgtattttttttgtagagacaggctttcgccatgttgttcaggctggtctcgaactcctgagctcaagcgatctgcccatctcagcctcccaaattgctgggattataggtgtgagcaaccgcgcccagccaaaccccatattaagcaaaaacttgccaagagatcttttaaaaggcaaggaatgagtatggctactgtgtaattatctgaagggttttttttgtttgttttttggttttgtttgtttgtttttttgctggccttttagtttttatgtttaattacccaagcccctaaagcattaaagaacttcacctatctaactttgtagttcttttactttatttatttatttatttatttatttatttatttatgagacagggccttgctctgtcacctaggctagagtgcagtggcacaatctcggctcactgcagcttctgcctcccgggttcaagctatcccatctcagcctcctgagtagctgggaacacaggcacgcgccaccacgcctggctaatttttgtattttcagtagagacagggtttcgccatgttgcctaggctggtcttgaaatcctgggctcaagcgatcctcctgcttcagcctcccaaaggactaggattacaggcatatgccactgcgcccggccctttactttcttataatagaaatttaatggagttaatacctgtagatagatgtaaaggtattgttttagtcatctacagaaagtactaagaaagattaaaacaagtcaccatagtcttatggttgtcattggcgaaagcctgtgtttgacctgactacaacatgataatttgtaggataattctagggaatctcgtacctggcagcaatttttttttttttttttgatgtaaactcttccactaagtagaaataacagataaaattgtgagggggagggagttgttttgaagctgttgaagtttttttttaaattattattattttttatttttaacctaatgacaagcccactaaggataccattcttaatatctggtctgataagtggattaattcaaatttgtgctaagggtttgaattgatagaaataaaactctggacaattttttttagggtctagattattttgaaatccccaatagggtagtttgttatcttttggttacattttaggtcgctcaagccctcagttagaccctttgagaaaaagcccaaccatggaacaagcagtgcagaccgcctcagcccacttacctgctccagcagctgttgggagaaggagtcctgtatcaaccaggcctttgccatctgccagccaaaaggcaggagagaatcaggagcacaggcgaggtagaactttagctgtttactgttccttaattgactgatcaatgttttccactcactttattttcattagaaggatttacttcatgtgaatgatcccagaaaattaaactgaatatgatagaatgtttggtctttcaaatttgactcaaagtggtggtggtgtgggtatagttttttgggcattgcacaggctttgttttgggttttttggtttgtttgtttgcatttctaactatggaagtttttgatgatgtaccctgagttgatttggcactttgcatgtcttcttctgtagctgaagtacacaaagtttcaaggccagaaaatgagcaactcagaaatgataacaagagacaagtaggtaagttcttggatctaaaagtcatattctatgcttctcaacagggagaatattttaaatatatgatacataattactataaaaaaatgaaaggcgggggttgtgactgtaaaggaggagcacaggggagtgtcactgtggtgacagaacagtcctttatcttgattgtggtggtagttttgcaaatctatatatggtagaacatcatagaactatgcataaagacataccaaaaaatgagtacatgtacaaactggtgacatctgagcaaggtctgtagtttagttaattagattgtgcctgtgtcggtttcttggtttcgataatgtaccataattatataagatgtgactgttggagtttgggaagttgggtgatgggcacaagggacgactctgaactagtttttcaatttttcttttctataattactttaaaataaaaagattttttaaaattttacttttctgggcccggcacagtggctcacgcctgtaattccagcactttgggaggccggggcgggcggatcacgaggtcaggagctcgagaccagcctggctaacatggtgaaaccccgtctccactaaaaatacaaaaaattagccgggcgcagtggcgggcgcctgtagtcccagctactcaggaggctgaggcaggagaatggcgtgaactggggaggtggagcttgcagtgagccgagattgctccactgcactccagcctaggcgacagagccagactctgtctcaaaaaaaaaaaaattttacttttctggaaaaaaattctacttagtggtaggcctttttttttctgagatggagtttcactcttgttacccaggctgtagtgcagtggtgtgatctcagctcacggcagcctccgcctcccgggttcaagtaattctcctgcctcagcctccctagtagctgggattacagccgcgtgccaccatacccagctaatttttgtatttttagtagaaacagggctttgccatgttggccaggctggcctcaaactcctgaccttattttccacccacctcagcctcccgaagtattgggattataggcgtgagccaccgcacccagccaggcagttatcttttaatatgttcttgagtatttcctgctagaaggatttgttcgtttatatttacattttcctatggcttctacttttgtggtttttatgttttgtgtcagtttcaagttaggattataaaattggttttcattgttttctatgcctttgggaatggaattttcttcatgttacaagtttgaaacgtttcctcattaaaattaagcccagaggccaggcacggtggctcacacctgtaatctcagcactttgggacgccgaggcgggcaggtcacgaggtcaggagtttgagatcagcctggccatacggtgaaaccctgtctctactaaaaatagaaaaattagctgggtgtggtggcacacgcctgtagtcccagctgctcgggaggctgaggcaggagaatcacttgaacccgggaggcgaggttgtagtgagccaagatcgtaccactgcactccagcctgggcaacagagcgagagtctgtcaaaaaaaaaaaaaaaaaaaaattgagcccagatcctgtttttgaatcagttgtttaagagctgtagttttcttttatgattattgatttaataaggttttatattttctttatctgttttgtaatatataacattctaaaatcattcattttattaatattttcaaatttattaatggaaaataaattataattttacaactcttctaaattaaaaagggaatgtataatctaccttatttagaaaatgattgaaaaatgatctttcacttaattttagaaatctagatatgatatttttagatgtatatgtactcttctctacatttatatatatatatatttttatatcccccccccccgtgttttttttttttttttttttttttttgagacagagtcaacctctgtcacccaggctggagtgcagtggggcacgatctcagctcactgcaacctccaccgcccgggttcatgccattctcctgcctcaccctcctgagtagctgggactacatatgccatggaatacagaattttgtttaatttgactcattatattttaccctttttattcagaaaaagagagagctcccctcccaaaataaaataactgccatactatctttcattgcccttcaaaactcaccccaccaaagaggttcattaacagaacagtgcatattcttcccgattttttttgtagattttacagacacagacatctatacccaaaacctttttttttttttttttttttccccctggagatagaatctcgctctgtcacccaggctggagtgtagtggtgcgatctctgctcactgcagcctttgcctcccgggttcaagccattctcctgcctcagcctcctgggtaggtgggattacaggcatacgccaccacgcctggctaatgtttctgtatttttagtagagatggggtttcaccttgttggtcaggctggtctcgagctcctgacctcgtgatccgcccgccccggcctcccaaagtgctggggttacaggcgtgagccaccgcgcctggccccaaaatatttttttttaagacagaaggatcatggtgtaattctggcttgtggccgaggcatttttaatagtagaggtgaatgtttcaaacatcctacttatctagatttatgtctggatatgctgctgtggggttttgtggtttgttttctcaaacccaggcagtttgccaaacctcagcaaacagcgcaaacctatcttgttaccctgtagtcacttctcatccttgtcagtatgtgtggagcatttcacgcaattgtgatcattaaactcatactggtttctgttctgcgtttttcagttaacatcaaatattcttcctctgtttttttcttgttagtcatttttcttgtgttggatatttgggttcccacgtttttcactataaattatgctgctttgtattgctttatcatgtctcttatgattggctgaaattttactgtgttatagaggagagagaatgtgtagatacaggaaggcttgaataatatagagccatctggagagacacagtaaagatggagtaggaagtgttttgagtcagtaaggattggtgcttgtctgttttttatctgtgatgtggaaataacacctattttcttgcaatttgtgccgattagtgtttatttttcttactataaatcttggttcctgttattctttccataaaaggctttctacattttgagaacccactgtgtgtctggcacttcagtttgccggtgttggggatatagcagtaaggaaaacaaagcccctgacctcaaggagcatacattaatttagtgcagaagcctccacacttgcctggctgtatactctgtcagtaacacatgtgagtgtggactccataaatacaaatgtttagaaattttgtgtgagctattctcagtctacatattaaatattagtgaaacttaattttttattttgtataaaaaatacaaatacaataaaatatatagagagacctgtaagcatttctgttgttgactgttgaatctaaagagcacaatagcaacatctgtgctaaaccagctattacatattgaatgtcctttgtatatattctttattatcatagctccaggtgctccttcagctccaaggagagggcgtgggggtcatcggggtggcaggggaagatttggtattcggcgagatgggccaatgaaatttgagaaagactttgactttgaaagtgcaaatgcacaattcaacaaggaagagattgacagagagtttcataataaacttaaattaaaaggtaagctttgatttttcttttcagaaaataatcttatttgatctgtgaattacagatgtttctcagattaggtgtttttatgtaattcagattagctgtcttgacttttctgatatgtgcttttgttcttagaagataaacttgagaaacaggagaagcctgtaaatggtgaagataaaggagactcaggagttgatacccaaaacagtgaaggaaatgccgatgaagaagatccacttggacctaattgctattatgacaaaactaaatccttctttgataatatttcttgtgatgacaataggtacagtttttaagctgttcttttatcttatgatattgattgaagtgtaaaatggtttcatgtaaattcacgaggtttaatgaatactaccataattgttttgttttgttttgagacagtcttactctgttactcaggctggagagcagcagtgcagtcacagctcactgtagtctcaagctcctgacctcaagcaatcctcccatctcagcctcagtaaaggggactacagttgtacaccaccccacccggctaatttttttcatttttttgtagagatgggggtctcgctatgttgcccaggctaatcgtgaactcctggcctcaagatcagcctcccaaagtactaggattacaggcgtgagccaccacacctggccataattgattttttaatgttttatttgctaaaagaaaatatatactaaagttctaaattattcattcaaaagaagaaataaccatatacttttgtttaaggatatattcatatttgaatattagcaattaaaacaagcatttaggtaatgtctaagtaggacctttttttcacccctgtatgttacagttcaaatgaagccagaaccgaagtgctaatctactttgaagtttgctggtaccataaaactgccagattgtagtaaatgtgggtccagaaaattggcaaattattgagaggttaattaaaggacccagtgtgaggaactaacagttctagaggttctcctgcccaatccaaattgtcattgtccttgtccttttcctggctgaagtttggtgccctctggtggcagttgtttgcttcaatataaacatggatggacataattctgagtcccacgattggctggatgacagcagcaataattcagatacttcttgggttacttggtatcgggtccatagattgggccaggaacataatggggacctaagggcccaccttccatctcctagcttcccaagacaaggcctccctgtctgactttaccttcttttcccttggggctgagtggaaagcgaagtcaattaccaatctcattatatctgaatttccattattttggagctgttactatgtttatcaggtgtatttgcaagaaactaatgtcagtcatgtgttcacatgaagtttaacagaatattacaggaacatattgaactcatatgccatgaacaactcgtgataacttagataagatgcttttttttttttttttttgagatggagtttcgctcttgtcacccagactgtagtgcagtggctcgatctcgactcactgcaacctccacctcccaggttcaggtgattctcctgcctcaaccccccaagtagctgggattacaggcacctgccaccatgcccagctattttttgtatttttggtagagaatgagtttcaccattttggccaggctagtctcgaactcctgacttcaggcgatccgccccctcggcctcccaaagtgctgggattacaggcgtgagccatcacgcctagccaagatgcttatttctaattagctttagtaattacttaggcttaatttgggagtagcactgcatattttggctgagggatattcttttaaacctgatatgctgaagattatttgcttttataatagagaacggagaccaacctgggctgaagaaagaagattaaatgctgaaacatttggaatcccacttcgtccaaaccgtggccgtgggggatacagaggcagaggaggtcttggtttccgtggtggcagagggcgtggtggtggcagaggtggtaccttcactgcccctcgaggatttcgcggtggattcagaggaggtcgtgggggccgggagtttgcggattttgaatatagggtaagtgttactgttaataaattctttggggttgacatgcattttacaagactcaaaacatttttacttgtttttgttttgggtgaattgttttgaggacattagaataacttccattttgacttttcagtagaggatatacgtgattcagatgtatatataaagacattatacaaaaaaagacagtatagtatcacctttatttcatgttaacagaatatacttttaacacccaaagagtctatctaggaagcacatactcccagaatggaagggcaagctttaacatttaatagcagttaacatttatatagtatttaccaagtaacaagacattgttttaaatatttttttacatattaacttatttaaactgcacatcaactctgtgaggtaggttctattattatccccattttacaagtgaggaaatgggtatagagatattaagtaacttgcgaaaggtcacatagctagtaagtgatggtgctgggtgttgagcccagcaagttgtttcctgagtcagtactcttaatttggttttgttgaaaattcactacattttccctggttttctcctttcaccatgaaattgaaaatgtttcgatatattggccttcaggagctactgctagagaattctgtaactctgtatagtagccttatgtgtataatgtagcttttgacaggtgtctgtaaattaagtcagcatagtaactatctcagttaacagtaaactatcttagtttattgattttagaagtagtggagaggaagggctataacagaaaggaccaaaatcttgtaaagagttccacttgtaatagcaacaggcagctggaaacagaaagacctgttagcaggagttccattgcccagtacttaaaactggccattgttgagatctctctggaaagagatcagtattagtggcttttggacctgctctattaattttaatgcttttgatattgtgccatcacagccaagactgccaaaaattatactcaagtcaccagcttatgccatccagccgttggtggccttatgtagttgcgggacttctgacttgcaaaatcaccttcccagctaggagaatctgtcttaggaactccagaatagccctcgcttatcactgttactgcccttaagtttgccagtgacaccttgcttacagaattcagcagtagtattttcacaaatattttatttgccattaactcctctgcaatatttgacactgaccaaccacccaatttggggtctttcttcctagtctttaaaatactcttctaggttttcaatttatactcttcctaattttttaatactcttcattcttttttttggggggtggagggtgtcagggtcttgctgtgtcacccagactggagtgcaatggcatgatcataagtcactgcagcctcaacctcccaggctcaggcagtcctcccacctcagcctcctatgtagctgggactacaggcatgcaccaccatgcccagctaatttttaattttttttgtagacactgggtcccactctcactatgttgtccaggctggtcttgaactcctgggcttaagcgatcctctcacctcagcttcccaaagtgctgggtttataggtgtgccatggtgcttgttccatcctcccttttgtaagcctgtcctggaccctatgtgtttctgcaccgcatctctatctgcactgtttgctgtcagcttaaccttcctcagactgatctcatcatcttccttctctcctgtcatctcagctctgcctcctcccagtgttccatgttggctcatggtatactgcccaggcactagaggtatccatgattgtggcctgttgccatttattcctttgagatgtccctgtcaactaccatggtaacccaccagttgggcttcagaccttcgtctctctttaccccactttaaggcagatcagctacattttgaacaacctgtgacaactccttgttgaagaccacattgagtcagcttggtctgagaaaaagtacatttaaattagacttggatccagatgagaataatagcagtagttactagtatgacctttcagacccttggttttgacatttgtgaataaagagttgcaccatttattctgaaataacaccttttaaagatcattaaactttcagagttggaaaacatctgagaggtctgacctggttaaaacataaacctcttctgcagtatctcttataggggctgggagcttactcttcccaagggcatccatcccaccccagggatgttctaactgttacaatctcagctgggcgtggtggctcacacctataatcccagcactttgggaggctgaggtgggcggatcacctgaggtcaggagttcgagaccagcctggctaacatggtgaaaccccgtctctaccaaaaacataaaaaaaattagccgggcgtggtggcacacacctgtaatcccagctactcgggaggctgaggcaggagaatcattgaacctgggaggcagaggttgcagtgagccgagatcacgccactgtactccagcctgggcgacagagcaagactccgtctcaaaaaaaggaaaaaacaaaccttccatgcagtaactgtgtgtgctccatgtggttactaatacaaacatttttttgacaccatgtcacactgtttatcattttgagccttttgtaaaactcgtatcacatatattgcagaattgaaaatgcattgtcatagttacctccatgcatctttgtctacgctcctgtatccttgacagatagtccagcctctgcttaggtgttgccaggagtgatggactcagcgaaccctcaggcatggcccagtgtttaggaggctcagttgtgacattgtagtccctgctcttcttaattgtgtgaggatcccacttgatatatttggcctcattcctcattaccctttaacctatctgattcaagcaagctgcctcatggttatctcacatacacattgtgcttgattccaactccatccccattcatttaccaaatatacagaattcttcagatatgccaggcactatgttgagcattggtgctgaccgatgtaggcccagcccttttgatgtttacattttggtgggagacagacatagctaaaagtcaggtcccccctttcacttatcctttacagccttgcccaagttttgctctgtcttctcttccttcctacactgatttcctcctcttctgacctgtggctatctgctttctttggcacacattttaaatacactgacattccctattttttgtatttagttttgttctgcatcaccagctagatgagaacctcttggctttagtgaatatgtattctacttttctttccatgacaacactcagctcaacatggagccatagtgggcttgaagtaattgcttgtcatgttgattaggaatttgccactccagccttcagtgagaccaaaggtctgtcaatgtagctagcctttgattgttcattccagagttgaataatcctttcatctgccactagagccccgaacccagcagccctacacctcctaaatcataaaatcatttcacctggcacctttaaaggtagaaaatggtgagtgatcactgtcacataaaggagatttaccactgaagattaaacttgtatctgaaacatctaacacttcctcccagagatggacatggatgacatttctgcagccttcatgaaatgagttggctttattttttgtgctatattagcatgagtcattgtggtttgggggtaagcataaatgagcttggttgtttaatgaaaacatgggtaaagataaaatcataaagttttagaatccttaaaagaatcagccaaactagaatctctacgctaccacactcacattagatgataaggaaactaaggaccccaagaagttaattgtcatgattgaggtacaagctaacaaatccaaaactcactctcttgacttgtggcctgattttccttaagggtaatattgtaaatataggccagtgcaatggtgtacacatgtaataccagcattttgggaggccagggcaggattgcttaagcccaggaattcaaggacagcatgggcaacataaggagtccctatctctataaaaaagtttaaaaattagctggagtggtggcacatgcctgtagtcccagctactcaggaggctaaggcaggaggatcagttgaacctgggaggtcaaggctgcagtgagccatgatcgcaccactgcactccagcctgggtgacagagcgaggcctgtctcaaaaaaaaaaaagaaaagaaagaaatataaccttatggtaagtttggttgtatggtgttttccccctcccaccgcccattcttttttgaggtgagaatggaaatcaggactagcaataataatgtaaccagctcctgttttatatgctgctgtcagggaggttaagccaccatggtgggtgataaaaatcacatctgtgtttcctcagatggggttcaaagacaacaaggtgtctgaatgactcagcataatgctctctctcctctccccctttcattttctcctttctccctctcctgtccccatctctttctctttttttttttttttttttttttacctttcagaaaaccacagcttttggaccctaaaaggtctggattgatcgtactgctttctgaaaggtaaaaaaaacaaatactttgggaggtgtgaaggttggctttgtgggggacagcaggttcatcttgtagctcattgctgtcaacttatgccataccatatgtatttcagtttaataacggggtgcaaatgttttggtgttgtatacacagatgaagttaagtctcacctaggaaatgtctgtttctaacagttggggtgagaatcagcagtaaaaaccaggtatatggtagcagctggtctagaggaaaataaaagcccttggctccagccctttgtacaggcctttagtttagggtcagtctctctggaaatcttgagatttttattgcttcctcactggttactttttaaaaattccccagtcagctttctacttttcagagcttatttcagatttaagagttatccttgtaaaattgatttttaaaccattgcttcctcctggcatgaaattttggagagaaatgttatactgactgggtattttattgcttagtaaagacatcaaagacttggggattttatgaaacttgtttcaaagtatgttgacagttgtatttgatgagtttgactattgagttgagggtttaagtcctatcactgcttttaaaaaattattagggagaacaaccaaagatgaggaagtatgcctgtattttggggtggggttcaccactgcattaacctctactgactggaagatgcagtcaacaatgaggtactactgagtatggaagttatagaaggagtttcgtggaaatgagtgagacaggtttttctatgaaagtaaaagtgggggagtatatttaaagataatttaaaataaacttgagcaaagtaaaaagaaaataatacaccaataatttggaacatgagctaaatttttttttcttttttagaaagacaacaaagttgctgcatagtctacaaacaagtctctgaaaataggtgaatttctagctcttcatggtcctgaacattgatttcagtctttgcaaagaatgaagaagtgaattcgctgtacatttgtcaccagcactgggtttttgttttttgtttgtttttccgcttaatttcaaagataaaatgcagttacttttgggggtggaaggctcatcttaaaacatgagcattaaatatatttggaatagcagaaggttaagtaatttcttatgtatagttaaactaaagcagtacttcagtgggacttaacaagtattttttcatcactgaaaggttttttttttttatcactaaattgtatttggcaattgcaagttgcctgcagatagggccgtgatactgtgttttgagccacagaaggttgtgtgtgtgtgtgtgtgtgtgtgtgtgtgtgtgtgtgtatgtgtgtgtctttttcctcctttcttttggggaatcctgtaatatgaggtagcttatttcgtcaattaattagggtgctggatggtagagaattttgtcagtcaactatgtacacacagtaaatactgtttcttaggcaaaggtaacttttttatatagttgtaaaattccattatattccattgccaaagaaacattaagaactttgtatagctgtataaaaagcaactaattttttaaagaataaacattttaaagtcagcaaacatactgtgtccttgcagaagttgatgtgctgagcagcagccttatgggtgggtctttttttcttagttttccaggcttaacatttttgattttgttttttaatgtttggaacataaatgaagatttgatacattatttcattatctaaaaaggattaattattcatgctcattgtaagaacttcattttgtagcaaatggcatatcacaggatctgtccagataatcgatattttcagtatacaaatgtaaataatcacagatgagaatgtacttagctgtattttcaaataagtaatcttccccccttttgtaggactttaaaactaggcatcaatgaacctgtttttcctattatgcctggaatttagtcatgataccttgactcattccatcatatttcaagaggattcagagtgctagaaattattttggtagcctgtaacacacggcaacactggtccttgggcctatgatgacccacagatgactcagtatagagttcattgctaattataaattactagtgaatctttttgatattttaagctctagtgggaaaaatctggccacttttgtgtttttatgaaggccatggaataaaaggatccaaagatttaaatatttttatctaatattttgattgttttcttaactttctccttaaaacattcagtagtgataaagatatagaaactgcactgtaggagaattggaatatttaaggctggttgacattttttattttcattttatatcttttgtatagctctacaaggcagtgttttgtaatttggtttcattatgaagatccagtacttggcagccatagtttagacaatattgttcagtgctgtttgcttgcatgttaacaacaaaaccttttagaggacccacaaatcatgatattgaacacagttccgaggcattcagagcatcagagcaagtaccatggcaatacatgtgtagactgttggagatgtcccgggccaatttcaagaaagaaaactgtaaatactagttctacttgctctgaaattatgagtttatgcgttttcccagccctccgaatcactgactggggcgttttgtgccccagcaataactggcagcatggcatacctgcagtaccccttacaatattaaagcaaagtttttattctaaaacagaataaaactgttcaataaaaaatgctcgtcaaagttctttctctttaaatagtaacattctgtttcagtaggaacataatgaaaggaatcttttaaatggaagagcggaattataatgtttgtattccctgtaataactataaatcagttactttatttctaagattgagttattgttgcagatgtttagggaaagctaaaagccccttccttcccctcctgtgtgtaaataaaatacttctgagatca

SEQ ID NO: 1561 - DNA, 57069 bp, Homo sapiens; identical to SEQ ID NO: 1560

SEQ ID NO: 1562 - DNA, 2396 bp, Homo sapiens
caggagtggggtcagcaggaggaactctacagctatgggagaacctgcgttcacctcttttccaagcctgcctgttctggtgagtatgggatccttattgactattgaccaaaataatgtccatttgtattcctttttctttctgtaaaacatcttcacagtttagcaagttgttctcaaaactagatgctatctcgtggaaacttataccctaggtgttaatatttgttgagtaatactcaagtaatattcaaaatattcaacaatattctaattttttgttcacggagctatctggggataatagccctgattttttaaaagtccaacaacatcactaagaaggaaaagaggtattacttggccttgcagtcttcaaattgtctctctctctggaaagttcttgaaccagaaattgcttggtccctttaaaaaaaaattttagttctctggttaaatatcatgattggttagtccttccctaaactcactgtcatgattcattgtagtgaatttctttcttttctgtttctctgtttctcctccctccatccctctctgtctctcccttcttcttcatcatggaacttaattatatctgataccctatcggaaatttgtttttagtgtgtttattatgtcttccttctcaccaagatgaaaatcaacagagtggtgatttctgcagtttacttctggatcaggggttctactgcacagcttggcacatcataagtgccctgtaactaaggagactaaataattttccctccaaaggggaacaccttgggtcgtgtaaggggtagtattaatcttaatgccaggacaacagaaatgaaatgagaaggacagaaatgaaggctttatgtttgtatctgaaacagctttatgagactagagtcttccaattgatttagagcaagaaaggatttcaaatcttaggaggggcttaatcatctttctcagtatgtcatcaaaagattctctcatggtgtaactctagttaattgagcttattagaaacagaaagcaacatggtgtttctgaggtttttcttcatgagcaggaggtgttcaggtgaaggtgggatctgggtgtggcagtgagtatttaaggtggcgagtgcaggatttctttggaaaccagagagtcaaggagctatgaaaatgacgttgtgtcctgaagcacagcagaaagagatacagagaagcgtgaggtcttggtgaacagggaagtctgggatcccggtgtcctgttggggatgggttaggaggcaccagcatctgtgtagctgacagtggcagggaagagaagagaggggtgtcctctgaggaggatgaggagggacaaggtctggaactgaccctgggtcatgaccttgagcatttagtccttgactcgcatcagcccgatgaggtcccaggacccagtgtcaatgcctggagctcctgccagcagcatcagggtcacacggagaaatgcagactctaggttccaccccagacttacttgggttcaggtccacatatctgacttcagcaaaccctgcaggtgctgaggatgtacactgccatttgagacacatttccccagaaagagaggctggtgggaagattccactgagctgagagaagccccccacagctgatcttctcctgtctccatttggttgaaatttcacattttcttttcttttgaaaggggaagctcaaaaggaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcagcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcgggcagaaatgctgacaggtggatgaagctcagtcttgggctttcggtccctttcttttaatgcccatcctcattcctactctgaattgtcacacttttcccttccccaccagttctttaataaaagtatttgaaaggc

SEQ ID NO: 1563 - DNA, 2430 bp, Homo sapiens
tgttgcctttcaaatacttttattaaagaactggtggggaagggaaaagtgtgacaattcagagtaggaatgaggatgggcattaaaagaaagggaccgaaagcccaggactgcgcttcatctacatgtcagcatttctgcctgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggctgcgcacacgctcagcaccagccctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgtttcttttgagcttcccctttcaaaagaaaagaaaagaaaatgtgaaatttcaaccaattggagacaggagaagatcagctgtggggggcttctctcagctcagtggaatcttcccaccagcctctctttctggggaaatgtgtctcaaatggcagtgtacatcctcagcccctgcagggcttgctaaagtcagatatgtggacctgaacccaagtaagtctggggtggaccctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcctgcactcgccaccttaaatactcactgccacacccagatcccaccttcacctgaacacctcctgctcatgaagaaaaacctcagaaacaccatgttgctttctgtttctaataagctcaattaactagaggtataccatgagagaatcttttgatgacatactgagaaagatgatcaagcgcctcctaagatttgacgtcctttcttgctctaactcaattggaagactctagtctcataaagctgtttcccccacaaacctcatcagtgcactttccattttaaagcctttgtttctgtcctcctcatttcatttttcgttgtcctggcataaagattaatactaccccttacagtacccctggcataaagattaatactgacccaagatgttcccctttggagggaaaattatttagtccccttagttacggggcacttatgatgtgccaagctgtgcagtagaacccctgatccagaagtaaacttcataaatcaccactctgttgattttcatcttggtgagaaggaagacataataaacgcactaaaaacaaatttctggtggaatatcagatataagtaagttccatgatgaagaagaagggagtgacagagagggatggaaggaggagaaacagagaaacagaaaagaaattcactacaatgaatcgtgacagtgagtttagggaataagcaactcatcatgaaattttaccagagaactaattttttttgttttttgtttttttaaaaaaacggaccaagcaatttctggttcaggagctttccagagaaggagacaatttgaagactgcaaggccaaatcatacttcttccctttcctagtgatgttggatttttaaaaaaaaattcaaagctattatccccatacagtttcatgggcaaaaatgagaatactttgaacattattcaacagatattaccacctgaggtataactttccacaacatccagttttaagaacaacccactgctaactgtaaagctgtcttacagaaggaaaaaggacacatatggacattcctgtaatcaataaatatcccgtactcaccagaacaggtgggctcggaaaagaggtgaacgcaggctctcccatagccgtagagtttctcttgctgaccccac

SEQ ID NO: 1564 - DNA, 2430 bp, Homo sapiens
tgttgcctttcaaatacttttattaaagaactggtggggaagggaaaagtgtgacaattcagagtaggaatgaggatgggcattaaaagaaagggaccgaaagcccaggactgcgcttcatctacatgtcagcatttctgcctgcctggccagcctgtctgcctgcaaggccttggccagtctctccctggctttcttcaccctcctggcctgtctccggatatctgcaggagtcaccaattggccagagaggggcggtgggagctgacaacccattcctggggttggcccccctgccacagctggaaaccgcccaggggtgggctcaagcgggatgcgcacacgctcagcaccagctctgtccagagattcaccggccgtccccggtgcaaggatacttaagacgctctccaaatgcagtggacttgaaccttctccttggctgctgcagggctgcagggcctgcagtctccggtaggcgcagagttgctgcggcttctccaggtgctcgtccccttttctgcgtctgacctggttgtcaggatgagacctgatccttgtcaccggcctccggaagatgcagctggtgagtctcatggggagagcagacctcgcagctcgtctccgatgggccttggccatgtggatttctcgtttcttctgtaaagcccagggcatcatgtttcttttgagcttcccctttcaaaagaaaagaaaagaaaatgtgaaatttcaaccaattggagacaggagaagatcagctgtggggggcttctctcagctcagtggaatcttcccaccagcctctctttctggggaaatgtgtctcaaatggcagtgtacatcctcagcccctgcagggcttgctaaagtcagatatgtggacctgaacccaagtaagtctggggtggaccctagagtctgcatttctccgtgtgaccctgatgctgctggcaggagctccaggcattgacactgggtcctgggacctcatcgggctgatgcgagtcaaggactaaatgctcaaggtcatgacccagggtcagttccagaccttgtccctcctcatcctcctcagaggacacccctctcttctcttccctgccactgtcagctacacagatgctggtggtgcctcctaacccatccccaacaggacaccgggatcccagacttccctgttcaccaagacctcacgcttctctgtatctctttctgctgtgcttcaggacacaacgtcattttcatagctccttgactctctggtttccaaagaaatcctgcactcgccaccttaaatactcactgccacacccagatcccaccttcacctgaacacctcctgctcatgaagaaaaacctcagaaacaccatgttgctttctgtttctaataagctcaattaactagaggtataccatgagagaatcttttgatgacatactgagaaagatgatcaagcgcctcctaagatttgacgtcctttcttgctctaactcaattggaagactctagtctcataaagctgtttcccccacaaacctcatcagtgcactttccattttaaagcctttgtttctgtcctcctcatttcatttttcgttgtcctggcataaagattaatactaccccttacagtacccctggcataaagattaatactgacccaagatgttcccctttggagggaaaattatttagtccccttagttacggggcacttatgatgtgccaagctgtgcagtagaacccctgatccagaagtaaacttcataaatcaccactctgttgattttcatcttggtgagaaggaagacataataaacgcactaaaaacaaatttctggtggaatatcagatataagtaagttccatgatgaagaagaagggagtgacagagagggatggaaggaggagaaacagagaaacagaaaagaaattcactacaatgaatcgtgacagtgagtttagggaataagcaactcatcatgaaattttaccagagaactaattttttttgttttttgtttttttaaaaaaacggaccaagcaatttctggttcaggagctttccagagaaggagacaatttgaagactgcaaggccaaatcatacttcttccctttcctagtgatgttggatttttaaaaaaaaattcaaagctattatccccatacagtttcatgggcaaaaatgagaatactttgaacattattcaacagatattaccacctgaggtatcactttccacaacatccagttttaagaacaacccactgctaactgtaaagctgtcttacagaaggaaaaaggacacatatggacattcctgtaatcaataaatatcccgtactcaccagaacaggtgggctcggaaaagaggtgaacgcaggctctcccatagccgtagagtttctcttgctgaccccac

SEQ ID NO: 1565 - DNA, 2429 bp, Homo sapiens
gtggggtcagcaagagaaactctacggctatgggagagcctgcgttcacctcttttccgagcccacctgttctggtgagtacgggatatttattgattacaggaatgtccatatgtgtcctttttccttctgtaagacagctttacagttagcagtgggttgttcttaaaactggatgttgtggaacgttatacctcaggtgttaatatctgttgaataatgttcaaagtattctcatttttgcccatgaaactgtatggggataatagctttgaattttttttaaaaatccaacatcactaggaaagggaagaagtatgatttggccttgcagtcttcaaattgtctccttctctggaaagctcctgaaccagaaattgcttggtccgtttttttaaaaaaacaaaaaacaaaaaaaattagttctctggtaaaatttcatgatgagttgcttattccctaaactcactgtcacgattcattgtagtgaatttcttttctgtttctctgtttctcctccttccatccctctctgtcactcccttcttcttcatcatggaacttacttatatctgatattccaccagaaatttgtttttagtgcgtttattatgtcttccttctcaccaagatgaaaatcaacagagtggtgatttatgaagtttacttctggatcaggggttctactgcacagcttggcacatcataagtgccccgtaactaaggggactaaataattttccctccaaaggggaacatcttgggtcagtattaatctttatgccaggggtactgtaaggggtagtattaatctttatgccaggacaacgaaaaatgaaatgaggaggacagaaacaaaggctttaaaatggaaagtgcactgatgaggtttgtgggggaaacagctttatgagactagagtcttccaattgagttagagcaagaaaggacgtcaaatcttaggaggcgcttgatcatctttctcagtatgtcatcaaaagattctctcatggtatacctctagttaattgagcttattagaaacagaaagcaacatggtgtttctgaggtttttcttcatgagcaggaggtgttcaggtgaaggtgggatctgggtgtggcagtgagtatttaaggtggcgagtgcaggatttctttggaaaccagagagtcaaggagctatgaaaatgacgttgtgtcctgaagcacagcagaaagagatacagagaagcgtgaggtcttggtgaacagggaagtctgggatcccggtgtcctgttggggatgggttaggaggcaccaccagcatctgtgtagctgacagtggcagggaagagaagagaggggtgtcctctgaggaggatgaggagggacaaggtctggaactgaccctgggtcatgaccttgagcatttagtccttgactcgcatcagcccgatgaggtcccaggacccagtgtcaatgcctggagctcctgccagcagcatcagggtcacacggagaaatgcagactctagggtccaccccagacttacttgggttcaggtccacatatctgactttagcaagccctgcaggggctgaggatgtacactgccatttgagacacatttccccagaaagagaggctggtgggaagattccactgagctgagagaagccccccacagctgatcttctcctgtctccagttggttgaaatttcacattttcttttcttttcttttgaaaggggaagctcaaaagaaacatgatgccctgggctttacagaagaaacgagaaatccacatggccaaggcccatcggagacgagctgcgaggtctgctctccccatgagactcaccagctgcatcttccggaggccggtgacaaggatcaggtctcatcctgacaaccaggtcagacgcagaaaaggggacgagcacctggagaagccgcagcaactctgcgcctaccggagactgcaggccctgcagccctgcagcagccaaggagaaggttcaagtccactgcatttggagagcgtcttaagtatccttgcaccggggacggccggtgaatctctggacagagctggtgctgagcgtgtgcgcatcccgcttgagcccacccctgggcggtttccagctgtggcaggggggccaaccccaggaatgggttgtcagctcccaccgcccctctctggccaattggtgactcctgcagatatccggagacaggccaggagggtgaagaaagccagggagagactggccaaggccttgcaggcagacaggctggccaggcaggcagaaatgctgacaggtgggtgaagctcagtcctgggctttcggtccctttcttttaatgcccatcctcattcctactctgaattgtcacacttttcccttccccaccagttctttaataaaagtatttgaaaggcaaca

SEQ ID NO: 1566 - DNA, 44751 bp, Homo sapiens
tgatattcaatatagcatctttattaccacagaaactcatttatgtccttaatcattgtttaatataatatataagcatgtttaacacaaacatatcaaggatcgggctggaatcttttccattctatagaaaagcactaaccatccattaaagcaggtagctactttcagagcatgatatgagctgcaaaaaattgccctgacttatgccgcccccaacacaaccactcaccatatctaaaattacacccttgaagacattcattgtggttatggtagcatctaacaaagctgttcctattccagatattcggactgagaattccacaataaatttgagatacactcagttaaataaaaatgtctttactaaatctttggcaaactgatcatgtatactttgaattcctcaaaagtagatttttattttattttatttgagactgagtttcactcttgttgcccaggttggagtgcaatggcaaaatctcagctcactgcaatctccatttcctgggttcaagcaattctcctgcctcagcctcccaagtagctgggattacaggtgcaagccaccacgcccagctaattttgtatttttagtagagacagggtttcaccatgttggccaggctggtctcaaactcctgacctcaagtgatctgctcgccttggcctcccaaaatgttgggattacaggcgtgagccaccgtgcctggccaaaagtagatgttttatgttttgcttcatttgcctattttcccaagaaatctttttttcaaataccatcgagaattaatattccttgaagcaaacttctggagaatgttgaatttaggggtcaaacacaggctttctggaggtatttggtgcttgggaaaagaaacactgacctattagcaaagatagattttgtaataaattctaaataaactttatttagaattgtgaaaaatagaatcttcataatgaaggtggtctagaatttgctttcagaaactatcttcatctaatttttattaggattattttaccttgcagaattaattggtaaaatctttaggattatctattccttaaagtttttataagtatcagattttttaaacagggagttcacacacacacacacacacacacattttttgttaatctatttgggttatacggtgagttaattgtaaaacatattccttttgggggaaaaatgcaatcctacatttttacttgtactggaatgaatatacacgtttgtgcatgtgtgcatgtatagttttaccatattatgtttattatttttgagacaggttctcactctgtcacccaggctggagtgcagtggcgtgatcttggttcaccgcaacctctgcctcctgggttcaagcaattctcctgcctcaggctccccagtagcttagattacaggtgcccgccaccatgacaggctaatttttgtatttttagtagagatggggttttgctatgttggtcaggctggtctcgaactcctgacttcaagtgatccacccacctcggcctcccaaagtgctggggttacaggtgtgagccactgtgcccggcctagttttgccttataattttaaaaatctgcttgatataatctagagttgtgtctcttttatcatcattaatactctaaatgtattatctttcattttctcttccttgattataactgccaaaatctaatcactattaacattgaatcaagtctaatattctccattctcttaatttctactttctactgttacttggctgttcctttttttttttttttttttttgacagactcttgctctgttacccaggctggagtgcagtggcgcgatctcaactcaccacaaactccgcctcctggattcaagtgattctcctgccttagcctcccaagtagctgggattacaggcatgcaccaccatgcctggctaattttgtatctttaatagagatggggtttctcagtgttggtcaggctggtctcaaaatcccgacctcaggtgatccacctgccatggcctcccaaagtgctgggattacaggcatgagccaccgcacctggccacttggctgttctttacttgggttggttttattttgttgtttcctttttcttgacggaaatacttattcattccctcaacacattcatctgtgtgacaggcctggtgttgctgctgtgggtaagtgaagaagatgaagactgtatccacaaataagatttccttaccacattacagggcattaatttgtcactgaacagaactttgattatatctgacaaggttagatgtgcaggcatctcactgtcattcatttctacatagtctataattttggttttgattttaaacattttattattgaaatttcaaacacatacaaaagtagaaatattagaacaataagtctccatgaacaaaacactccacttaaattatcaacatgttgccaatttagtttccagctctctttgccaattatttcttttgctagaatattttaatccaaatgtgtctatcttcatttcatagtatgtatctcatatcatacgatcttttattttttataatcacactgacataatccctaaccaaattaatatatgtaaatatcatttaatatttagtccatgtccacacttccctcactgtctccaaaatggctttttatgttttgttcaaaccaggtccaagtaatgccaacatactgaatttagttgatatgtctctttaagtctcttttaatctgttaatggttgcccttccccttgtattttcatgctacctgttagttgaagaaatcaggtaatttgctctgtagaatttcacacattctggatctgtttggcttcttccttgtggtgccctttatagccagccctccatatgtgcagattcaaccaatctcaaatagaaaatactcaaaaaaaaacaataaaaataaaatacaataaaaataatgcaaattgaaaaatacagtataacaactatttacatagtatttacattgtgataggtataagtgatctaaagataatttaaagtatacaggaagatgtgagtaggtaatatgcaaatacatactatgccattttatacaagggacttgagcatcctcagattttaccatcagtggaggatcctggaaccaattccccatggataccaagggatgaccatatactgttcatctagtccctgtctgctttcagttcattattccagcaataaggctttgtagatggtggtgtggacttcctattgcattacgtcaggaagtgtgttgtctgatagacccatttttattaaggttaaaacagatcaaagggttcagaggtggccagtttgatagatccaccataaaaatctcgctataaaatatttcacctattagttgtagtacccattgaagatcatgttttctggacccattattccattaaggtctagaaaatggtgatttttctaatcctctaattccttctagatttattagacttcttcaaaaaagaaaaacccattcaaaaaacaaattttttttttgagacagggtctcactctgtcacccaggctggagtgcagtggcacgatctcagctcactgcaaactctgcctcttgggttcaagtgatcctcccacctcagcctgggactacaggtgtgtgccaccatgcctggctaaattttgtatttttagtacagacagggtttcaccatgttaaccaggttggtctcaaactcctggcctcaagtgatccacccaccttgtcctcccaaagtgctgggattacaggtgtgacccctgtgccaggccaaattcatttgaatttgatgaacttctggtgaccctgaaatttggttcacatgggaaaaggaaactaaatgacaatttttcctctgatttattgatttcaagaataatgagttgggctgggtgtggtggctcatacctgtaaccccagcacctttggaggccaaggagggaggatcacttgagcccagaagttcaagaccagcctgggcaacatagtgagaccctttctctaaaaaaaaaaaaaaaatttaggtggaagaatcacttgagcccaggaggaacagggtacagtgaactgtgcttgtaccactgcactccagcctgggggacaaagtgacaccctgtctcaaaaaaattatacattggtgctctagcatctttcataggttaccaaattatgcagccacaatcaagtaaactatcaaattattggtgggatcacatcaaaaactcaacttgaaacaactcctactggttgaagatatggcattttgagcatccaaaagtatactgacttatagaatgatgttttgtttctttcccacaggagttttatacacacacataaatatacacaacaatattaaattcctaggtggttaatttcttttaagccacatttttgatagtttctaattaattttaaactgtggtcagacaacagggattgtaagccttttgctttctggaattatgggaaaatcatttcctatttccctctaattcttcaacagctgtattactagtgacctcacattcatgaaattcatttttggcatgaaatttctaatgcagctcaagtgctgaagaacttcctacattcactacaatctaaattttacctagaataaattatgtttaataatttctgagaggtgacaggaggcatttctacatttattatgtctacagatcttccttttacgtgaattcactaatactaatgacaataataacaattacagataatatttacagaatacatgctatatgactgtgattcctccaagtattaactacttactccttgcaacaatcctattccacagtgtggcaggctgactctaaacaggccccccagtggtcctgtctccaggacttattcacactcttgtatcatcccgttctcttgagtgtggactatcctagtaacttacttctaccagtagaaggtgagggaatgttacttccatgattagattacacaagatggtaacttccatcttgctagcagactgtcctcccttttggcttgcatgccttgatgaagcaagcagccatgttgatgaggctattgtggccaggagctgcagtcagcgttcagccaacagccagctagaaactgagaatctcaatgcaacaggcctcacggaaatacattgggtaacaactatgttagtctggatgtggatccttccccagttgagccttcagatgagacctcagccctggctgaaatctgtagccttgcaagagaccctgaagcagaggacccaactaagtcatgcctatactcctgatccaaattataagatataattatatgttattttatgctactaagtctgtggtaatttattacgcagcaataaataactaatacatataagtactattattaccattttacaagtcagcaaaatgaggcacagaagcttagtatcttgtccaataaatcaaactggtaatcaagtggagaaagggagataatgacagataaggctaaagattttcctacattcattacattattctctcataggaatttgctgaagataaaccatgtttaaatggtgttggaaggcttttaaatcaacatattctttctctaatataaaatttattatgcttggaattgagcatgaaacacattttctcaaaaatgaattttctgatgttctgtaacatcatatacatttgaaggctttcttctattaaattccattatgaatcttctgatgctgagtaaggtgtgaatgctgtctaaaggccttcttacactccttacacttgtagggcttctcaccagtatgaattctctggtgttgagtaagaaatgaataaagtctaaaagccttaccacattccttacattcataaggtttctcaccagtgtgaatactctgatgttgggtaagttgtgagagcagtctaaaaggttttctacattccttacattcataaggtttctcaccagtgtgaatactttgatgctgagtaagttgtgagagcagtctaaaggcctttccacactcttcacattcatagggtctctcaccaatatgaatgctctggtgtgaaataagctgtgagtaactactaaaggtcttccaacattccatacattcatagggtttctcacgagtatgtattctctgatggcgaactagttgttgtcttaatctaaaagtcttcccacattccttacattcgtagggtttctcaccagtatgaatactctgatgaacagtaagttgttggcatattctaaaagcctttccacactccttacattcatagggtttctcaccaaaatgaattttctgatgtactctaaggtctggaccacatacgaaggctttcccacattccttacattcatagagcttttcagcagtatgaagtctctgatggcgtgtaaggtgtgtacactgtctaaaggtctttccacagtccttacattcatagggtttctcaccagtgtgaattctctgatgtcgagccagttgctgatgtactctaaaggcctttccacattccttacattcatagggtttttcacccgtatgaagtctctgatgttgagtaagttcttggagcactgtaaaggccttcccacactccttacattcatagggtttctcaccggtgtgaagtttgtgatgtcgaataagatgtgcacgctgtctaaaggcctgcccacattccttacacttataaggtttctcaccagtatgaattctcaggtgttgactaagtgttgagcgacgaataaaggtcttcctacactccttacactcatacaccttttctccattatgaacgatctgatactcagtaagaaaattgtgccttttgtaagtggtcattttttcagaggtaattttcacttgcccaaaatatccctcttgttgttccttttccccctcaatcttgcttttgcattcccaatcattcctaaaaatggaaccctgaaggctatagcttttaattctttccattatatcccactgaaatgaatatatttcataaatgtccttttctggagataaagtattggtcctgtatctggactccaaatctgaaagaaaacaagaaagcaaatacatactgttttcctgttccagaaagaaaaaacaaacaaacaaaaaaaccacttctatagagaaaaggcacctaaaataatgcctgttacaaattgaatggattagacagatctcaaacatagacatttctgccacaatcttatatatgtgtacctaaaaaaccttatcttctacaaaagtacacactaaaaattactgtgttcagaagaaaaataggcccggagcaggaccacttaattttttttttttctttggagatggagtctcgctctgttgcccaggctggagtgcagtagtgcgatcccggctcactgaaagctccgcctcccgggttcacgccattctcctgcctcagcctcccaagtagctgggactaccggcacctgccaccacgcccggctaatttttttttgtattttttagtagggacggggtttcaccgtgttagccaggatggtatcgatctcctgacctcgtgatccacccacctcggcctcccaaagtgctgggattacaggagtgagccactgcgcccggcgaggaccacttcattctatgcctttttttttttttttttttttttgagacacagtcttgctctgtcacccaggctggagtgcagtggcacaatctcggctcactgcaacctctgcctcctgggttcaagcaattctcctgcctcagccctcctagtagctgggattacaggcacacacccccaagcccggctaatatttttgtgtgtatttttagtagagacagggtttcaccatgttggccagactggtctcgaactcctgacctcaggtgatccgcccgcctcagccttccaaagtgctgggattacaggtgtgagccaccatgcccagccaattctatgcatctttaatcagtagaacactaacaaataaaatagttgacatctaaagggataaaccaaaagacacctcagcacttcatgtgtattaaaatgcacaaaaataaagagacaatgctagacttcaggtcctgagacactgtacatgaaaataaagcccagagccagtgaggacatcattaaggtgggagtaaggtaaagtgcagcctgtctttagataagaggccatgcaaggttgatggtatattcctctggggagggagacctgggtgcagacatttattattaattttcttaaaacgggtgaaagggctcctgataataaagcatcatgtagaaggcctttgtctttcctactgaacattataaatatacctccactaagctagctccactggactagaaaaattactcataagccaatcatctacattatacacaattcttttgccactattctgctaatgtgtaccatgggacagattgcactctcatcattttgaaaaagggaaacacagcaaataaagagtccaggagtgcaggcagggctggtgattaggaaagcaagtcaaatcagtgaagccctgttttaagtgtggataagaatcacctagagatttgtttaaactatgcagaggtgtttttaactgactgaaaccatctataggacaaagtcctgggcaagtaattgttttgttcttgtttatattcttcaagaaattattgggatgctgatcaatatttgagtctctctgtttaaatgttttcaatgctatctctttaccattataataaaatataaatacctgagcataaataataaagctgctgcttgtcaacaaatatcttctcccatttgttctctctgttcatagcatactggcctctttcaacgcacaaaatgccccacaactgttccaaataaataggactcttcacaggctgctccttctttgaggaatcctctgacactgcatggttggctggttttcattctcagcctcaaatcaaaatcacttcttcacaaaggctagtcctgctggccctatttaagtctatgcactttacgcttgtcttactccattttctgttgcttataatgaagtatctgaaaatggataatttataaagaaaaggaatgtattattattatttctactctactctgacggattaaggagtttatttcttaacaattatgggggctgagaactccaaagttgagggactgcatctggtgagagccttcttgctggtgacaaccctgcagagtcccaaggcagcgcacagaccatcaatgggtaatgggggctgagtgtgctagctcaggtgtctcttttgcttcttacgaagccatgtgtcccactcccataataactcattaatccattaagccatgaaagcccttgtgacccattcacccctcatagatcccacccattggggattaagtttcaacatgagttttggaggagacaaacattcaaaccacactctcttagcacactctttctcttttctttgtttttttgagatggagtttcttgttgcccaggctggagtgcagtggcacaatctcagctcactgcaacctctgcctcctgggttcaagtaattctcctgcctcaacctccccagtagctgggattacaggcacccaccaccaggctcggctaatttttctgtatttttagtagagacggggtttcaccatgttggccaggctggtctcgaactcctgacctcagatgatctgcccgcctcggcctcccaaagtgctgagattacagtgtgagacactgcacctggccatgcacattctttttcatatttataacactttctccaatttttgaatcatatgtttattaattttctcatattattctgttagtttagttagtctgttagttaagtgttatccttgaactacccccagggcagaaacaatctctattatcaccattaattagcaaatcccaaatacataatagatattaccagtttaattctcataattatataatcattaattaataggtatatctgcctctaatctttataccagaggtccccaacccccaggccacagaccagtccatggtctgttgggaaccgggctgcacagcagaaggtgagcagcaggtgagcgagcatgaccgcctgagctcggcctcctgtcagatcagcggtgactagattctcataggagcgtgaaccttattgtgaactgtgtatgcgagggatctaggttgcacactccttatgagaatctactgcctgattatctgaggtggaacagtttcatcccaaaaccacgtaccattttctcccgccccagtccatggaaacattgtcttccacaaaactggtccctggtgtcaaaaaggtagggactgctactttataccatattataatgatttacttatctctgctagaatttatactatgacttatcaatgctacacttactcaaacttttgttggccgggcactgtggttcacacctataatcccagcactttgggaggccgagggggcagatcacctgaggtcgggagttcgagaacagcctgacccacttggagagaaaccccatctctactaaaaatacaaaattagctgagcgttttggcaaatgcctgtaatcttagctactcgggaggctgaggcaggaaaattgcttgaatctgggaggcggaggttggggtgagccaagattgtgccattgcactccagcgtgagcaacaagagtgaaactccatctcaaacaaaacaaaacttttgttccttcatatcctccccatgtgtggtcctatccattcccatgtagccaacgcaactaaagtattttttttcaatcatgctaacattgaaaggcttatgaaatcctgagcaaaaggtcatggtaaatgtcaagtacagcagaatgactatcaaaaatggaagggcatctggggtcacctgaatgcaacagagtaaaaataaaggctatgttggatgtgggcttgaagatcatgatccagatggcgtactttcatgaagaaaatcgaaaatgctgaatgaagtaagcaaagacatgggttgagatggtataggaaaggaggagaatttttttctgtgactacagtataaatgtgtaaaactggtgaaatgacccaaagaatagtttgtgatcactgcaagacaaaataggaaaaaacaaaatcatgaaaccaaaagacatcttcacttcagattttaaaactctttcctaaatatagaacagtaatattgaaaaatacattatagagaacctatgaaatatagctacagatctcagaagaaattttatagatacatttaaattcttagagcaatagaaatgaaggaaaatatatgagtatcccacacaaaagttagaaaaagaacaacaaagtatactgaggaacaaagaatgaagaaatagattaaaatgaaagcagaatttcattaattagataacagaaatgaaagacatataaaaaatccaggttggccaggcacgatgactcatgcctgtaaacccagcactttgggaggctgaggctggaggattgcttgagcccaggagttcaagaccagtctgggcaacatggcaaaaccctatctctacaaaaaattagccaggcatggtggtgcttgcttatagtcccagctactcgaaagactgagggaaagaggatcgtctgagcccgggaggcgggcattgcaatgagccatgattatgccactgcctgggtgacagagcgacaacctgtctcaaaacaaacaaaaaacccaggttgtttggaaaacaaaaacaaaaacaaaacaaaaaaacaaaaaacaaaaacaaaatcagtggaacataaccattagctaagataataagagaaaaaggaaagcattcaaacaaaataaaaaatggccactagctattcagtgacaactccccatagagctctcactttttttttttgagacagagtcttgctctgtcgccaggctggagtgtagtgtggcgcagtctcagctcactgcaacctctgcctcccgggttcaagtgatcctcctgcctcagcctcctgagtaggtgggactacaggtgtttctaccatgcccagctaattttttgtatttttagtggaaacggggtttcaccatgttggccaggatggtcttgatctattgacctcgtgatccacctgcctcagcctcccaaagtgctgggattacaggcgtaagccactgcgcccagccgctctcacattttttgtacatcttgttggcagaagcactacctacctttgttctgggatatcttttcaagaatgtttctatactataacaaacagccttgcaaggtagagataacgtctctgtctggatcaataggcaggttcgcttgcttgttcaggataataaaggtaatgtctccttccaagctaaggctacgtacacttattgcccacgatgaatgatttgggttcttcaagctcagtgttccttttctataaggcagctcactgcatgctcaggaactatctagacccatccttatcagcctcatgtgacttgcaggcaaggaggaactgctggctgtgctgagagcaatcaaatcctttgtctttgactgagagcatgtgtttcctgccagcatccatgacactacggcaagctaacttgtcagcttgcaagtagggtgaagttgtagaaataatatagttcttgacacatgtaaataactaacaaaacagaatattttgaaaattataagggactactatgacaaccaaggctaattactaacaaagtatagaaaaagtattcaaggctgggcgcaatggctcacgtctgtaatcccagcactttgggaggccgaggagggtggattgcttgaggtcaggagttcgagaccagcctggccaatatggtgaaacctcatctctacaaaaactacaaaaattagccaggtgtgctggaaggcgcctatagtcccagttactcgggaggctggggcaggaaatgacttgaacccaggaggcagaggttgcaatgagccgagatcacgccactgcactatagcctgggtgacagagtgaggctccatctcaaaaaaaacaaagaaaagaaagaaaaagaaaaagtaatcaaagacccactccaaaaattattttgaagattatcaaaacttgagaaagcactcaattatatttaaagtggcccagaacattttataaagcctaatactccaagttatctttgagtataaaaatgaaatcaggctgtgcgcagtggctcacgcctgtcaatccagctctttgggaggccaaggcaggcagatcacctgaggtcgggagtttgagaccagcctggccaacatggtgaaactgtcatactaaaaacacaaaaattagctgggtgtggtggcacgtgcctgtaaccctagctactcgggaggctgaggcaggagaacctcttgaacccgggaggtggaggttgaggtgagccaatatcatgccactgcactccagcctgggcaacagagtgagaaaaaaaaaagtcttctttctctttgcccacacatattcccttagaaaagtcaatttctaatggctttctttggtcaccagatagtcacatagaataggcaaagcctacagaacagaaaaataagtaattgggtgccatgtaataatactacagggatttgaattaaggattgacatttcattttaaatgaaattgtgtaactggcttttaagtacattttaaaaggattgggtaggtacttgggtcgatacttctgtttgaggtgttcaagccacaaatatacaaatatatagctatcactgataaacctgggaagctgacccctttaggctaagttggccttcatgagatcagaatgcccagcacctgtgtatcagggtaacaccagctgactccttgatatagaggttctggaggatgtcttaccaggacagtcagggaagtcaggattttgtttgtttgtttggagatgaagtctcactctgtcacccaggctggagtgcagtggcacaatcttggctcactgcaacctccgcctcctggattcaagcgattctcctgcctcagcctcccaagtagctgggattacaggtatgcaccaccatgccctgctaatttttgtatttttggtagagacggtttcatcatgtttagccaggctggtcttgaactccagagtcaggatttgaccccgcctgtgctgcaaccttctgggacctcctgtaggaagtgctatacctgctttggaagaagcagctctcagaggaaataacaccaatgggttcctccccaagagatcccagaaaccagaggtggaacttaagctggcttgtattttttttatcaatgctctgactctgtatctcagtggaaaattctattcaacaagaagaggagggctgggcacagtggctcacacctgtaatcccagcactttgggaggccgaggtgggcagatcgcctgaggtcaggagttcgagaccagcctggccaacgtggtgaaaccccatctctactaaaaatacaaaaaattagccgggtgtagtgccacatgcctgtaattccagctacttgggaagctgaggcaggagaatcacttgaacccaggagaggcggaggtttcagtgagccgagattatgccattgcattccagcctgggctataagaggggaactctgtctcaaaaaaaaaaacaaaaaaaaaaaaacaaaaaaaaaaaaacaggaagaacataatttctcctctagaactaaaaaatatttgtattttatcagaataatataccagtttaattaataattcccttaacgccctttgaaaatgtgaatttacaggctgggcacagtggctcacgcctgtaatcccagcactctgggaggctgaggtgggtagatcacctgagctcaggagtttgagcccagcctgggcaacatggcaaaaccccatctctactaaacatacaaaaaattagccaggcgtggtggtgtgcacctataatcccagctacttaggaggctgaggcaggagtatcacttgaacctcaggaggcagaggccacagtgagccaagatggcaccactgcactccagcctgggtcgcagagcaagactctgtctcaaaacaaaaaaaaaatatatatatatataatatatatataatatatactatgtatattatctataaatattaaaatgaaaatgaaaaatctaatggacagctttaacaacagcttagacttagcacaagagaagactagtgaatagagacatggatttgaagaagatttcaaggttgaaaggaataaaaaagaacaatagataggctgggcgtggtggctcacacctgtaatcccaacactttaggaggccaaggcgggcagactgctttgaactcaaactccacaagtttgagaccagcatggccagcatggtgaaaccctgtctctactaaaaatacacacacaaaaaagtagctgggtgtggtggtgcttgagcccgggaagtggagtctgcagtgagctgagattgtgccactgcaccccagcctggaaaacagagccacactctgtctcaaaaaaacaaaacaaacaaaaaaaaaaaacagaaaagaacataaaagatacatgggacaatgttaaagtgtctaacatatgtgtaactcacacagagaaaagaacaaaaatgagaaacaaacactatctgaagatatagtaaccagaattttcccaaactgacaaaagacatcaaacccaagatttaaaaaaattcctagctgagcctagtgactcaggcctgtaatctcaacaatttgggaagccaaggagggaaaactacttgaggctaggagttcaagaccatcctgggcaacatagggagacccccatctctaaaaaaatacaaaagttcactgggtgtggtggtgtgcacctgtggtccaagctacttgggaggctgaggtgggaggatcacttgagcccaggagggtgaggctgccgtgagctgaaatcatgccactgcactccaacctgggcatccaagcaagatcctgtctttaaaaaaccaaaaaaaaacaaaaaacagcttcctaaatacttcaagcagatgacaacacaatatccaccacactacaaaactacaccacaatataattgggatttttacatttcactgcaatataaaattaggcacaccacagtaatctgttaaaaaaaaatccaaaagcagctaacgggaaaaaatacctctaaaacaatatctctgaaggagttacaatataagtgacaaactactactcaatggaaataatgaaagccagaagacaaggaggggatatttgctaagagaaaataactgccaactcagaattctattctccacaaaaataaagacaaaattttgtaccctttaaaaattaagacgtaataaagatattttctaataaaacctaagataatttattgccagtggacacaataaaataaatactaagtaagttctttgggtacacagaaaatggttccagataaaagcaatgcaatgcagaaaataataaggagcactgtaaaaggtaaatgtgtgggcaaatgtaaaaaaaattcactacttattacaataagaaattaatgccctgtggggattaaaatgtggaattaagatacatgacaacagagctgggtacagtggctcaggcctgtaatcccagcactttgggaggctgaggtgggcggatcacctgggatcaggagttcaagaccagcctggccaacatggcgaaaccccgtctctactaaaaactacaaaaattagccggcatggtggtgcatgcctgtagtcccagctactctagaggccgaggtgggagaattgcttgaacccaggaggcagaggttgcagtgagccaggatcccaccactgcactccagcctaggcaacagagcaagactgcatatcacaaaaagaaaaaaaaaggcatatgacaacaaatgcacaaaaaactgaggacacataaaaggaattaaaatactattaagggttgcgtacagtggcttacgcctgtaatcacagtactttgggaggctgagacaggaggatcatctgagaccaagagtttgagaccagcctggccaacacagtgagacccccatctctaaaataaaacaaattagccgggcatggtggtgtgtacccgtagtcctacctacccaagaggctgaagtaggagaattgcttgagcccaggagtttgaggttgcagtgagctatgatcacaccactgcactccagcctgggtgatgcagtgagaccttgtctctaaaaataaatgaatacattttttaaagattctattaagatccggccgggtgtggtggctcacgcctgtaatcccagcactttgggaggccgaggcgggtggatcacaaggtcaggatatcgagaccatcctggctaacatggtgaaaccccgtctctactaaaaatacaaaaaaattagcggggcgtggtggtgagcgcctgtagtcccagctactcgggaggctgaggcaggagaacggcgtgaactcgggaggcagagcttgcagcgagccgagatcgtgccactgcactccattctgggcaacggagccagactctgtctcaaaaaaaaaaaaattctattaagatccctacaattttgaacaagatataaagaagctaatttcagattcaatgcaataagtaaataatgtacttgttattgtctaaggcaaccacaagaagaaaaataaatgtatgtataatgatcatgttataaaaggaaaaactagaataaaaatgcttgattaatccaaaaaaggcaggagaatgaaaaaagtaagaacatattaagcaaacagaaaaacactgggaagacagcagatttaaacccaaatatgtaagaaaattaatgaaatgtagatgcataaaatacatcaattaatagacaaaaatgactgggcacagtggctcacacctgtaataccagcacttcgggaggccaaggtgggagaatcccttgaggccaggagttttagagcaacctggcaacacagtgagacactgtctctacaaaaaatgcttaaaaattagccatgtgggctgggcgcggtggctcacacctgtaatcccaacactttgggaggccgaggcgggcggatcacaaggccaggagatcgagaccatcatggctaacacggtgaaaccccgtctctactaaaaatataaaaaattagccgggcgtggtggcaggcgcctgtagtcccagctacttgggaggctgaggcagaagaatggcgtgaacccgggaggcggagcttgcagtgagccgagatcgcgccactgcactccagcccgggcgacagagcgagactctgtctcaaaaaaaaaaaaaaaattagccatgtgtggtggtgcgcacctgtagtcccaactactcaggaggctgaggtgggaggatcacttgagcccaggaagttgagccatgttcatgtcactgccctccagcctgaggcaacagagcaagaccctatctcgaagaaaaaaaaaagatcttccttacccacactggggatgggatgctgtttccattactggaggcagcctagtgcaggctgttgcagtacaagcacagtaagggaagtattcagagaagagcagcccagcatgtaccaggcaaacctatcaggaatctaacattttctctcagccttccactagtaccattctcagcaaaaccactatcatcttcaatgtggacaaatgaaatagcctcctagtgggtcttcaaactatccatcatgcccttattcaatctattctctgtagagtggtaattatttaaaaatcagctcatgtaggccgggtgtggtggctcacgcctgtaattccagcactttgggaggccgaggcaggcagatcacaaggtcaggcgttcgagaccagcctgaccaacacactgaaaccccatgtctactaaaaatacaaaaattagctgagcgtggtagcgtgtgcctgtaatcccagctactcgggaggctgaggcaggacaatcgcttgaaccaggaggcggaggttgcagtgagccgagattgcgccactacactccagtctgggtgacagagtgagactccatctcaaaaaaaaaaaaaaaaaatcagctcatgttactcccctgctcaaaaatctccagcagctttctactacacttaaaataaaaaaaagtcagatgcagctgagtgcagtggctcacacctgtaatcccagcactttgggagactgaggtgggaggatcgcttgagcctaggagttcaagaccagcctgggcaacatagcaaaactcccgtctctacaaaaaatacaaaaattttccagcggtggtggcatgcgcctgtagtcccagctacttgggaggctgaggtgggacgatcacttgaacccaggagttcaaggctgcagtgagtcatgatcacaccactgcactccagcctgggcaacagaacaagaccctgtctcaaaaaaaaaaaaaaaaagccgggcacagtggctcatatctgtaatcccaacactttgggaggccgaggcaggtagattacaaggtcaggagttcaagaccagcctggccaacatggtgaaaccttgtctctactaaaaatacaaaaattagccaagcacggtggtgggcacctgtaatcccagctacttaggaggctgagacaggagtatcgcctgaacctgggaggtggagattgcagtgagctgagatggtgcaactgcactccaggctgggcgacagagagagattccatctcaaaaaaaaaaaaaaaaagtcaaatgccttctcctatgatatacaaaccattacatgatctcgctcttgcctaacattatcttgtttctacacctttcacttaccttttgaataagcatcttaatcatcttgggcttcttgcagttcctcaaaaatacaaagctcccctcagcccacccaaagcctttgtatttgctgttctctgccaggaatgccgttgctttagatattcatatggcctgggctcttttttcatgtcactattcaagtatcacctcctcaaaatgtcctgaccaccctatttaaaacatccctatctctacttgccaacttccattctcacccaggctggaatgcagcagcgcgatctcggctcactgcaacctccacctcccaggttcaagcgatacttctgccttagcctcctgagtagctgggactacaggcatgtgccaccacgcccagctaattttcgtattttcagtagagacaggtttcaccatgttggccaggctggtctcgaactcctggcctcaagtgatcctcccacctcagcctctcaaagtgctgggattacaggcacgaagccactgcgcctggcccttcttacttttcttaatacttgtccctacctaatattatgtattgatgtacttgtttacttcatgtccttactcctattaagatgtaagcaacatgattgctgggacccatgattctcattcacatctgctccactggtgtccagcacaacacctagttccaactaggcactcaagtatttgccaaataaataaaggaatatatttctagccaatgaaagacatatcaacctaatcataatagaagctagaaagaaactgggtcctaaatatggactgaactctgttcccctaaaatttgaatgttgagccctaactaactgtatgtggagatggggcttttaggaggtaattaaggttaaaggaggcctagaggaggggtcctaatccactagaattactggccttgtaagaagaagaagagggccaggtgcagtggctcgcgcctgtaatcccagcaccttgggaggcagaggtatgaggatcacttgagcccaggagttcaagaacagcctagggaatacagggagatctctgtctctataaatttttttttttttaaatagctaagtgtggaggcatgtgccagtaaacccagctactcaggaggctgagacgggaggattgcttgggcccaggagttcaagactgcagtgagctgtgatggcaccattgcactccagcctgggcaacacagtgaagccctgtctcaaaaaaaaaaagaagaaaaaaaaaggaagagagtgacctctttctctctctgtgtcatatgaggacacaacaagaaggcagctgcctgcaagccaggaagagagacttcaccagaacctggcaccctgattttggacttccagcatctagaattgtgagaaaatacatatctggtgtttaagccacccagactatggtattctgttacagcagcttaagatgatacagatttaaatagagatgaaactgtagtcaccgatcaaaaaaaagagtagcccctctctttgtcaaatcttttccccattcccctcaacagcatccttaaaattttttttattttaaaataattatagatccatgggaagttgcacaaaatgtacagaaaagtcctgtgtagacttcacccagcccctcccagtgttaacatcttaggtaagtatagcacaatattcaaaacaagaaattaatggggctgggcgcagtagctcatgcctctaatcctagcactttgggaggctgaggtggatggatcacctgaggtcaggagttcgaaaccagactggccaacatggtaaaactccctctctactaaaaatacaaaattaggtggtggcgcatgcctataatctcagctacttgagaggctgaggtaggagaatcgcataaacctgggaggcagaggttgcagtgagccgagatcccgccactgcactccagcgtgggtgacagagcgagactgtctcaaaaaaaaaaaaaagaaagaaattaatgttggtatattccatagagcttacttagacttcaccagttctatgtgcactcatgtgtgtttatttgcatagctctatgcaattttatcacaggtagcctcgcaaaaccaccaccaaaatcaagatactcacctgtaccatgactgcaagatttcctcatgttacccctttctaacccgaaccatcctctacgccctacatccctacccttggaaaccactaatttgtttttccatctctatgtgattttgcaaatattacataaataaagtcatgtagtgcataaccatttgtgattgattttgtcactcagcataatttccttgaaattcacccaagttgttgcatgtatcaagagtttattgcttactgttgctcagtttattcatggtattggtgtgcctttcaatcagttttaattgggctacttatcatttagcactgagctgtgtatatactagatactggtcccttgtcagatatgttttaccactattactctcccagtctgtgactcacccattcatctgcttattggtatattctgatgagacaaagttttcaatttggataaagtctaatgtcttaattttttatttatttattttgagacagagtcccactctgtcacccaggctggagtgcagcggtgtgatcttggctcactggaacctccacctcctgggttcaagcaattgtcctgcctcagcctcctgagtagctgggattacaggcgcatgccaagacgcccagctaatttttgtattttcagtagagatcaggtttcgccatgttggccaggctggtctcaaactcccaatatcaggcgatctgcccgccttggcctcccaaagtgctaggattacagatgtaagccactgcgcccggtctgatttttttatttttatggttattgttttcactcaagaaacctttgcctactcccaagtcataagttgggacactcatcactgtcctgtttccctctaaaaactttatgattgtagcttttatatgtaggtctaaaaaccatctcaaattaattttggtatgaggtaaaagctgagaggtttgtttatttgtttccccagttattccagtactatttgttgaaaagcctttcttctccccattggaatgctttggcatctttgtcaaacaataaatgaccctttagtgcgtgtgtggcagggtatgtttctaggacctctgttgtgttttgttcggtaatctttgccaataacatactgtcttgatcactgtagttttaataaatcctgaagtttttgttttttgtttttttttttgagataagagtctcactctgtcacccagggtggagtgcagtggtgtgatctcggctcactgcaacctccgcttcccaggttcaagagattctcatgcctcaccctccccagtagctgggattacaggcttgcaccaccatgcctggctaatttttgtatttttagtagagatagggttttaccatgttggccaggctggtcttgaactcctgacctcaggtgatccacctgcctcggccttccaaagtacagggattccaggcatgagccaccatgcccggctctgatctatctatctatctatctatctatctatctatctatctatctatcatctatctatctatctatctatctattttattttttgagatggagtcttgctctatcgtctgagctggagtgcagtggtgtgatctcggctcactgcaaactccgcctcccgggttcaaccaattctcccacctcagcctcctgactagctgggattacaggcgtgcgccactacatccagctaatgtttgtatttttagtagagacggggtttcaccatgttggccaggctggtctcgaactcctgacctcaactgatctgcctgccttggcctcccaaagtgctaggattatatgtgtgagccactgcacccggcctgattttttaatattaaccttatatcccatgaccttattgtgatttttcaattattacttcgaatagttgttgtcttgattccttaggactttctatgtacacaatcatgtcatctccaaatacagacttatgtcttcctttttgatctttatgtctcatttctttttcttttgataatggatttttatagtttataatgtattttttaaataggtgccccttaccagattgaggaagttcccttcaatttctagtttgctgagagctttttatcatgaatggatgttggattttgtcatatgctatttttacatctatgaagatgattgctatggtttgaatgtttgttgcctccaaaactcatgttgaaaattaattcctaatggcaatattgagaggtggggtttttaagaggtgactgggtcatgagggctctgctctcatgaatggatgaacctattcatggattggtgagttaatcgattaatgggttatcacaggattgggactgatgactttataagaagaagagaggcctcaactagcacatttgcatgttcagcccacttgccatttgatgccctgcaaagcctcggaattcagcagagtccccaccagcaagaaggccctcaatagacacagccctttgaggctggacttctcaacctccaaaacggtaagaaataaattccttttccttgtaaattactgaatttcaaggtattctgttataaacaacagaaagtgaactaagacaatgatcatacggtctttcattttttctgttaatatggtgaattaacaggtagaaagaaatcctaatcatcatttttgtatatcattatatttgatttgttaatattttattaaaatttttgtatctatgtatggaaaagatgggtttatgctttttttgtaatgtctttcttgggttatggtatgagttatgttggcctcataaaatgcattccttttctgaaggagtttgtataatactgctgctatttcttccttagatgtttaatagaattcaccagtgaaaccatctggggctggcattttctttgtggaaggtttctgataatgaattcaattactttagcagcataagggtattcaatttcttttttatcttgtgtcagttccggtaagttgtacttttccagaaattttaaaatttcatttaagttatcaaatttattggcataaagtaattcatggcattctcttattattcttattattcttcttttttggagtcggggtagagtctcactctgtcactcaggctggagtgcagtggcgtgatcttggctcactgcaacctccgcctcccgggttcaagtgactcttgtgtctcagcctcctgagtagctgggactacaggtgcccgccactatgcccagctaattttcgtatttttagtagagacagtgttttgctgcgttggccagactggtttggaacccctgacctcaagtgaccagcctgcctcggcctcccaaaacgctgggattaccagagtgagccaccacgcccagcctcttattattcttttaacggctataggatctaaagtgaaaatccctctttcattcctgatgttagtaatttatgttctttaaaaagagagaatgtaaattactaggtgtttaccatctttgctgatcttttcaagaaatcaatttttggctttattaattttctttatttcttttctattttgctgatttctgctcttatatttatttattttttcttctaccaggaatagttcttctctttaaagtaggatagaaatatgaaagatgagaaacagtgttgcattcaagatcaatagaaagttcctttgctagtccaggcttaaaagatcttaatttgcttcaagtcccaagccctgcctccataggccaggggctttttgaagagagaccccaacatctcaagggtgtgcctccaccctaatcagtttagctattacctgcagtagtgatttctcaatgcctgctcagccctcactcaccagggcagtatcttcttgtcccttccctcacaaccatcccaggttccttcctttcttcatccaataaggtaatcacatctggtttagaaatggaaggtcctgcttaaaagaaaaatgtgacatggaattatacaccagaaaatctttagatttagatttggttaaatttataattaactacagatcaatatggcactttataaagcctaggagcgaagaattgcaagggagttgaagaatgctcatattaaggtaacttgagggtcacaaggaatagcctgtatgaggttaaattaagtatactaaggccattatattaaccatctggtcaagaacaggccttaatataatttaacctcacacaagctctgttgaaaggcagtattgtgtagagggaagaacacagactggatccagactgcctggcttcacatcctgcctttgtttctgtgttacctagcaaattattaaccttttgtgtctacgttttctcaaataaaatgaagataataatatcttctcatagcgttgttgtgagggttaattaataatgaacaatgcttagaataatgtttaagcccaaatatatggtgatgtttattaacatatacacataatatatgtattagctattagctatttactgttatcattttgatgagtgcatactaaaaggttttttgagacattcccagatcttttctaggatattcattcaatgttaaatgccaggcttttagattttaattttcaattacaaagtaggtagaactgcatatgtctgttacaggaaacagaatgtgtttcagggttttttctgtttgagacagagtctcactctgtcacccaggctggagtgcaatggcgcgatctcaactcactgcaacctcagtctcccagcttccaggaattctcctgcctcagcctcccaagtagctgggattataggcatgcgccaccatgcctggctaatttttgtatttttagtagagatggagtttcaccatgatggccaggctggtctggagctcctgacctcaagtgatccacccgactcggcctcctaaagtgctaggattacaggcatgagccaccatgcctgaccttgaggtttttttgagatggagtctcactctgtcgcccaggctggaatgcagtggcgtgatctcagctcactgcaacctccgcctcctgggtttaagtgattctcctgcctcagtctcccgagtagctgggattacaggcacgtgccaccatgcccggctatgagttttaaataacctttctggatccatctcacactatgttctacagattcctttgatttttagagaaactcagaacccctatgtctaggtattctacttgcagatggtgtgaagcatttatgtcaattctgagctccaatataaggtgaagtctggtttcttgaacaatgcttttgccatattcaaatccatccccttggatactaaggaaatcaggaattacagagtctgaaggaagtctgaagggcatagcagactggacatgatgaaatggagaggcctagttccaacctgacaaagcttaaatcattcctttgagaatagaaagtagttttagagagtttttctaaatatagtcctgaaattgacagcagagaaagctaatatcatttgggataaataaccttacctagtgaaatgaagttgctgtagttctcccacattacatccctatataagtccctctgagcaggatccaggaattcccattcttcctgtgagaagtctatggccacatccctgaatgtcactgaaccctgaaaaaacaaactcaggtattacttgtgaaaataaattaaatacttttaaaatggaaagaggggagattgaggattgcattgcagagaggggtcagatagcatgcaaacagcattgggctgaaaacttgtgacatgagtaggggccagtaagaaaattagtatttctcaagcactgagcctacatgttcttgaatagtcctgtggctatagatatgattacattttcatccaaacatttctagaaatgagtacataacccaaaaaaatcctaattaaatgaaatagtgcacgcaagccttttgaatactatgtgcctccaccataaattctttaaaaatatgaggtcttgaggccaggtgcagtggctcatggctataataccagcactttgggaggcccagatgagaggatcatttgagcccgtaagttcaagaccagcttgatcaacattagcaagaccctgtctctacataaaaagaaatttaaaaatttaaaaatttaaaaaaaaagaaatatgaggtcttgggctctcttttccctttaatgatcatttaaaaacattgataaaaatttatcccacatgtgctacaaaatccaagaagacagattcaaattcatcacaaactcgggttttattataaacactttctcttttataaccaattctttagtaaactttcaaaaattcgttcgatggcagtctacatttttaatatattagattcttttttctttagatattttaattcaataaaatctcgaaagtcttccccaattctcaacgtctacaatatctaatctttatggatgtgaataatcttcttgcttgtcactatctatcatctcttgaacattgtttttttgttcctgagttacaggacactgaatcatgaagatatcataaagatatcacctggacaccattatcaatcatattcttttcttttcttttttttttttttttttttttgagacggagtctcgctctgtcgcccaggctggagtgcggtggcgtgatctcggctcattgcaagctccgcctcccaggttcacgccattctcctgcctcagcctcccaagtagctgggactacacgcatccgccaccacgcccggctaattttttttgtatttttagtagagacggggtttctccgcgttaattaggatggcctcgatttcctgacctcgtgatccgcccgcctcggcttcccaaagtgctgggattacaggcgtgagccaccgcgcccggccccctgtatcaatcattttcaatgaggagtcattttgctccccaaaagacatccggccatatctggagacaattttggttgtcacaatcggaggaaagggtgtgagtgttacaggcatctaatgggtagaggccagggacactgttagacatcctacaatgcacgggacggccccctacaataaaagactccccatcaaaatgtcaatagttcaggccaggtgcagtggctcaagcctgtaatcccagcactttgggaggccaaggcaggcagatcacttgaggtcaggagtttgagaccaaccttgtcaacatggtgaaaccctgtctctactaaaaacacaaaaatcagctgggtgtggtggtgggagcctgtaatctcagctactcaggaggctgacgcagtagaatcacttgaacccaggagacggaggttgcagtgagctgagatcacactactgcactccagcctaggcgacagagtaagactcggtctcaaaaaaaaaaaaaagtcaatagttccaaggttgagaaatcctgctctagaccagcacatcctgtaaaaatacacaatggacctcgttcctggcattcttctccgcaggaggaaatctccattgattgaggtatctatttgcagtcctattctgatcacatcctattcaccctgttggtgaagaagggatccctgccctaaaaagtacaagacaatcaaatagcccacactggacagatgagattgacagcaatttgttcgatgcatatattcagagcctgagagaggacatcatacatcacgcaggggcacaaggggattgcatttaagaacagcatgaacaagcaggggtatgggaggcaggctttacagtaataacaaggtgaggtgttccctggttcctgcagtggtatgtgattggcttgtttgaataattccataggctagcagggaggtgaaacccattaggttgaggacgacgaggggtgtaactggtctagctcataggagaactagctgggtaggaagcctttcccgctgggtgtgggcatatcgggtaagagcaggggaactcatggttaggcctttagggtcttgacaaagttgtcaaggcacacatgaaagtttaggccttatcttataaggcccaattacatccctacccaatccacctaaaagccttacatagtatagggtctcaacatacataaaaactaaggtcagtcaacactaaatcctatcctatatacttgaaaaactcagatctgtggagaagtttagagttttccctataagcagtcagataagaccaaattctctctttcatcaaatcacagatcttaaggaaagctcaaaatagggacctcccacttaacatcagtaatccattcctgaaaatcagacattctaacgattaaccaggtacctattttcccatcattttatttactttctttccttccttcctccttctttctttctttgctttctttcctttttctttttctttttttttttttttttttttttttttttgacagggtctcactctgttgcccaggctgttgcctaggctggagtgcagtgatgtgatcacagctcactgcaacattgaattcctggcctcaagcaatggcctcccaaaggagggattacaggcgtgagccactacacacggcctcccattatgtgaaatcagagcattataatgagttatatgtcaattccatccctccaactagctttgcacattttcctccaatatagaactatgggacacagtgggtcagtacacacacaacatctttgcttttagtattttaatcatctcttttactaaattcatttttctcatttgcttggtttctttctccacaattttcttcaatacttttccaatcttttaggaactcattttacactagacaaaaatgagggctatatgtgaagcacagtatggaaaagtgtttccaacaagaacgtgatagcgggaacggctgacactcaggatggtgctctgttacctcctcagtcactagcagcaccaggtacacacatgcccttgaatgatagttatacacatttcaaaacatctgcagatggttccattggtctaacaactgtatttgggatataacaagatttttcctggatgttatttttgttttttaaaaaaaagcattgtattggatcaggtgcggtggatcacacctataatgccaatactttgggaggctaaagtgggagaatcacttgagcccaggagtttgagttcagcttaggcaacatagtgggaccccatctctacaaaaaattttaaaaattagccaagagtggtggcacgtgcctgtagtccccagtactcaggaggctgaggtgggaggatcacctgagcctgggaggtcggggctgcagttagttgggatcataccaccgcattccggcctgggtgactgagtgagaccttctgtcaaaaaaaaaaaaaggctgggtgtcatggtggatggtggctcatgcctgtaatctcagcactttgggaggtcgaggcaggtggatcacttgaggtcaggagtttgagaccagcctggccgacatggtgaaaccccgtctctacaaaaaaaaacacaaaaaatagctgggagtggtggtgggcgcctgtaactccaggtactcagaaggctgaggcaggagaatcgcttgaacccagaaagcggaggttgcagtgagccgagatcctgccactgcactccagcctgggcgacagagcgagactctgtctcaaaaaaaaaaaattgtattgaactatatgattccacttgaacaaagttcttgttttgttttgtctttttgagatagggtctggctctgtcatccaggctggagtgcaatggtgcgatctcggttcactgtaacctccacctcccgagctctagtcattcgcccacctcagcctcctgagtagctgcgtctataggtgtgccaccatgcccagctaggttttgtattttttgtagagacacggttttgccttgttgcccgggatggtctggaactcctgagcttaagcgatctgcccacctcagcctccccaagtactgggattacaggcatgagccaccacacctgccccacttgaacaaggttccaaaaataagcaaaattacattatagtgttcgacatcaagacagtggttaccctgggcagtaggtgggtggggagtgactgaaagcatctgaggtgatttcctttcttgacctgatagcatagatgtactcaatttatgaaaattcatccagccatacacttatggtttgtatatttttttgtatatatgtcattcctccacaaaaaatttcaaaaacgttttaaaaatgtcatattgtggccaggtgcagtggctcatacctgtaatcttagcactctgggaggccgaggcaggcagatcacctgagatgaggagttcaagacaatcctgtccaacatggtgaaatcccatctctactaaaaatgcaaaaattagccaggtatggtggcgggcacctgtaatcccagctacttgggaggctgaggcaggagaattgcttgaacccagaaggtggaggttgcagtgagccgagatcatgccactgcactccagcctgggtgataagagtgaaactctgtctcaaaaaaaaaaaaaatgtcatattatgtattggggacacctattttttctatgtaaaactaagacaaaaagcactgtactgagaaaaatatactttttctggagtttaagttttaaaatgaaaagcggttccactggaagatgttaacaggaggacattctgcagagaatgccttcaattttctcaaggcatctcatttccgctttctcacagctattgacagaagattttgtaggtaggagatgctcaacattagtgggagaagagatagccacataggatactgggctatctgtcccaatcctcacaggagggaaaagaactggagtaggttcttttttttttgagatggtgtcttgctctgtcgccccagctggagtgcagtaacgcaatctcggctcactgcagcctctacctcccgggttccagcaattctcctgcctcagcctcctgggcgcctgccaccacactggctaatttttgtatttttagtagagacagggtttcaccatgttggccaggctggtctcgaactcctgacctcaagtgatccgcctgcctcggcctcccaaagtgctgggattacaggcgtgagccattgcgtccagccatggagcaggttcttggatgaagctctggtaagcaggaagtttcagaataaagaatgaatctatatacatgatacagaaattgacagtatttcgaaaaggacagagaaacattaacttacatgggccatggttttagaactgcaaaaactggtcagtccttttcaagatttctctgttggagaactatggagtcctgataagccagagctgaaagaagaaaaagaaaccatgaaataagctgcgccacagagctcccaaaatgatgtacatcataaatatgaaaacttttttctcttccattccttctcccaaactacttccattggcttttccaaagtaccacccaccactatgcccatccctatcctatacccacatataactggggaaaagtatagggagtctaaagagaaacaagctctggccgggcacggtggctctcgcctgtaatctcagcactttgggaggccaaggcagttggagcacctgaggtcgggagttcgagaccagcctgaccaacatgcagaaaccctgcctctactaaaaatacagaattagctgggcgtggtggcacatgcttgtaatcccagctactcgggaggctgaggcaggagaatcgcttgaacccaggaggcggaggttgcggtgagctgagattgcgccattacactccagcctgggcaacaagagcaaaaaagaaagaaatacaagctctgaagaaataggtgacaaatgatgaacttggtgtagaagcctagctacttctgcaagaggatttctgaccaggtcgccctctagcaatgtggatctggtccagacactggattactcagatttgttctgagcagctcctcctcactctaggacaacttttcaggactgagaagggccctgaatcctgcccctagaatcctgcctgaactacctaaacacagcaactaaaagaccacacagattgaacctggcagcttctgccaatgtgaggctacccttgccttccccagccaggaaagctcgccactccagttttccaatcagggcctcccataccatgacatccttcaccactccttctcttttattgattaatttttttttagatggaatttcactctgtcacccaggctggagtgcaatggcacgatctcagctcactgcaacctccatctcccgggttcaagtgattatcctgcctcagcctcctgagtacaggtacatgccaccacgcccagctaatttttatatttttatatttttagtagagacggggtttcgccatgttgaccaggcttgtcttgaactcctgacctcaggtgatccgcccgcctcggcctcccaaagggctgggattacaggcgtgagccaccgtgcccggccccactttccttttagtatccaagctggggacagaagggattcatgattcctgcagttggtcaacaatattcattgagaacctctatgtgttgggtacttcatacacattgtcagttgtcctcggtactgttctgcaatgtagtgctctccttttaatagctcaggaaactaatgcccaggggtcaaatcagttaagttgccaacatttgttttgaatctacatttctctaactaaaaagcccgtttcttttttctttttttggttttgttttttttgtttgtttttgcagacagagccttgttctgtcacccaggctgaactgcagtggcatgaccatggctcactgtaacctctgcctccagggttcaagcgtttctcctgcctcagtcttccaagtagctgggattacaggcgcctgccactacgcccggctaatttttatatttatagtagagacagggtttcaccatgttgcccaggctggtctcgaactcctgacctcaattgatccacccgcctcagcctcctaaaatgttgggattacaggcgtgagccaccacacccagcctaaaagccagtttctctttcaactcaggtatttgtctctgaagcaaggatttctacttcaccaggagaaatctgatcatcagcaattcactaaaaaaaagaggaataactaacagtaggttttgttttgttttgttttttcaaaaacacggtctcactctgttacccaggctggactacagtggcatgatcttggctcacagcagcctcgacctcccgggctcaagcaatcctcccacctcagattcccaagcagttgggactatagttgggcaccaccatgcccagctaataatctttcaaaaaatgctaaatctcagaagatagcaaaatagttctttccatctatggtccacctgcagaaacatcagtttgagcaattatccatcaacaaaaatgccttcacaatagctaaggcaaccaggtgagagatcgcagtactgggttgtagcacaataataagaaaagaagcattgaagagtgcaggaaggacggctcgacattacccatgtcacccctccccagctcaaggcagcacagtgtagacagaggtattgcccacttggggaaaagtcagggaagtgagcacagaactttgcctgttccctaacaccaggcccgccatagtaaaacccagcaacagggagactcccaaccccagactccaggccagtagccacagactgaccctctagacctgctctggcatcaggaaagatcatgcagcccaggcttcaggcttgcatgatgaactccatctccaggctgccaccaccatcaggctgacatcagaggccctgggctccaacagcccttagcaacaggcaagcctcagtggcctctgcaatcaggcacataacagtatggcaccagtcacagtggtctcaggctttgagcgtgccccagcactgcaccagccagagtggccctgggcttggggcatgctatgtgcaacaccagagaatgtggttccagccttttggagcatcccagcactatacccaccgtagcagccccagccttaaggaccaaaccagacaggctgcccagaaccactgcatgggctattgatgggctttcccagatgaacctcattctgcaaagactggaataaatacacagtcctttcaagtgtgcagacatcagtgcacggtcacaaagatcaacaacaatcagggaaacatgacatcgtcaataggacaacataaagtgccagtgattgactctaaagaaatggagatgtctgaactgcctgataaagaattaaaacaggctgggcacagtggctcacacttgtaatcccagcactttgggaggccgaggcaggcggatcacgaggtcaggagatcgagtccatcctggctaacacggtgaaaccccatctctactaaaaaatacaaaaaaattaggcgggcatgctggtgggtgcctgtagtccagctactcgggaggctgaggcaagagaatgccatgaacccaggaggcggagcttgaagtgagtcaaggtcgcgccactgcactccagcctgggcgacagagcgagactctgtctcaaaaaaaaggaaagaattcaaataactgttttaaggaagttcagtgaacttcaagaaatacagagaactttaaaaagtgagaaaaacaatatgtgatcagaatgagaaattaaatagattgaaataatttttaaaatcaaacataaattctggagctgaaaaatacaatgaaggaaattttgaaaatgcaagacagaacatcaacagcagaattgaccaagcagaggaatgaatctgtaaacctgaagacaagttatctaaaaatatacagttggatggaaaaaaggatgaaaagaaatgcagaaagtttataggattcatgggacagcatcaaaatagcaaatatttgagcagtaggagttaaaaagggagaagagaaagataaacaagtagaaagcttatttaaagaaataacagcaggcacagaggctcatgcctataatcccagcactttgggaggccaaggtgggattacttgagtccaggagtttgaaaccagcctgggcaacatagcgagactcatctctacaaataattttttaaaaataagccaggtattgttgcatgtgcctgtagttccagctacatgggcggctgaagcagaaggatcacttggacccagaagttcaaggttgcagtgagctatgatcatgccactacactccagcctgggcaacagagtgagatgaaaggaaaggaagggagataagaaggaaggagggatggagggagggagggagggaaggagggaaggaaggaaggaaggagaaagaaagaaaaaagagaggaaagaaagaaaaagaagaaaggaagggagggaggtagggaggaaaggaggaaggaaggaaggaagaaaggaaggaaggaaggaaggaaaaaagaaagaggaaagagaaaaaaagagtagcaaaaaactttccaaacctggggaaaggtaagtatccaggtatggcccaaagttagaaggaagaaaataataaagattagggcagaaataaatgacacagaccagaaagccaatagaaagaatcaataaaattaagagttttttttttgaaaaaagaaaaaacccacaaaattgacaaacctaactaagctatactaaccaagagaaaacagaaaatattgaaaatattcaaataaaactagaaatgaaaaaggagacattacaactgatacaacagaaatagaagagactattatgaacaaacatacaccagaaaattggataacctaaaataaatgattaattccctgacacatacaacctaccaagattgaattatgaagaaataaaaaatctgaacaggctgggcatggtggctcatgcctgtaaccccaacattttgggaagccagtcattatgacaaacagtatggagaggcctcaaaaaactaaaaatagaactaccatatgatctagcaatcacactactgtatatatccaaaggaaatgaaatcagaatgtcaaagagatctctgcactttcatgtttattatagcattattcacgatggccaacacatggtgtccatcaatggatgaatggacaaagaaaatctgctatgtaaataaaatgtaataccattcagctatgataaagaaacaaaacctgtcatttgtgacaacacagatgaatctggaaggacgttatgttaagtgaaataagccagaaacagaaagataaacaccacgtgatctcattcataagtggaatcttaaaaagttgatctcgaccaggcgtggtggctcacgcctgtaatcccagcactttgggaggccgaggcgggaggatcacctgaggtcgggagttcaagaccagccttaccaacatggagaaaccctgtctctactaaaaatacaaaattagccgggcatggtagcacacgcctgtaatcccagttactcaggaggctgaggcaagataatcacttgaacccgggaggcggaggttgtggtgagccgagatggcgtcattgcactccagcctgggcaacaagagcaaaactccgtctcaaaaaaaaaaaacaaaaaaacaaccaaacaaacaaacaaacaaaaacaacttaatctcatagaagtagagagtagaatggtagttaccagaatctggggtagttgggggtggggggaaatggcaaggttgaggagatgttggtcaaacgatacaaaatttcagttacataggaggaataagttcaagagatctattatacaacatggtgatatagttaacaatatattgtattactgaaaaaagctaagacctgtaaagtgttctcaccacaaaaatggtaactatgtaaaaggtaattcatatgttaattagctagatttagacattccacaatgtatatatactttaaaacaccatgatgtacatgataaatacatgtaattttatctgtcaaaaaataattttaatactaaagctcggtattaagaaaatgaccagcctgggcaacatagtgagaccttgtctctacaaaaaaattttaaaaattagccgggcatggtagcgtgcacctgtagtctcagctaccaggaggttgaagcaggaggatggcttgagcctgggaagcagaggttgcagtgagctgagatgatgccactgcactcaagcctgggcaacagagtaagaccccatctcaaaaaaaaaaaaaaagaaaaaaatgaaagaaaaaagaacagaaaaaaatgaaagaaaaaagaaaagaaaaaaatgaaagttaaagcaaacaaaatgtacctttttacaatgactgcattgcaagacctaaaagactgatgatgccctatagtagcaaggttgtggggacaccgacactaggtcggtccacatttagagctatgtgaagcagcatttcaatcctgtaaactctgaatcagaagctccacttctgacactaaagggactgtatctgtacataaagattatgcagagctatggccggggcagtggctcacacctgtaatcccagcactttgggaggccaagacaggcggatcacctgaggtcaggagttcaagaccagcctggccaacatggtgaaaccctctctctacaaaaatacaaaaattagccgggcatgatggcaggtgcctgtaatcccagctactcgggaggctggggcagaagaatcgcttgaacccaggagacggaggttgcaatgagccgatgtcgtgccgttgcactccagcctgggtgacagagggagactctgtctcaaaaaaaaaaaaaaaaaagaaaagaaaaaagattatgcagagctatgctgacagcatggtttataatgaattaatggattaaagttgaaaagaacctaatttcggaatgattcaataacctgttgtttatccataccattgaaaatgatgcaaccattaaaaatgatgttgccttaattttgaatgggtgaagccagtgtgttaaaaaaagaaaataccagcatgtgtagtgtgaaactattttgacagaaaaaaaaatcatgtttccctagcaggaccagttaaaatgtttacagtcacagccagcaacacgcaccaccacattaaacagagtgtgagcctgaaatacccaaatacttcaaataagactttcccggctcaagttctttcagtcttccttttaactgagaaaaaaagctaaggatactgtaaaaacagatgctgttttttctgagtggcttttttttttacttcggcttctcattcatgaaccaactctatgatttaatttgcccatgtgtgttggagtacggcctagaaaagaatggcaaaaagtctctgactgatgtcttctaagcactgaaggcagccccatgctgcttcctttcacatcttcctgataaacaggtttattttgcttctgaaccagttcttttggctaagatgcctatgaagccctccagcagatgttgggtctccttgaccaactggtctcactttgcatataacatcattaaaataaaaactgtaaggcatacatctgtatgaaacccagttacctccataaagaccctgtagcttcagtataatctggacaaaacttgacagtgtgtgccatcatgagattgatatctcttcccttcatcgtgagattgctgaataaagcaggaaggaatttttttttttttttttttttgagacaaggtcttgctttgccacccaggctggagtgcagtagcacgatctcggctcaccacaacttccacctcctgggttcaagcgattctcctgcctcagcctcccgagtagctgggattacaggcgcatgccaccacacccagctaatttttgtattttcttttttttttttttttgagacggagtcgtgcccaggctggagtgcagtggtgcgacctcggctcactgcaagctccgcctcccgggttcacgccattctcctgcctcagcctcccgagtagctgggactacaggtgcccgccaccatgcccgggtaattttttgtatttttagtagagatggggtttcaccgtgttagccaggatggtctcgatctcctgacctcgtgatctgcccgcctcggcctcccaaagtgctgggattacaggcgtgagccaccgcgccccgcctaatttttgtattttcagtagagatggggtttcgccattttggccaggttggtcttaaactcctgacctcgggtaatgcacctgccttggcctcccaaagtgctgagattacagacatgagccaccgcgcccggccagatttttttttttaagtatgcataatgatgatatttggtatactgttgtaattaccaatatatgcttttatttttctgcatgatattagacaggttactttccagttccccatatgaaatggtgagaactacagtttctacctgaaaggattgttatgagaaataaataagatactacatataaggcacttagagtagtaaataagcatttcataaaagtcagctatattaataaagatgaagaatactacatatgcttcttcccacaattatttttaaaattctactcaggcctgtaatcccagcactttgggaggccaacacaggcggatcacttagatcaggagttcaagaccagcctggccaacatagtgaaaccccatctctactaaaaatataaaaattagccaggcatggtgatgcatgcctgtaaccccagctacttgggaggctgaggtaggagaatggtttgaacctggggcgggtggctgcagtgagccaagatcgtgccaccgcactccagcctgggtgacagagcaaaactctgtctcaaaaaaaaagaaaaaaaaaaaattcttcgcagccctgctcttgataggcaatccttcttgattatcaacaatttacaaaaggagggtacaaagataaaacaaatgtggtaggataccaatttttggatctgggtgatgaggaaaaatattaaattacaacctaacggtaacaaatctactgtgcacttattatgtgccaagcattagctaagggttttgcatatattaattcctctactcagagccatcctatatagcagggtctatcattatcctcattttgcagatgatgaaactgtggcacaaagagattaaataaattgccccaagctcaggcagctttaagtggcaggttgaggactagaacccccctactttagctccataacccatacgactgtcactgtactaaactgcatctcatgagacctgataaatacgtggcctgaaacactcatgctgtcaaaaacttcaagccactttccaaatttctactgtcttcccttcccttctaataaccccttcccttgttaacacagacctctccactaaaaaccccatcgtattgtcactccttaaaagcctcaaaagcagaaaagatcctgtcgccaatcaaaccacctcctttccctgcttttgaactcagggcggtggggatcaaagagacctagtgggtaattccatctaaactgtaaactcctcaactaatcaccatcgaatgaaagttctacgtggtggctcacgcctgtaatctcaacactttgggaggctgaggtggaagaattccttgactccaggagttcaagatcagcctgtgcaacataaggagacctcatttctacaaaaaaatttaaaaattgcgcgtgggaccacgtgcctgtggtctcagctactcaagaggctgaggtggaaggatcgcttgagccagggaggtccaggctgcagggagcgagatcacttcactgcactccagcctgagggacagagtgagaccctgtctctaaaaaaaaaaaaaaaacttaagtaacaaaataaagctctgcagttagcttctcttcaggaggtttacttccagaccatccaaatgattagaaagaggcagctcataagagaaactaaattactgccaaatgctcatgtcaatacctactggaggccgggtgcggtggctcatccctgtagttctagctacttggcaggctgaagcaggagaatcctgcttgaacccgggaggcggaggtttcagtgagcacatcgtgccactgcactccagcctgggtaacagacccagactccatctcaaaaaatacaaaaaaaaacaaaacaaaacaaacctactggaaaggggtaggaattggaatctaccttcatcaccccatcattcactgggaaggaaggccaaagcaccaggtcagtggacaggacatttcaggggttaaagtctaactagctgaagattaactggaacaagcccgcatagtctgacaaaatcatatctattgactggcagaaagggagaaaattccacaggaagggttggaatagaatggacgagagagacgagaaaagctctttcgtaaacggttgagttccagctgaaagattctaaggaggatctaatgacagctgcaatctggaatggctgctgtttccgaggtgagattaggagaggcagggattaatgagatattgaatgcaatcatgagtgtaatcaagagggtatccccagtaataaaatgaaaacagcaaagcaagtctagaacatcactggtaagaaaactgtaatctctcaaagagggagtcattatgccattttacaactactgcaccacctggggagaaatcatgttttctattaattttgcaactggctttatctgtctcttccttcctagcctgattaatgacagagctgcttcattgttcagtccgagctgattttcattccacagaagaggaaagcaaatgcccccacgcccagaaaaaataaaaattacacttcatggaacaaaacggaaacacaaactcatctggatgttgacttgtctatatgcaacagcaatcatttcctcctctccccgctgccttcctaaagaacagcaggattgggaaaggagacgggaatcttgagaccgcgggcctttcctggagccggccttggctgagcaggacacacccccgctagcgcacttgctccctccgtctactgcgcgcaaaacccgatggaaataacagggagcctggaataaagctgaccctttcccgtatcagagcgaaaggccaggtacacgaagacggggctgggatctgtctccgagttccccgcagtttccatgggagggagctcgggtaaagctgtgcaatctgcagttcttcagactgcgtctttttgtttgggggccttcattcactccggggttcctgtatctaactcggagccattccgggccgctggacctgggcggctctgaagcgagaaggcagaggacgcaacagggcacccggcgcccagtcagcgccacaaactccacagctactgcctcctggctcacactgaggtctgcgccgcccccgcgccacccccgcgcccattgcctcggtgcaagcgaccaactcacctctcggagccgacaccagcagcgaagccggaaagaactgc

SEQ ID NO: 1567 - DNA, 577594 bp, Homo sapiens
gctttggcgctcccaaggactccccgccactctccccacaaagcagcggcggtggcggcggctgctgctggatcttcacactgcagccagcagcccaggacgcccccggccggacgatgggtacccgcgcctgagcatcccccgggcaggcgccaggcgcgaaggcagggggcgggaggaaaggggcgggggaattcctgattccctggtggaccctggaagttgtccttaaataaatatatcgctggcccgcggttgagcagccacctcgtcagagcagcatgtggactggctcgccgggtcccctccgtgctctgtgctgtcgccgccgccgcctctgtcagagcagcagctgtcggcagcaggagccccgcacggggcgcggagcagggacgcgctgccaccgcctccccctgcgtcctgctggccgcgtcttctcgggaggtggtagtcgctgttgccgctgagaaacccgcccgctttccacggctggtcgcctggtgaggagttgagactctgcgcctccgcccggacccacatggcttgttacctggtcatcagttcgagacatctcagcaatgggcactaccggggcattaaaggagtcttcaggggacccctgtgcaagaacggatctccctctccggtaatgtgcgcgcgcacacacatacatacacaaacgttccaactcaacacaaacaaaaagatattgagagatagtatcctgatacaatgagtaggtggtggacatctaaaacgtataccttatccataggtatggagatacatcgtgtccgtttatacaatttattgacagactgtgacacagagaggggtgtgtatttacatgtgtattttcaattcagtcagtaggatctatagtgctacggatgtaaatacttactgaatgcagtcaactgcagggctcagaaggtagctcctctgtgctatgtcaacttacgaatctgctgatttgagcagtgtagaaagtttgagtggcacgttataatgtgcttttgtaaagtcatcagttgagattagtttaataatgctactgttactttgtgagaaaaactcaaagattttccctcaaatcattggcaaaaggaaagttataggtagtgaaaacttgattatatctaatgctcaactatgcacattctttaaggggaagtaagagaattctttatggaaatctgagttggataatttattgtataatatacaaatatattaacatgcaattaacgtgattgctttttaacttagtaaactattcaatttagttactattcagtttattcacattctttttataaaataatttcatccagattatatgagttaaatacattattaattcatttcttggtacatgctattatgttttaaggctccaaatatgtttcaagaaaatgtgtgtgaatgtgtatgtgtgtgtaatttatatatatatataataaatatatatataataaatatatatataataaatatatatatatattagttttggactactagtgactaagtatccaaacttaaagaccaacttttgaggtttcatataaaaaacagtatttaagtctgtatgatatcaagagggaaaactgaaattgcccaactttaatttttttatgtttgatattttccatcatggtttaatgcttctttagcatgaattattcaaaactgcaacatattataaaagcctttgattattaataaatgctatatgtaatttacatgagaaatctaagatcagaaagtacaggtgcccagagatatcactaggattcctcatgacaaactattccttcacatgcttttatgtactataaaaagtgggttgttgcaactgctccccccaacaactgtatacagtactgagtcagaactgttagatggaaaatactgtttgtataagtacttaacaattaaactcacagggttagcaggcacttgcagagttctagtttaataaagcccacattcagtccctctaagtagcaggtctgaatctttcccatttctaaagattctcagaattggagttcctgcagtctcagcaaaccactttaatgtttaacaactcacagtgccaggagaatctttcttacagccaacttaaatcctttaaattcttctttaagtctatttcatctagaaaacatacaatgttctgcctttctcacaggtattatttttcaacgctttggtaatctccgtgcctgtctcccttgccctccttttggttatggaaaactaaattgggtagggcattgtactgtttgtgccttaagacttctcagtataaagggagaattgcttcataatcttacacggtttagttctattcaagttggttagactatggtgttcatcttcccaaatctgtagggcttgcagaagaatttctgttacatggtcaaaaagtgtcctttctctcccactttggtcagtcatctcccaagagcctgactgacactatagagactggatgtgtgaatgtggatgggagaagacagcccattgaccacatggctgtgctggttgaccagggttcaccaggtactccccaccctcagggcactatttttattcactgctgggctggtttttactaaagtacaaattaatttactttgttatctaggatctacactttgactcactggaaggttctctccaatatttatttacacatttggatgtacttaaattacatatgcatcatttaaaaatatctaaattaaatgatatatgtactttctcaacactatttgatttacttggtcttcttttacattttattatggaatttgcatggctttttcaatatttgaatagtttctcatgtgagctgggcactgtatgaaaatttgtgtttattcattctctatcattggcaggtggttgagatgagtcttccaacaagttgaggtcctcttcccattacataacacttagcctttctccctaaggtgaagtggatcactaccttctggaccttagacccttacacacttgaaaactttcctaatctagataaatgtgtgtttgccttccttactaattaattgcaaaatatgaaactgtaaactgtggttatagatctttttttaattcagcaatacacattccccagttattttcaggttgacataactttattgatttttttcctttagtataaatgttaaactcagagatccataaaatacattcatctatttccttaaaaaaacatagctactctgactttttttttttttcaaatttagtgccaggaatgacctaaaattgacctttacatcaatgactttaattatttccactcactgaaactcagtttatttagtatagagatattcttagttgacttaactaactttcactaagatttccaatacttcaactttggtctttgccctttttatccaagtgtctctcctattacttttgctccacatttttctgttttattagaactgtttgcatgtagaacatggtcttaatattcaataaaacaattattggttaagactactttctacctctgctacagaaaggagaaagctacaatccctttttgacataataaggatttcttcttttgtagttctgatattatggatatctgatatctggatattatggataaaacatttcactttcctatagacataattcttcaattatataggtaaagtagttgtgtacatttatgttcaaatcacatgtctgtaaaatccaaacatgcaattttaagctaaaagtaaaaaagaatgattatatttatttcaaaggatttaatttagaaaacatgttgaatcattatatggaattgttgtaataaattcttaatgagttatttgagaaataaagcattttacccccaaacagtttttgcagatcagtaaactgaaaatcccagagtgaaattcagcttctatcttcaaagtgaaaacatggtaatgtcttttatctattgcatctttcttctttttagagactgtgtgtgaaaaaatagcatactgctttttaaacctaattaaaatgggaataattgagtagagatagtttatactactttaaatccagggacatattaaagaaagtaaaaaaaaaaaagaaaaatgagagaggattttatggtgcttaatgataaaagtctctatttttagaaactgtgcattttctaaattctaccacaatttatacctatccccgactctatctaaactctaaaataatatgactacatgatgactttaaaaatcattatgagatacacatatatacattatagacagaaaaatagatagatagatagatagatagatacacattgctatctgtgctcaagccaaagaagttttttatatattatgttatatagtcttctaccatcaaatatattaatggtaaaactttgttttaataattgggagcacttaggggacccagcaagccagtccacatgggctgctctgaaaagttggctgctcaatttaataattaaatttaataacttaatcagtaattaagctattcattgagaacatagtctatagattaattcagtgttcatgaacttctaagttctatcaccatgtttgaattcaataaaacaaatagcttctatgtaataagaaaaatatatttgacttgacttttagttatgtgatctgaaatagcatctcaagtttatattcgaatgtagtgccgttaatagtgagactatcattcgggatacctattgattacatgttaataataatggtagatatatattttatctgtggtacatatttagcttattattactcttttgaagtttagataaggttatatttcttaagaagtgcttattcctgggagcaccatagttagacatcctggaatatctttttctgggaatgcctattgtcttaatgcattgggtataaaggaaattttggggattgtcatcaaagtgaaaaatcagggtcgctgaatgttttatgttatcttatcttaagttgtatagctgattaaattggctaataggaggatgtggaatataaacaaacaagcattttaaatggaccaacaatctgctacagaattctcttgataaattacaaatgtatatctataaatgaaagaagttctagaagagatgaactaccttgaagatacatccatccatccagagaacttcttaaatgaggaaatgagtgcagttaaacccttgtcctttttttctaatgcctataatatctgactgtgtatattttcattatgcctaataaatacacattaaagactttcaaaattgctcttaaagtgatgcacttttcaagtgcaaaatataattatgaagacatgccctcctgtagagaagtcacctgcatcctcttcttgaattcatgaatgcataatactacctttcatgttggaattttcagacgttttcaataaagacgacttagttacaattcttataatacatgttctcttttttatgtcaagtatcatataaagcaacctcctttcttgtaattgcctttacagccatttcttctttcccctaactgatttcaataactttttagttagcacctatgctagttggtaccttccagaacctaaacaaatttgtgtttatttgacttcagaaagtttccatattaagaagacttaaataggtatttgagcgctataattttggcttttattagattacactacatttatttcataattgaaattagagggctcatataccttgattagtttcttttagatatatgactaaaatgaactctctgttttaggtttctgctccataatttggaactaaaataaaaatgaaacattttggtatcatgggtaggctaaatgtgcatgacatttaacatagaacttaactatttgtgacttaaaagaaaacataatgttagttgtaactgtgaaatttttgctgtataaagtgtatgcactaaaatacgtatttttatgtgttaagtaataacagagcttgaaatgccagttggttttaggctgtgttggaagcagacagcaagaacaataatatatatctcaaataactatcaagtgcctttcagtgtgaagttgattttttcaagatacacattgtcataattctttggtatatatgaacatattttgtataaaataatttgaataaaaattgaaataaaaatgctactttgcttgaaaatgcctttgggttataacaaatgtagtttttcataaaaattcaagtagcccttataaaatgacagctgaaaaagccttttgtagattgatttcacaaatcaggtttacttagagaataagatctggagagagaaattaaatatttgatatgttttcaagaaaaagtgtagttatagtgataatagtgatataccaatttccaagttacgtagtctctcttgttttggaagtactaaacttggaaggaaattctggaaaaataaattactttctaccttagacagcattttcagttgtagctaagacactctaaacttaattgaagataaaaaaacacaaaagagtattatggtgtttaaattggagcaggacctgtaatcccagcactttgggaggctgaggtgtgaggatcccttgaagccagagcttgaagccaggtgttctagaccaggttgggcaacaaagcaagaccacatttctataaaagaaaaaaatcagctgggctcagtggctcatacctatagtcgtagccacttggaaggctgaggaaggaggacagcttgagcccaggagctggaggctgcagtgaaccataataaggccacttcactgcagcccccaggcaacaaagggaaaccttgtctcaaaaataaataaataaaacataaaagggggttttgatttgctttttaaaatattcgctaatgatattaattttcctgagatgacactcagataacatgtattcaactaatctcttattttgttcaaatttgatatctaaattctaaacatatacttctgaagaactgataatatatttttctcttcacagaaaaggataaccatatagttgaatcattttcttttcttctttggctgggaggaagagacaaatctgtggcttagcaaagggataggaattgatgttggccttaaaagcaacatgatatacccttctctgctcatctcctgttcctagtccagctctgattctatttccaatgactctcgttatttttacatttatattttgctgttttaatgtacaaagtttctttcacatgacttagatctgttgtgaaaacaagttgggttgtaaatcaataataaaatattgaatgtccaaattaaggatgctactcaggattttgtactggacagcaatgagaatgattcatagagattattcagtttgttcatttctagcaagtataattaggactgccagttttctttttttctttgacaattggcaatttccttttggcaaattttatttcacttttgtgtgggtgtaagaggcagaatatagcttattttgaaatggatattgccagttttttcttttcttaaacaatcttcttcctctctattcttcttgccatcagtccttattcatttcattcacataattatcaagtttttcagcatctttttttggttcacacataaatgttggcatatacttctaactccagagatactagccctcgcaaatggtaagaactactctattctgtgcgctctttcacccaaccttacaagtttctcccctgttcaccatccacacgtaactttcatctttagttcagaatttacagctttccccatatctccattcagaacccacctaccagtgttcttcccctgcccttcttcccacagctattactcagcacttcacttgtcctgtgtacttctcagcaccagacaaatacagtcagcttcccctctttccactcacatatgtcccttccagttctttattttgctgtgaataattatgttctctaacgtcttccttggcaagcaaaggctatatgcattttctttttgtgaatgaaataaatgccatattccaaacaaaaatggccatggggcctctttttttaaatgacagggaggatagaggcatgccttaaattagacttgtcctattcatttgcttcatctgatatgaaaggaagaggcatggaggtggccatattacttgcattcacattctctaaaaacgttcaaaatccttgaataatattttaagtgtaggtgcatgatccagccttcacctacattttcagctttcactgtgtatccgtccacatgattctactattgtccacttatactgaagagttcttgactatgacatgttcgcagatgtttctgccattgcagacgctgttccctctaccccaaaaattttttacccttcatttgttgggccatatcttgtatattcttacagacttaactaaggagttcagtcctgcatttcctttcacaggtcaagtgcatctcttatagcctgccattacatccatcaattgccatcacatccattgaaatccttggggtaagtctgctgtcatccttatgtctgcaaatattctgccttattttactcaataaatatctgtagaatgaatgaacggaggtgtgaataaaaatgaatgatgaacaatatattattagattcttcatcattcaggacattcccactgatacatttgacaatagtgtagctggtatgaggaatattggaaatttccacctagtcattgacttcaatgtttagcttatgatttaaaaaccacttaaacttaatgaattactgtgaatacctcttctgcaatttcactgcaagaagcctccagaaaattggggctagctctacagtttagctatatatttatattgaaattagtgaaatttaaggaaatcttaagtacatatttaggcattaagaacattaactcacaaatatttggctaggcgcagtggctcacgcctttaatcctagcactttgggaggcccaggtgggcagattgcctgggctcaggagtttgagatcaacctgggcaagatggcaaaacccatctctactaaaaatacaaaaagttagctcggcatggtggcacgagcctgtaattccagctactcaggaggctgaggccggagaatcgcttgaaactgggaggcagaagttgccatgagccgagatagcaccactgcactccagcctgggtggcagagtgagactctgtctcagaaaacaaacaaacaaaacttacaaatactgatttttatgtgttcagtttctatgatatattatacctaaatgtatttctctctttgggtattacttctggccactgatagagggacaatattacatgaggatcaaaaatgaaggccctggagttaaacctcctattttcgaattctagttttgccattgactagtaattttataacttctcttaacttcagttttaacttcttcacagtgggaaacaatggttcctaatatggtgttttgagcctagtgcttgacattcattgagtgttcagtaaacattaacagtgattattactcagattgtgtgtgttgatatgtgtgcatgcgtatatacacctgatgttgtagtgggggaaaacttccaacaagttttatcaaactccaattgggataattatccttgtcttagttaatttaatgatttcaatagaaaataaatagatttcaatggaaatttaattagtataaatatgttcccttttgtcctggtggtaggtccacaaagaagatttttccatagagaattttttccccagttataattttttagaatgcagactattctactgatggattaagtggtcactgttttcatggcaatttttatcactttaagatctaccaagatcatttggtcaattgctttaggtataatttagtgtcacttatcaatccaaattgcagagtgctttattctatgtagcatttcagaacatcttttgctgaaggccacaagaaactgaagactggtatatataaattggtgtaatttgtacatgagttagttaagccgtattttttcattggtggcatatttaacagcttctgataaatgaattacaagttaggaacttgatcatttctttcctatttaggagtttataggaggtacataagaagaaggaaaaatagtgttttgtaatctttttcttttttttgaaagagagacaataattccctgaccaacgaccactgcagcctttgagatagcaacatcctggaaaagccacagtgtggttgtatcataattgttaagaatctccaattgcctgagtttatcagtcacatacttttcagcaaggttttgttagcaattgtcccttctcaggccagttaggatgggaccacagtatgtaagagaagcttggtcttcttctaaataataaattttatctaaaatatttagtcatctagggtagacatacagaaagaaagtaatactcttaggagtgaagagaatctgtttatttttatggtcagtttcttaatccaaataaactttttatcagttgttaatagatagttaaattctttgccttatttatagaatataaacattggaaagacccttagcaatctagattcttttaccaatctatatacttaaatatatcactatggtaggcagattaatgatatccccaaagatgtttatatttgagtccccaaaacctacaaatccaatatcttacatgacaaaagggactttccggttatgattgaattaaagaggatgagatgattatcctggatcacacagtggggtccaacttaatcacaagggtcataagagggaggcatgaatgtcagagagaaagctttgaggatgctatgcttctaggtctgaagttagaggaagaagtcacaagccagggaatgcaagtgacttcttgaatctggaaagggcaagtaaatggattctcccatagaggctcaagaaaaatcacagccttactaacatgttgatttgtgcccagtggagcttctgacctagaggactataagataataaattgatgttgcattaagccagtaagactgttaattcaacctcactcaaccttaacatggatgaatatttccaatggtgtgggagctctctgcttatcaaggtgatttcttctcctgtgagatgagtgaattaatgccagtctcctgtctctgcgcaaatgtcccttcctccttctttcttttactcactggacttcagtatgcctttttgaagcaagagtgtagggaaacaagaagagctctctgttcaacataatatccctttaaatattcagagacagctggtaaatttcattgttaagacataaaagggactgaaacatttgtgagaacaaagaacatcctatgcaatgtatatcacttgcattatttccttataagttgaaatttatgcaattcgaaatgctttactacacattttaatgtagtgcaggtttgaaatataacatactgatagttcttatattcttgataaggtggtaaactcagtacaacactatcatatattaaaaatactgttcacatttttaaatattgcctactttacccagatgtttccctgtcataccatctacatcctgtatccagagggtaaacagaaaaatcaaatcattttaaggggatattttaaggctttctcttttggttttttactcttctgcttacagatttgtgaattcctagggaaaaaagcattagttttaaataaaatgtgatgtatgaattgaagtaatagctataatttcataaaataaaaaaattctattctagacatagtggcatataaatggaaacttatttttaatttttgtattaaagaataaaataatatataaattatcactaatcatatgtgtacagctttttgatgccacgaatgtgaacagagaacagtataggccctggaagttttattttaaaaattaatattaaaaggaattttagtaaagaacacacagatttgcagctcaattgacagcaaactattgaaataaagccctcatttctgggtgtggataggtaactgcacaacgtctctgttgcttcacttttctgtttcactttgactggccaaagcaaacttactaaccacttgaaacaattaaataagagaatactgattaggcacaaatgaatggatttatgctaataaaacatatatattatatgaagagtgacatctgtgaaggatttcattatcttttccttaatattacatgccaattttcaaagatctgatcatcatgtagatttagaactgttttgcaagtggttaggaatggccctctgttgagttttcattacttgagaggagatatgaattatgtatttaatggcaagacagcaataaatgattaaaggaaagaaacctgtagcttggacttctcacaaaaatgaaatttatgtgaaaataatatgtaaactttactacaaaagttgttatacttccacaagcatgcatgaagataaaatacaaatttttgtcactatggaagcagggttattgccaagaagattgtagataaagcccaaacaatgctgatttaaatgaatttaaatagatttaaagaattgatcatgtattttaaactacgtttaatgttcttctttcagtattcatgtgctacatactatacgtttaggaagtgtgtataatatccctgggagaatccttggtgaccaccactgatgatttgctttcctgtcatcattgaaagaagatttgtgaaattgtgttacaaaaaaaccataaatcttctttatgtgtttcttccaatagtaggtcactttactgtggatttgttgttgtttttatatatcacactctgtttaaatctctatgatcatcaggatgcattccacccctgaagtgacagggcaaaccggtcttccacagggaatagagaaggtgagaaagcacagttaaagagaaatgataattggcctaaaatattcataaggagtggacttgggtggatttacatagtacataagcatccctaagtctgaaggtcttagaagtagaccaaatacatagtaactggaatacaacatgtgatctgattgtatgacaaatttgggtacatgaagttctaaattcttcattaagtcatgaatattaagctagccctaggatttaatttctgatcttgttgagtgctgtttcatgaggcaaggaaagaactgcaaactcaaaatttcttactcccgtgtttggaaacaactcagtaatacttgaccagtgtatttcaggtggtggttgctttatttttaaagctatgatatcctttgttcaaaggaaattctaggagccaggcaaaatagtcataagcagaactactttatttaaaggtggggggaaggtcttgaatggtgaaagcttcttccttttcctctgtatctgggcaggaaaggtgcttttggcataagcccagaatactttgatctgaataacacttagatggaccatgaacaggaagcagctgctgtttctaaaacatggttaaaattcatacatcttacctggagtaattaaattagctatctgatacactgccaattaattccacctctaagtgttgattatatattagtttcattctgtttgcagtttttatgaaaaatgttaaagtgactttgggagctcagccctcaggaactactgagtgggtaaattcaagaaagcacaagaaattttcccctgagctaagtgctcaagtaggaggggaggcccactttaaagagtaaagcaggaattagcagtatgtgtagcagaaacctggatatagaactaacatctggaagaagccaaagagttctagaattaaaaacaaaaatatttcaactggggagtccaagtcattcattcattctgtcagtcagtcaatcaatcatacattcaacaagtattttttaagagtatattgtctgtcagacacttgctggccatgtagcaaaactgaaagataaatcacattgtgggaagagcagatatgttttacataaaccaaataatactgggaagtaacactacttggataaatgactgtattaggtcattcttgtattgctataaagaaatacctgagactgggttatgtataaagaaaacagatttaattggctcacggttctgcaggctttacaggtagcatggtgctggcatctgcttggcttctggggaggttttaggaagcttacaatcatggtggaaggtaaagtgggagcctgcatgtcatatggccagaacaggggcaagaaaggggggtgagggagatgccactctcttttaaatgatcggatcacctgagaactcatatcatgaggacagcacaaagccatgagggatccgccccagtgatctgaacacctctcaccaggccccacttccagtactggaaattacaattcaacatgagatttgggtggggacaaatatccaaactgtatcagtgaccaaactcctttggataaaacagaaaaaagaaaaaagtgaggtaaggggcatctgaaatggatggactgagatagttatctctgttgtcatgggtcagttgactcatgcacaaagcacttaggtcagagtttaaaattaatttagatctatacaattctaaatttttatctagagacttttcaattttgctcttttgttttttaagtttttttttttttttttttaattttgaaacttcggccacctccaagtgacgaaggggattacagcaattgaaaggctcctgttaatcctcttagtttggttgtggggtgcagcctatgggccagtaccaaaagtgtgatcagctagaggctgaggggatgttctagatgtaagactgagaggaaagaaagcaatagagcactagattggacctggtctagtgtgaggtccagagtacctctttttcattgggtatctgtgtgtaagagaagcacagttggcccctgtccatagtgaaggtactgtttctactctatggaggattctctgttcctagtggtcaatgccagacatttcaatttagatgctgctaaatgaaaatatacattagaggtatctattcatcctactaagtatttattcttcaatgtgaataaaggatctggaaacaattctgttaatctaatacctcaggtgttggatctctgaaagaaaatgtgggaaaccactgaagagaataatgagagctgaagatgagtgttattgtaaggttctgctttgatggggtaggtttaggggcctctaaattgtagagaccacaaaaaggaagctcctaatagaaaaatgaggacttaaaggaaagggcactggatggaagagctctgtgctgttctttgtggaagaccctgtcaccaaagttcccagtgaaaagctctcagggggattatggctatgccttgaggctgggtggaattcagatagtaagttttcacaaacattttggggtccttactacatactgggtactgttacaggtaccggtgatagtgaagtcaacacaacagacatgctgtctgtgttagtggagactaaggaagataggcaacaaacagatttttatttcttaatgccttatataaaaatgtataagaatttaaaattcttgtgaagataagtaactgattctaaagaagaataaacagggtgaccctacctagtcctagaattgggtaagacttcccagagtaaatgatgcctaatctgagacatgaagaatgaggaggagctattttggcatagagctctgagtcaggacccaaggaatggttctttggaggttggctcagaggccgaggggcaacaagaaagcaaaggctgataggtgaggaacaaccatgcaggaccctgtaggccctgtaacaaggaaataagaaaatcatctcaagtagatagatatatggcctttaatccaactacagaactaaacgtgatcattccatagtcccaacagaagcttttctacttcttctcagtcatgccaaatgagataggtaaccatgacttttttgttgttgtttttattatttggaacaaaaatcagaaataatttataaacaagaaaataggagttccaaagttgagtcatcactaatttaattacatgtgcagtaaattcaggatccattcctgtgtatagctctataaagttaattttcagttcttctcttcttataagagtcaacagacgaggcaactctcctcattcctgaaaagcatgtatgaccactgaaatatgagccctttccagtgttgcttggtgacaaagcttgtctctttctatatttatttaaaatttgaaaataaaattgtgatgtgtgtagggctttgtggtatagtttatatatgtaagttgccttgattcatgcatttctgcatgttgtccctccaattttaaggtgggaacatggaaattttcccttctttgtactaagtacagagaggtgcttacaggtattgattttagagttggactgagctggtttgaccttctattccagctctgaccagctgtgtgactacttcaccattatcaggctcaggttgttcacttgtggtgttacttgtcttatagggcctttgcaggcagtgaatgagctaattaatgttgagggcttaacacagggtcttgcacaatagtaagtgtacaatgaaaggagctgatgattactttgatcacagttggcttattctgttaaaaacaggttttcatgactccttaaaatgttctcagtagtgacggggaacttaaaattgttgtatcaaattgttgaaattgttgctcttctggatggccctatcagatcacattatactgtagttggtttttattgggaagagaagttcaggcatgagggccagttagcatcatgttgagcacaactattgcaaatagcagccctgtgttttcacaactctcataataaaaaaatgttcagtgtgtgccctactttcctggtacagctttaattcaagataatgatacatttgtagtggcttttctatttctcgtggtgttttgtttttttttttttttttttttcagagcaaattgagttaagtagaccagttgttttcatgaacttgctgccaagtggaaggattttttctctcttttctataaggctagatatttaatctaaaactactgtctctgtgctgggaagcatccaacctcattactgtttaaatgtcttactgtctttggaaattctgatgaaccccaattagtaacccataaacccccccccccaccctgttcacttcgttatttaaaataaggaaatattagtgcaaaaacatttgtatcagtgtctagtcaggataacagaaattattctcagcttttcaaacagaggtaatccaataccaagtaattgtttaccgatgtgttaaaaagcctgagggagagaaaagagttagttgctattacccagaattagtaattgcaggaagtcactattgcccctagagctggaagggcaaaggggaaagtggtataagcagtattatgtggaccttacaagcatgtacctgggagtgctgcagctgctgctgaaaccacctgacctttgctttgcaggcatccatgagcccacagtcctgctggtgctactggactcactgacaaggtgagcgactggtgcctacaaccactggctgctgccataatgatgctggtattgcagagaggcaaccactggcctggtgctgattctgccaccgccaaaactcatgagcgctaagatgctaaggcagttggacacagaagcagaagaaaattaatcatggcttcttttcttctcctaacttccactctcccaccagtcctttcctttggaagacccaaccagagaccagctagcaaggggatctggaataggtactttactggcttcaagccagcagtttacaggcatgcagtcccagagtaaagttgaaagagtgagaatagagctgaatgctatcagacaaatacccagcactgtatttagaccatttaatataagattgcagaaactggccgggtgcagtggctcacgcctgtaataccagcactttgggaggctaaggtgggtggatcacttaaggtcaggaattcgagatcagcctggcctggccaacatggtgaaaccccatctctactaaaaatataaaaattagccaggtgtggtggcatgtgtctgtaatcccagctactctggaggctgagggacgagaataatttgagacccagaggcagaggttgcagtgagccgagatcacaccactgcactccagcatgggtgacagagtgagactccatctaaaaaaaaaaaaaaaaaaaaattgcagaaactgagaggaagtggcattaactaatgaaggaaattattttctgaatatatatgtatatatctgttatacagaaatctaaagaatgggtacaaatatttatattcaactcacacctcatgtattagtttcccactgctactgtaatgaactaccacacatttagtgaaaaaaataacataagtttattattttgccattctgtgggtcagtgtcactaggctataatcaagttataggtaaagctgccctgctttctacaggtattctctcaaaagagaattcattttaatgttttttttccagcttctagatagaagttccctacattcttaggctcattgcaacctatctccattttcaagctagaaacttcctctcatgctgccatctttatgattctctgtattgggaaaaactctttgctttaaataactcatggttcgatcgggcccacttggataagccaggatactcttcccatgtcaaggtctttagttttaatcccatctataaagtctcttttgacatgcaagacagcactcacaggtcctgatcgtggacatctatgaagatcattattctgcttactatatctcagaattttagactcctatacatctgtagttattcactggctattgttttccttagaaatctcaaacatgtaatctttaaaacaaaattactcttccaacaaatattcttcccccttggttggggacattgtcttcatctagcagcctaggcttgaagcttgagaatatttttctgtagtccctcattagattgggaaatctgctaattttcattcctaaatatatctccaatctacccctaccctgcacttctcttaccactcctatatcctgccaaggaaggcaggcattaccctgaaagtacttcttgattaatggtgcctagcattgtactagctggtggagccgccgatatgcataaggtatccatgttgtctgctccaatggaatgtgcagtctagcatggaaagtgcacattaaacaaataaatctgtggtaaatgtccatttctgatctttctgctcatggctccccagttccattttcaaaaattggggttttaaaatttctgaatattctaaagagaggacaatttgtgttatttaaaagtaatcaaagtaagtactttttgtgcatgtgtgtcacttttccctgattctgagatataaagatggcaaaaaagactactaaatgacatgtcaagtatggcaatttaattttaataaaatccagctagaatggctttagggctcatctccatcaattgttgtttaaatgagattaagttgaagattttaggcccccacactagacttaatgaatcagaatgtctggagtagggcctgggctatgcattttaaacaagtattccatgaattttttgtgcccattgacattatgaaattattgaaccaatgtcaactcatgaataatccctggatttataacactgaggccagaggatgaggaaggtttcatggctggctcactgtctgttctctcctttttccgctagtaactcctgtgaatattctctgtgaagcttccatggtgactaaatatctccctagtgcccagttcacaatcagagtaacatgcaggaagcactcactatatgccagacatacggtgctaaagtcagcctttcacgtgttgtcatatttaatccttaacacaaccttaagctggagacactgttatctttcatttgcagattaaagatcgaactttaacttcacattttactacattgcatggaagagtgctggggcttcattccagggctttcaaattacaaagctcaaatgtgaaactacttctctgagaattgactattattccctctctgtgccaccatgaaaattttcatattcttttattacagaataatggcatttaaattgttgattcacatatctgttctcctttcttcgattcccccagcaataggatcagtgtcttctttatccaagtaaatgatagccctaaggtgctacagggtctatgcgttagaagatactcaaaaaactgtccaactggtcattcattcattcaatctcagctgatttagagtgggtcaaaatgtaaatattaagtaaaagtaaaatttgggtatatacataatcaacaaaattaaaagataaaacttatatgaaaaggtgtgcaacatcactgatcatcagagaaatgcaaatcaaaactacaataagatgtcatctcactccagttaaaatggcttatatccaaaagacagggaatacaaaatactggtgaggatgtggagaaaagggaacccttgtacactgctggtgggaatgtaaattagtacattcactaaaaagaaaagtttggaggttcctcaaaaaactaaaaattagagacatactcatatcttcagcagttaatttgtatgtataatgaactgatattcagactttttttaagtaagaaattaatggtaaatacttttttgtcttttttttttttttttttttgagagaggatctcactctgtcactcaggagggagtgcagtggcatgagcatggctcattgcagccttgacctcccaggactcaggtgatcctcccacctgagcctcctgagtagctgggactacaggtgcaccactatgcctggctaatttttgattttttgtagagaaagggttccaccatattgcccacactggtctcaaacacctgggctcaagcgatccgcccacttcagcctcccaaaatgctaggattacaggcataagccactgcatgtggcctaatggtaaagactctaattgacaattacaaaaaactataaagacgctttctgagaacccaaagacatcaaaagtgtgtaaattcaaaagtgaagcaaatacttttcaacaattttatctcacgtaaactgcaaataatgatataatttgaaatctcttatctttcttcacaggaagaaataaaaatgtgtattttgcttcccttatcattatgcacttttacttattttataatgtactaattctgttcatgggtatgaatattaaaatctaatttatacatcaggcaacaaggcacagtagtattattatctcattcttttaggcacatgtagttaagcaacacatttcttgttagaaacacataatggaaacaaaaccccataaaagcgacacaagtctattttaatcttagaatttgagttctttaaaaaacaataaaaattccttcgtatgtatattaagccatttaattgaaagagtggagtaattttctgatattcacattattattgaagaatataagaagggtttccataatgcatactaatagaagttaattaaatgatcagggtctggttatctgaattggcattcaagcgtttattgaagtgtagctcatgttcttcctgaggatattaagagcagcagcagaagcctgcttaaggacttaccctgggctttgacttgctaaaacatgttctagagtatcttcagcctactgactccttgttgtagagacattatatatcagcagcttgactaattggtctaacattcttgaggtcacccagggctactggtcagaattcaaaactttttatgtccttgtcacaaagttgatcatcataactgcattatggaaagtgtgggccagcagactatatgccaaacacagcttaattcaataaacatttatggagttgctgataattttcttatatcatttattttatttaatatttctgtactcattcaatttacaaaatgctgagacccagaggctaaacaaactactcaaagtcacagttagtgagtgaaaaatctgagatttgaacacagatcctcaaatatgaaacctgggattctttctgccatgtgtgagtaggttcctttgaaaatatcctcaggttactcaggctcttattagcttcaagagacaaaaacccccgcgacactttacctgacttaagcataaaagaattaattgattgagaggactcaggggtagaaaatgtctccaggccttggccaagatgggaaaggaaattgggagctgaggtgactcattgtttatagtctatttccaaatatctcatctctgcttcttactttagtttcataatttgctgccttataaaagggctttctacaccaatttgtaagtagtgactatcccagcttttgtgtgagtgcgtgtgtgtgtgtgtgtgtgtgtgtgtgtgtgtgttgtgtaatagggcaagagaggagagaaaaagagattgggttggggaggagagggtgacagggtcacacatctgtatctcactcagggaactatggaaagatacactctgagaaaagtccatgggcagctctatcagaaggagatcagaggagggacagggaggacataattaatagaaataatctgcattatttatgcaaagcctttctcgtacagcactgttaaacactgatagttaaccccctggttcttccacttgattaggagccattttatgaatcttaattggtttctttatttcaatttagttatatatatacatatatgtatatacgtgcacatgtatttatatacactaatatctccacctctatataattatatttcaaatatgcaaatgtatgtaattttatttacacaggcattttatttccattaattaactaggagtctccttcatcaaagagatattttgatgcttcttgtagaaacacacagtgggaaaacattgccttattgtcatttataaagtaattacttatgtttatgcaaccatcacttggttaatattagcagggagaacaaggtagtgtgagaaataagaaatggtgcttctgtgagtagaacttgcttagctatggttttccagctcctctgatatggtacagtattctgtgtaaatatctttagcagcaagcatgggtgagtggtcttcctaagaatcatcgcacaaataagcatttgtgtacaagaggactcttgggggaagcatcatacttatttcaacttaatattatgtgagatcactaaacatttcttcagttacagaatcactggcacttctgcaaaaaggccaaacgtgcaaatgtcaaactgataattaccttccctttatgtggtaaaaggaatatagaaactgtggaaatcatctcattaaaaggtaatattgagtaccttcataaaaatcatcctggttaaaaataattcaaaactttgtctcttacagtttattattcagctccctcaccccataagtcaacccactaagcacgtggctaaagtgccagacttataaatacttgaagtttttgcatgtcgtttgtgctttgtgagattgtagaaagtaacagtaatgtgtggattttgggaaaaattctatacccaaaataaggcagtagaagtgtagtcctgatttcaaggggagaatgagaaagatggggactacctctagcttccacactcctattgattagtgctgtgactttgggcgcatctctacatgcttcattttcctcactgagacactgggctggaatagacagtattagaagttcccttagtgtgatgtcttcatccataatatcttagaggtatgatagtcatatttcttaaaaaatagtacattttgaaaagagatgctgatcattgtcgaaggtgagtgatgggtaaataggtttgttatactactgtcttcacttttgtgaataaaaatgttcagagaaacagggaaagagaaacatagctgcagagaatcgttacaataatatgggaatggtaaaagagtagattgaacttccttgcatcttccatcctaaaaaacatgatacgttagtttattctaagaagttactgcaacataaaatgtgatataaacggtagaacatagtaggaaatgggaacagagaagttggaaaaatttccaaggccccttgggtcattttggttgaaatgctttatcattttgttatgaatgtcatataagacatattcatagtcaagtttaatgaatatacatttaatgaatatacattacaagtttcatgaatataattaatgaatatacattacagagataaatggttcatgaattcaccatcattttggatcatgcattattgctctttaaagtcattagtttggaaaagtgagatttgattataatttgtgacttgctagcatgccctaactgggcaaaaaaagaagtgacctggataagggccaaatttcagagcaaaatttataaatacaatgtggctgatccataaagtatatagaacacaggagacaatctgcaattaactgtaaaagtttgaccatggaaatagcagtgtattaacccaaggcttgagctgtaacattagagcttgcacatattctaaactcactttctgcacagcttagtttcttctagagattagtgcaattatttatctaaacaaatgtttattaagaagacaacatgctgttcctgagctgtgtacatagtcactcggggacctttaaagtccaggattattatacactgccattcaaaactggatagagcccttttaccctggggccacaattggacattgaatctcacatgaaaggacagaaccaacctcactggaaaccagaataaagaggtgatcttccttttaccaaaaactttagaatcctaaaagtgacctttatatttttaaatatactccgcacattcactgccaacggccaagcttttggaaatactgtctatacttgtttcctcaccagactctcgctcctcaacccaccaaatcctgcttctgcctctgccactttgcataggtcaccctctccaagtcaccagtgaccttcttgttattaaacttacttttacatttctttgttacttgactttgaggcagaaattgatgttgttgagtattctcctctttagggaatgttcttttctttctctgcttttctttttctgcttcttggcaatttaaattatgttatcttagatttctttgtagatggctctttttattttccgtaggcatttctcaagatttagaatgaggctttcttctctgcttattctatatatttgtgtgggtaatagatagcaccattcctgaagtctcagtcattatccagaaattgatttacaaatcttcatgttcttgacagatctacctatgagctttgaggaaatacatcaaactctgtattggacagtataacgttgatgattctcagacacctcaaattcggcatgttcaaaacgacaaacctcatctcactccctgtgaaacccaaactgttgctcctccaatattcttgatcttagggaatggcatcttcacctgcctggtacttcatcctagactctttcctcttcttaacattctattttcagacaaataccaaggtattggacacgtctcttgattctttccacctctttctattcagtaaaggacactataggagtctgtttttgtacagacttctattatctctttcctagattgttgtaatagcctcttctcttaaggtgtatctatacagtctcgttacctagttctcatccgatctgtttcccacaattcagagtggtccttctataatgcataactaaccatagtatttctctcataaaaataaaactgctttccatttctattaagataaggtcatgatacttctttattccgctttaaatgtttgcataatctggccccataccttgctatccagcctcatctcttatgactcccctttgtacttgaggccctgccttgtagaaattctttcagttctcccaacacagtatgcttcttcttgccttcagattttagaatatccctctgctagaatacatacatatatagataagtacataaaatctcctctgccaggaacattcccctcctactccttgacttttaattggcttacttctatttaactttcagaaatccctgtgtctttgttctcttagaggcattcctgatcctctaaattaggtgaagttaggaaaccattgtaacttgtatatccaggatgacaacacttattataattgtttaatttccttttatatgtctggggtgaagggagaaagatcctgcatgctctctaaggtagaaattatgcttattttgcttatgattgtacccctgctgatgcttggcaaagtgcctgacactgtttttcagctcatccttgctgaataactaaatgcagagagaaaataaaatgtaatatttgtcatatactcccagtaccatttgagagaaatagtgggcaagctatttcaatatagtaccaaaggacaccttggcacctaaattttaattgcaaatagagtagatgctataccagtgaatttggggagagctatagagagccctttatgtgtttgtgtcttccatagtccctaggatatgactctgcatataatgggcaatcaataaataattcttggattaatgtttgaatgacttttatttgactaaaggaagaaattaagctcaataagcactgctgattttttttctctttactgaatgcagatataagattaaggggagatgtaggagatttcaggctaagaataatctttgggctaattcctcttttagcttaatttattttaatttatcaaactgcttttattctgtttttctttcctaggagttcctcacttatatcagaaaatactgttagtgcctagctatttcaacaaagaataaaatttaatataatttatatgacctacacctcatctaaagatagcaatactggagatatccaaccaggaaggagcaatttttgcttgataattccaacaaaaattgtttgatttccatttcaataatgaaaatattgataatggcctgtttatgagattgcataacacttttgataaaagtaaaattaaccttatggaataattcttacagatattttaaatgattcctttttgtgataagacactaaatatacaaatgaaaaaaggccatggcaattgtttacaagttgctggcaggaagatgagtgtgcacacaaacatggcagcagaatttctagaatgtggttgagtaccatgtacagtgaggacagaaaaaagttccttgagtttgccagtcttcacagaggacataatttgattgctaagcagaattttgctaagagaagtgaggaagggtgatagaagcaaagagcatggaaaaattagggaactgttagagaacaaagtgtgagaaaagactatgagaaaggagaaagagacaagagaaaaccataaggtgaatctgggtagcaaagtaagcatggatcagagaatcaaggctttgcagattatttattatagaattttgctttttatcctgaaggtgaaatggaatccattgaataattttgatcaggggaataatatttattgagtgctgactatactcaaattactgtgaatttacctgttaaccaaatagtgaactctgtgagtaagtgtttatgcacacttctttaaagatgttccttctcattgagtttaaaggccttattactaggagtttacatatatatatgtgacagatgaatctgagaatattacttaaaagatgaggtttgcacagttttgttgcagtgaatttaactgtttcaaactgtgaattctgtaatgaagtgtttaaacgttcttcaaagatgtcaccatatgatgggaactttacaccattgttttatgggttaacaccaataactaatcgtaaaatacagatcctgttatcactctcattgtgcagatgaggaaactgaggtacagaaaggtaaagaaacaaattacacttctaaaaagttgtagaacccggtttcagttcagcaatttgacaccagagtggctctcttgattaaaccttctgctatactgtctttatgtttgatagaaacatgacataactgagaagagagagtaggaagaagaaattggagtgaggaaaatgcctaagcagggcacagaaacaagatcagacaatgggaacactgtggaaaacagatgaggattggattgattggctgtcaatcataaaaagaaagaaaggaatctaggataatttttgaatttctgacttagcagccgtttggagagtggttcattttatagcaacaaagagggtatagggaggggtaggttgaaggaatgtggcggcagggaatgatgcattcatctagtgcatgtggaggtgcagatgcctgtggggttccagtgggacttcttgagaaggccctgcatgaggactggaggccaggtggaatttggtgtagtagtgaagaaaacatgtagaattaaatccagaacccctaatcatggcaacaaggccctacatagtgtaaccctggccactgtcaccaacctcactcccctcttgcttccagtactctggtctctctggtattccttctgtccttcaacacaccaagcttgctcctcccccagagcctttacacttgttgttctgtcatatagaatgttctgaccgttaccaccccacctcttttcattcagatctcagtttgagaaggcttcactgaccaccgaatgtaaaccagacccattagttactgtcaacattatgacttttttcatagcacatgaaaccatctgaagtcattttctctatttgtttatttgttttttgtttcctcttccagagtatatgctcactggaaacactggccttgtcttttttaccattgtatcttcagggtgtaggcaggaatgcaaacaacatagttgtataacacatatttgttaaatgaattaatgaagatacaaacatgtatttgaagtcattatctcttagatgggagttgaggtcatggcattaattagaatgaattagagaagtgtgcaactagagtgatcagggaaagagaagaatgccttgacaacactattattctcttcatatcctctttaaggataaatggtaatcttttcaactgaaattacaggtgaactaattctataaatattcacattcagttaaaaatggtttctttttcatttgaaatttatatctacttatgcttaaataaaatatatttggtctaaattgtatggaaaatctcttttacatttctgcctatatagaaacatactagcaaaagtattttaataaatccaaagtccaaccattgttagaaattaacaactaaacaaataaccaaaataaaatgtatcaaagttggtctttcaaaaatataagaaaacacagaaatggtaataagaactagtttttttgtatagcaactcaacatgaggccagctaatataaaatttttctcagatattataaactgtccataccaataaaaagttctaaactaatgagaaaaagtgagtagacaggcataatttgcttaaagttacttacttgtagaggaataaaggtctgcataattaatgtggtgaagttaataatcacaagaccctaaatgggagaatactgttatcttgcttttattgttactgttgttacactgttataccagtatactgttacatttccttttaccattggcaaaacaccttaatgtctttaggtctcagaatctttatctgtggaataagaggagtcaaacagatatttgaaaggtactttttgggttctctctgtatgctcttaaaatctatgcactgtttttactacatacatcctgtccacaggtaatcaggaaatttaagtaactgaccacaagggggagaactttaattctgcattaaattatttaatacaatatgaaatgatttgaaagtacttggctatgtgaggttggtgataggctgcttcatttccacttccttgtggaagttggggcattctactgctaacgataggtttaacttaattgaaatgtggttttgtgtttgtagagttatgatacagtcactggatgtcaaattctatttgtattaagcaataatgctccatgaagggatccagatgccttttttattaaatttatgatagtagaatgttagaattcaccctggaagagtttttcctttcaagtaatattatttaagttattctgcaagaaatctattaccttcttgaatgtcaactctgaaacaagcataggattatcaacggggcagtctgtactcaagtattcatataaaaagaaaagaattagaatggtgctggccacatcatttgaatgttatgtgatcattggctttatatatatgttcgctgttatatgaatattaaatattatatgttcacactgttaaatattcatttttctgtgggttaagttatgtactcttatttaaaattttattttaaggcaactatagctttctttatttttaaaatattttatttgaagttccaggtacaagtgcaggacgtgcagattttttacgtaggtaaatgtatgccatggtggtttgctgcacctgtcttcccatcccttaggtatcaagccccacgtgcattagctatttaccctgatgctctccctccccttgcacccctgacaggccctagtgggtgttgtttccctccttgtgtctatgtgttctcaatgttcagctcccatttataagtgagaacatgaggtatttggttttctgttcctgcattagtctgctaaggataatgccctcccttctccatccatgtccctgcaaaggacatgatcttgttcctttttctgtatagtatatattcatagtattccatatcacatatcacatatacatatatcacattttctttatccagtctatcactgatgggcatttgagttgattccatgtctttgctattgtgaatagggctgcaatgaacatacgcgtgcatgtatctgcattctattataactttcattgagttaagaattaccttatcagtcatactaaggcttaaaagtttacattttggatttcattaagctaaatttgtaaggtataaatgtaagatttctggattttatcaaatgtacccaaacatacacagctaaatgagtccaatttaaagacattatatcagtgacctatataagtatctcaataactcatttgttactgaagacaatttgtacttccccttagaagcattgtcacgctctttttaatatgttcagtgacagcagatctgtctttgagagtgagtataaattaaaaaaattctatcaatggagatcaaatcttaaagttactaattaagttggagtataacaataatttggagatcaaaaattagatataattaaaatatttaagctccctttgatttataaacctcctttattcaactgccaaagggtcccaaaatgttttcagcaatggtgttgctacctggacaaatataaatcttcctgaagtgactcctatacggggtaaatttatttgaatacattcattctgatgtgttcacaaaaatgaacaaataactatataaatgaaattgtttatagtcacactgtgtttattttccagttattttcatagtgagccttcatgaattctttaaaattacgatatgctaagtaaatcagcaattttatcgttgagagatattctataacttcttccaaaaatgattaagattgttaataattctctttttggcttagtgaattaggtttctattggtattctcacaccaaaaagtattatagacccataaaaaatctatgccaggcagtgtgttgaatataccccctattgctacttgtacacccagtgactagcacagtgattggcctactagtacatttttaccagtagctatccaataaattttggtacataaattaatgaataataagtgatacaaagagcttatacacgtatatattatttttcccattacatatgtattatttttccacagtgctgcgtaatcattcacccaaaccttagtggttaaataaacaataatcactaatgttcacagaactctgatttgggcaggactcagtggaaacagctcatttcttctccacacaatgtcaactgagctggcttcccaggtttactggaagcctggggtctggggtcacctgaagtctcactcactcacatgtctagtggatgataggggctgttggctgcgaccttagctggggatgttgtctgaaattgctggattgctcacagcatagtgtttgaattccaggagctagcattcaagtgagcaaggcaaagtgcacatttttatgacctagccttcgagatcacacggaataacttcttttgtattttatcggttaaggcagtcacagaagaggtctgcctgcattcaaggggagagagttagaagccactacacaatgggaggaatatcaagctcatgttgtaagaaaggcatgtgggattggatatattgcagtaaccatttctggaaaatacaatatgccatattttctgatttataaatatataatttttatccaaaattcaaacttctattcactagataactttagaaaataatattcccaaacaaaattcaccctgctaaaggaattctatctgatccaataaacatttattatccattattctcttacatatgctcgtcttctctcccaaaccactttcacattcatgctaatcctggaccaaggattgtatctttgttgaacgttttctctattccttttttgctgggaaaatatttacttacgtttccagtcagtttatcactaatcatttactattgacatgcccctgtgtctttttcacagttcaaagaatagacagcataatgctgtttaatattaggtgtttttttctaaattgatataaattttgaaagttatatactctttcttagctagaagaattctcattttatcttaaacatttttttctgttactaacttgaaagaaacttcagttaaaactgaaaaataccattctaattaatgaagtattacaaaatttggaaaatagaatggtcttccctaaaatttgattctgttatgtaacaatgatgcatatcatttttgtttattatatacattttgtttgttacatacaatttggtcagtattttcatatgcagaacaaaattttcttcaaatgaaaaattgaggtgcacactgagattggtttgtcctcaaagaagctaaaaatgaaaaaaaaataataaaaaataaaactataatgataagtattttctccattaactccaaagttggtttcgtaagatgttaaggtgatttgggacaaatatcattgcagttttcaaaatattgatgtcaattaattgtttaaacaagctaaaaacttttaaacaatgcaaaaaatattcatctggataaaagaagggatcaacttgaaattggtcacatagaaattatatataattagttgctttctagaaagtgaattgagaaaataaccagattgtttattttacataaaatcatttagaagtaagtgttaatagtgggcagataatgttttctgtgtaccctgccatattcctcagtgcctggcaaatgtttgtaacatagagggatgttcaataaatgatgttgcatggagtagcacaatgccacctgataatgtattttcatttcattccgaatagctattgttttctgtagctttataatggtctcaatattcttgattatataggccagaatatgtgggctttggaaatattttcaataattagattttgttttctgaatgcaggaattatacagtgattattcctttacttgtgctctcaaagcccttcctatatactgctactataatgatatattatattacattatatgtcatatcgtaactacttctacatgtacttgcctctaacctgaggttgcaagcaactcaagggtgggatttttcttctcgattttgtaccctcagaacactatacttctgctatgtagtagtgactgtttattaactcttgagggattggatgataatctgaattccgtttgtcttttttcagccatacttttttttgaaaagtgtcaattcatgaaaatgatgttaatatttgagagcttatgataaacttattaaacccatctacctagtaaaataatgtattgaacttaataccacaacaaatagatacattttaaagtttagctcaacatactctataaagattaatatattacctctgtgtatattgcaatgttctgtttcttttaaaagacaccagtaactttaaaaatgttttttttatttaagtagcacaaactccttaagagacatgggcacattatccctctcaatcctagaaacgtgaaggagcaggccataccacctcagaatccagagtgatgtgtatgggtctattatacatgtttataaatgttgccgggtccatgaattcttcggatttgcacaagtactttatgatttgttctgggaggagtaggtcaggtgcaacttggtgtaagttatcgcctggtcctttagtgcctactttcatagtctggcaaaggtagagtgacagtttatgagtttgtgtgagaaaatctgtgatgacctcctttagggactgtgactgtgtcacatcgtcgagatacataactggaacttttatcactgaaacatgccattgcataaaaagcctcattggaatgttatgagaaatgactataattttcatttgttgaataaaaaatactgtttcatctttgacatggccaatataatctaaaagaactttgtagagagtgtcgctggaggactcgaggatatgcagaatggaagtgggatagatgagcagcaatcctgtcactgcttctcctaggtgatgtttcaaaactgactgaaacatttgttcatagtagtcagcaacatcttttctttctacatttgcttgtatcttggccactagaaacatcctatcaagaaggaatttctttaggtgtagtcgttgtttctcttcttgaaagtgcaggtaattgctacgtgggacttggagaaaaagaagaggttccagtggcaaaggccttttgctgcccttctggttatggaccgaaaaggacatgaggagtcttatttatttttccagatgattccagcttttagcttatcataatatttatgctgccagggtacctctttactgatgaactcgtgtttttatttcttctgacaaaaaaaaaaagagtaaatcacggtttgtcaaatgttactaaatagtaaaatcccaatcttttgccagttttatcaggaaacaatgtatttgaaatgaaagacaatgttaaaacaatactcaaactatagacttttttaaaagtttacaacgaaagagttaaataatatcctaggaaaaaactttgtaaatgtcatgtaatggtgattacagattgtcctttataagccaaattttttaaaaatggtattttatggtaattcttccagtttcttttacaaatctaactgatctataacttttaaaaaaaaatccaaggctttttaagtcctaattagcttatgtaacctttagtcatgtcactaatagttaataatgttccttgaataataacagtaaacatttcaagggaaaagttttggttctttgttttttctcctatcgacgaatctcagaaatgattcatttctcccccctttatttgttttcttgttgtttttgttgttgtaagggctacatgaaagtattctgctactttaacttactctgcttacaaatctcctcaatttttttttccaggtcaacttaccatttttcttttttttcctgtgcttctgtcacgcacctgtcctcgaggccctacttgtcctccatcaggctcccaactgccagtcctctggtgttctcagctgtcctgtgttctgccttccctcgggcatacgtgagtcagaatgtcagcaccattaaaggaccagagcgccaagtttcttaatacgggtatctcgacaaacacttcaaagtcactgcagaggaagtgtgaatggcttattcctgaatggtttatttttagtcaggtgcatttgtaagtcagacagatggtgagaatctggacatctttttcctttctttttttccgtttgataaataaaaagtatggttgtagaactcctctgttctacttagacactaactaaagacttcaggaacacatatctgaatctatctaatggtgaatatatgatgagaaagttctatagtaagatttggcttacttaacttaatgtgattttaagagatgcacctcttaaaattgtgtcttaagagatgcatctcttaaaattgcatccacatgagttctaaacagtaattttaaaacaagtttaaaaaacgtttattcaatttttaacaatgaaacctaagaataattttttccctgagttctgtattatccaaactaatgatctaattttaatgataatacaatgataaattatccaagtaaatgaaggcagagaggtgacttaataattaattaattgtgtaatacataaaaatggactattcttcctcattgtgattcactttatcactccctgaagcaatacaatctttccgaagatgtaaaccatggtgccaaaccatgtcattgcccagtctagttattatctcactctcattcttcttacagctttgttggaagaaagtgtccatgttgaccagagccttcattatggccttctctcctctcctggtttctatgatactgcactttcttggatttctttctaaatctctgtatgaggccttgcccggcaataccttctcacatccaactctggaaaatacttaggctctgcgctcatgatgtggttggatctctcgctctacttctttgcccagttagctcagcaccatctatatgtctcttttgtgagggcaggtaagtggtccttaaagccactcttgccactagattgcacgtttgaaattggaaattgatcatggggctttccttctgagcttacctgtggactaaaaatatttttcaatctgagtctcaaggtagacacaactagttaattggggttgagaaagaagaaaaaactgagctcccattctagattatttttgcacagaaaattctcaaattattatctccagtcacttattcacaactcttctctccttggatgtaactctgtcttttcaaatttaaaatgaaaacatttaaacaattattttccttattaaacatgtttccctttacaaataccccacttgtgtctaaattaacatgttttttcctctcagttcccaggccaaaatccttggtattatttgttcatgtttcatccaagttatatactccaactctattctttttactaagtctttttactcactttaatatgccttaagggttcttgatttacactacctctttcatagtcctacttctttatttggattataataagggtctctacccacagtatttctagatttctccaccccacaaattcagctaagagtgtgaaaccataagccctttgatacatctactttataaagttaaaaagattctcattttacaaagtcctccctgctttctttccctccatagaatgctgggaggcaaagcctctgccttcaccacatccagagtgacttctggtatttatttccaatttccagtcatggattaaaccagagagaacatggggacaggcaatggtgtgatttgttacctaacacagctactgatcaaagtcagtaggagaatttatgaggtactgctacccaggagccccttttcagtgcacaaactcaaactagtcttttatacacaggtgagattcttcctcttcatgaaactgttccttactgacagcccaatttcttccctaacatggctgagaactatccctcaagataaggctaaccccaggatgtactgttccacctcaactttctgttgacttcatttacatatttttattataattatgttctcaaaatataaagaattgccacagcaaatgagagtgatgtactatcaagttttgaacaagattgttaactcaccttgtcagtttcccactatcttcttggattccctgaatctcagaataaataataaaaactatttcatagttctgcttgttttatcttctggctttgctcattctcctccaggtctagtttttgtgcactgctttttccaaatctcttttttaagagttctatttccatgggtatcagaaccttgatggcttcccccttcttctaaatcatagctccccactctgatcaatacttccaacacaatatctctctgataatcacatgtgtctttctaccttttactcctatcaaaagaagcttagtggtcatcttttctcaccatgtgtgctttttgttttccttttatttcatatatctagattcctccaatataaacctaatagaagaatgatatttcatcatgataaacatataaactctatagaaaatcaactaagctctcctttcttcaaaagagtgataatatcttaacaaagcctaattgttgttatcttgaaaaacatatgaactatcatttctgtaagtcaaaaaaggcaagtagagacaatgttgcatggttcaaactaatacattcagaagcaatagtttttaatctccatggatggtttgacatctttattccattttcccaatgtaattttccattttcaaattatttttttgctattgggttgcttcctaaaaattttagcttcattgtcacatggctatctgaaaggtttaaaggcaacttgttttcttatcattcatcaatcacactctgaactgtcaagagtaagttctgactagatagaaatagaagcaacatgcaattcagacagtttttgattcattgtcttgtgtaattagaattgtacactctctgctcaatggacattcagctttaagtgcccaggtgccacaatccttatgtgccatctattaagggcaagttatttaccttcagatggtgactcaagagaactcttctatctgtctgtctacgtatctggataaagaagcatttgtgttattctacccagagtgatctgtttagaatagctatccaagttcaagttcaaacaactgataagtcacagaaccttaatagaagcttaggatgccaagtcttctttcaattattctacttatctacctttttaattcaacttatctgatgttaatacatagcatatacttgtaactcgtgtcaaagagtacaccttactattactgatatacttatgccctggtttcctttttcagaaccaaatgctcctgaataacaaatttatcatgtcctttttgtttttgtaagccagacagaaaggattaaaacaattaaataccatttattatttaccatgtgccatgcactagatacttttacatacagtaactaagctacttttaacagtaaccctatatgatagatagaatcttttctacagtttatatgggaggaaaccaaaatttagagtagttaagtattttgcacacaattaaaatcttctctcagcagcctccatattctgtctacctgggtaaagaggaggtaaattatctcctatttctatccatgaccatagtgtcattcttccccctgtctatgagatgattcctctggaaccaaaggataccttatggtttggataaagtaaatttaaagaaaaacttctacattatacctaggtttcagcaacatttatctactgttattatctactcatttgtctcagatttattgacgcctttggtgtgccaggtgatatcattaggcactataagaaatgtaagtctggagcttagagtccagatttcaggagcttagagtcaggtacaggtgatgaaatgtacatgaatctgagatgttcttgagacagagcagggaaaaacaataaatatcatgcaaatgatgtttagtgctttagaaacaccaatttagaaagggtaactctggagttttcttagaaacgttagtgaaagagttctcatttgagcgtggccttcagagaaacaggattgaaggacagcctcatgaattggtctcacatacattcctttaaaatgtgaggttgtgcacttactaaacttgatttccatctggaataccaggctttaaactctcacctgtgctcaggtcctagcgaaacaaaacactctaaatcatttcctttcactttatgtcttatatcaaaatgatcagccaaagagaactaatcatctaaataaatggcttacaacttgggtacagcctttcactaagagcacatataataagctattgagtagacaaaaaatatatttgatttagcatagcaaatctgagtgagcttagttatcaaatcactaggtatttgaacatttattgaaaaagacattccccctccaagaaaaaaaaacaaactacattactttctctggcattgactctcttcaccaatagtattacggaacagtgtttggtaattacttatcaaggagagcgcaggctaggaacatttagttaattgattacaacatttcacatagttttcatctatttactatttgtagaaaaatgtgccaggctctatggaaatattcttgtgaatcagatattttatctgcacatgaaaaatttaattctgttagtagatcttaagatccccatgactatgtttagtacagggctggatgggcgtatacaagagtgctaagatataaacaatgaacaatgaaagcacaaaatttggaaacatttaaatttggctggaagaatgagcatttaagctgggaattaaaaaatagatatgatttgtgtgtgtgtgtgtgtgtgtgtgtgtgtgtgtgtgtgtgtgcttaaagcataaacagcagagggcatatgttaaagataggaagtgtggcacaccattaagaaaatggaaacaatctgttctggctaaagcactagtcctcaaaccacagaatctgcaaatttgttaaactgaagattcctggtctctaggccaaaaatgtctaagttagtaggcttaaagtgagacccaagaatttgcatttttgacaagtaatctcccagtctctctacatacctcactttaagaaagaagaggctaactcacagtgattcaaaccctgactgtctattagaataatctagtggagaattttttattttattttattttatttccataggtttttggggaacaggtggtatttggttacatgagtaagttctttagtggtgatttgcaagattctagtgcgcccacccagcaccccaaaagccagttcccagtcttacttaattaggaattccaccaggaatggaaccctggtgtgtagtttgttaaaacctctccaggtgattttaaatgtagcctggagcagaactgctagaaggtgagtggtgggaggagaggggaaaaaaaaaaaaagtaacttggaagcagtttgtggaggacttctatgccacgctcagaagtttgaattttactccgtggataatagagaatcatgagaatttcctgagtgcctgtaattataactgtttaggaagttgccctgaagtgcagaggaattggagatgggaaatactagaggcacccagagcccttttaagaactctgcagttggcaagtgatccctcttatcttctgccagcttaacagtaaattgtttcaactttgctgaaaaccaatttgcaaatgtaaatcataagcttaaaaatctactctttgactaagtaatgcctcttctagatcccatggtaagtaaataaaattatgagtttcacgttgaagctaagtgaagaaaaaattttaaaaaagaaacaaaattactgacaaacatttgaaatataaagacagtttttatagaaaaaaagaactttgaaaaaatgaatatatgtattaatgaacaactactatgatgcccttgaaattaattttgaagaatatttcaagggaggaaaaatagttattcactgaaacgaatagcataatatgaaaaattatagatatttaaaaataaaatttggatctgatatggtttggctgtgtggccccacccaaatctcatttcgaattgtaatctccatgtgttgagggagggatctggtgggaggtgattggatcttggggcagtttccctcatgctgctctggtgatagcgagggaattctcaggaaatctgatggctttaaaaatggcggtatctcctgtgctcgctccctcccgcctcaagtgaagaagctccttgttctgcttcaccttctgccatgactgcaagtttcctgagacctcctcaatcatgcgaaactgtgagtcaattaaacatcttttgtttataaattgcccagtctcaggtagtatctttataacagtgcgaaagtgaactagtaatatctttcttcaggcacaacttttttctgttttgtttttaaatcagtaaaagaaactgggtcctagaagctacagtggtctaagcagcagcaagtttatgcattcatttttgtttttgttaaaatacgttaaaattgtcacactgctggcacacctcatttgcatgaaattctgtaccacacttactaattgtagtaaagtttccccctatctcagggaaaagaaaaaaaactactctggaatgtaattttctctgagatctaaccgaactttgttaagtggattgggacaagattataaatgatatgaaaaataacattttgacatttgtccatcaaatttaagaaaataatttgcctatataatttttcgtaatttttttaaagataatatattctaccctcatgtggttctcagatttaaaccataatgaacaggaaaaaaaaaaagggaaagaatgcaactgagtgctaaggcagaacattgtggcagaagaaattaatgaaggtggagtatatactgaatatcaagtgcagaatttcatagagcaaacaagataaccgtctatatttttcacatatgcaggcaaagtggattttgcaattgccagttacgttaaatgcactaaataaaactcctaacattgatactataaggcacccccttaagttttccagtctgcaactgtgcataattttaaaatgtttttttgaaaaacattttaagtttaaattggattcccaaccttatttttaaaaagtcacagaaacaagaatagagagaaatctagccatgttttaactggtagaatttcggacggatatttgttttgtattttccaattttttcaagtgtgtctatgttattatgttcagaaaaaaaaacgttaaaaaataaggctattgcaatggtttggtgaatgatgatacatgtgttgctttgtttgtaagtctaggatagtctagcctgagagcctgctattgagtagaacttgtagaatgatggatcatgaaccaaattgaacaaagagaagcttcactctgggaaatctgtacctaccaactaggagtcaagataggaaaatataagggtataagatagggaaattactaagaaacagtccaggaattttagtccagacaccttgcatactactgagtaaaaggtgagtctttaaagaatttgcaccagttggatacagtctgaactaaagcagttgctaagactgaaaatgtgcaagccatcaccaaggtagacaagacctgattcactggatatgggaggttaggaatgcaaggatttagagatgacactgaaggtttgaatatcagttactgggaggactaacattttttctttaaataaagatggaagatacaggaggatgcccagatttgggaagaaaaatagtttgtgtagattatcttgaagtggagtggccatggaaatatccaggtatatatgtaactgtgaatctgaagatctgaggaagtctggacttatgatgaaaatttggtagttgtctgcattgagggtagaactgaaaccatgggaaacaatgaagtcatgagatagtgaaaggaaagaagaaggtggaggagcacattatggaacatccagttttagggagtaggcaaataagaggcagtgaaagaggcaacaacaaatcagaaataggcagagaattaagaaaacacaggcttatgaaggtcactgcaggagaaacgtttaaaagttggtggttgaggtaaaattctaaacaaaaataaaaaagcctaaggactggggtgaccatttaatattggcaattacgtttactagggatttaaagaaaaatagatctggtaaaatagttgagcaaagccaggttgcaagcattgagtggatcaaaggagaataagtggtcagagggtcgaccactcctccacatttgtcagtaagaagaatgaaagcactctgatagtaaactatagaggaggaagatagtagattaatagttgtatagtaatcctaggtttttacctattaaaaactagcatgctgggtttctttttgtcttttctatcattgtgtccagccaggaaggtggaatctgaaaatggaatactgtatggtatgcttcgaaaataccttaagattgtcagcttctatacagagatttggagactacatataacactaaactctcagttatgtttcttttatcttcttttaatcagttttttttcagcttctttgcaggacagaacactaaagctttatgacttaactaacacacagtgcacattatgatgaggtgacataaacacaaatttgaatttatttttttatgacttaaaatctttgtgtaatagcaaagttgctttacacatacaaattttattatgattggagtaatatcttcacaatttcattactcaggcccatataacctattatgctaaaatgtgttatcgataagctaatatctattttagtgcttccttttggttcagctttgaacaattgtcacatggaatggagaaaatttgactagtagaagtttagagctggaggggaacttggtacccctgacataacatactccgtttgcaattaagaaaaccatggcaaaaagagatagatattactgatttcaagttgcttacttgtaaagttgccgaaaaatgtgtactcatgaaatactaaaacagggagataatatttcacactagagtattttttaatatattataaaagtttcagtggataaagtggtgttagagctattctgaaagaagttgtaggaatctgaattttatgacacttaatattgagaaccattaaatgttttaagcagtaaagttatatgatgagttacacatttaatggtgactagttttgggaagacagaaattttatagtcaggtatgccctactaaaacattattgtattccaaatatgcaatgagggtctaggctagaatttagaactttaaaatgtatttctttttaaagtaacagcaatattaatccaagtctaaataacatattgtttttattccatgtaactagagtagcagtatagtaaaaacaacataataaaatatttttaaatattagctatgtgctagatgcctaagcagattgcctttaatttatccaacaagcctttattatcctgaaaccttcccagcatctattaaatttaaagccctttgtccattttaactcaaggtacctccacatttctttggaaactgtacctactaacactagcagttgtggacaattgagagacttatgtatcactgttttaatatatgtgaacataaggtacgatcactttttttgtgaagacaattttgtgaaaatataaaagggtgatgaagtagagcacagtgttgatggtgcctgcttcattaaggacagcacattcctgggggtctagagtaagaatgcagtggtatgggaagtataggcacctgtcctccatcatcatcatgaatgcctctctggtccatgtctcacctgtcattatagttctttgtctcaatgacaagtacctcttaactacatatgtgccactgttggcctcatggaaaccatttcaatagtggtacgtgttccaagagttcccaggcaaagctgttctgggctctgtgtgccttgcgtgctgaaatatagataatagctttgtgcttttttttttttttcctaactcaggaagttttaagtgccacattttgtaagatagtggctgatctaactatgaggaccttatttctaacccattgatttagctagtaggaatcattatttctatgtattttctatttaaatttttaaattttaaattggctatatccctcccactgttcagttgtggtatactcagaaaaatctaaacattaatcatacaaggtgaataaaagcataactataaaggcaaagttctcaaaatcatataattagtttcagagtcaaatattaaaattatttggattacccagtccttaaaattgtcaactcttttagctatacaacttgagtatagattgcagttgctgtgattatatttgctcctaattataatttttattaaggatagtttggatttaagagaggccacacttttttggtttggttttctgggaagagtaactttgttttaatcattaacagagttgcaagtgtaagttaactttcgtatctggcatttactctaccttaatataaggtagagaaatagcctggcctagtcattgttatatgggttaaatctctcatctgcttctcaaaataatgcatctatctaccatggacccacatttaatgcctatctcatttgaggggtgtgtgtgtgtgtgtgtgtatgtgtgtgtatgtgtgtgtgttgttagaaaagttcttaaaacttttcagtaataagccattatcatagtagaaagaaagcatacttttaagctttgcctcttgagcaaactgaaggcccattttagatctcaggctcacagggtccagggaggtgatatttaataagtttctagaggttaaggccaatggtgtgacctgtgttcagtgactcattgttgttagaaatttgcctccagtgatctatttgagaaccaggctagttttacattttttataaggtcattctccaagacctatgcctcttaaaaaaaggaaaattcttcacggtcatattattatattggaattcaagtgcaggtctctggcctagtgtatatcttctctgccttcaaaaaactgttttctttgtgacttaaaaaatgaaaaatccatatcttttttgactgaagataactttatacttttaacctatatttcagaaagccaatctttagagaaaatgaaatattttaagggaaaactaaagcatagccatgctctgcaaacttttaaaacattagtttcaggctgtgattgctgttttctatttgactttcaagttagttttaattggcataattttactatttaatagttaagcatttttttaataataagatataaaggtgaacaataaaaagaacaaaaataagtttatgttataaaaaataaaattaaagaggaagaattttgtatgggtagggtgatggcaaagtcaaataaaattcaaccacaccatacagaagagctagattaaatcttgaatgctttgtgttacgtgagtagaaaagaatgatcgctctgaatactttataacctctaagaggagagaatgttgctgcagcaatatctgggaaatacaatcagtgtgtctgaagccagcatctatttatcttaaattaatcatttttttttctgagtaagtggatgataatcctggtgctgggtgccagtgtctttttattcatgccatagataaaactagagcactcctatgttggtgagagctatacaatacaaaaggtctcaagctgtaactcttctgtaagattatagacagctttatagatttgcaacatgattttgggattgagaatcagtaaataattgtatctaaagtaaaatcttgtgcataatcaagtctattttacctttctgccctcaggaaagtataaacaaggtattctaaatataaggcagtaatttttcttcttcattattaaattctctggtcaaagaagttcctacaactgaagtggaaaagccttcactaaattgtaaactgtctggttgctgttagtgtgagccatagggtgaagagcagcatggtgcctctgatgcagtgaacctcaaatgacaccacattgaaggcccagcaatcaggcttacattcaaatatgtactcactttatctcttctgaaaagaaaaccaggccaggcacggtggctcatgcctgtaatcccagaactttaggaggctgaggcgggcggatcacctgaggtcaggagtttgagacccgtctggccaacatggtgaaaacccttctactaaaaattagccaggcatggtggcatgcgcctgtaatcccagctactcaggaggctgaggcaggagaatcacttgaacccaggagacggaggttgcagtgagccgagattgcaccattgcactccagcctgggggacaagagtgagacatcatctcaaaaaaaaaaaaaaaaagtaaaccaggaaagtagtctggatttttttttaagtaggtcttctttcctaggcattgtcagtaagtattatattatcatcttgtctagggtagagggtagagtagcaagaaggaagtgagatctcctcacctctaaattgaacagtgtactgggatttaaccatcttctaactctcgcattatgtctcaagaatatatgtggatatacaaatatttgtcagtagacattagacattgtgattaaaagctgtgaaaaatatgtaaaatacaatgaaattttggtcctcctggaaaagcatctaaaaagaattcagaaaggaatggagcaatgactcaacatatcagatttagttaagtggtactgatagcaggatgaaagttaacctaacttaaaaattaggtaaggctatgtggcttataagagttaagaactcaaccattggtaagttatgaaatcccttttatagactatgcatagggctcaaggtgacccttagtcacactgacaaaatagtcagcaactgggttgaaatcccagatcaatatagatcttcaattggctaagaaggtaacctcaaaactgtttgtagtgatatcatttccttcttagataaaattcttttaactctggaggatttgtaatttatagtagaagtatctaaaataactaaatttggcagcatatttttgtattaagaggaggtgtacacacttggtattttaaggatttctaatgtgaaagaatctgccttactaagtaacaggttagctttttaattccatcttaaaatgcataactgagtgatttagatctataattttaaatagaaatcttaccaagttttatataacattgaaacatttaagattttatgtatgtatacagaatctattattgcttgtcatctatctatctatctatctatctatctatctatctatctatctatctatctacctatctatctacctacctacttacttaccaatctaccaacctacctacctatctaccaacctacctacctatctaccttccttctgagctatttgatttgtcagccaggcaattttaaaggaattgtctttaaaggaaggatttttaaaaattgggccaatgatcaattgaaatcctcttatactattaaaatatgctagactaataatttataaattgattttaaaaacttgagggtaagtcaggttttgaatttgctaatttgacaaatttatattaagctttaaaaccaaagtaaacccatgaatttttttatgcataacagcttctctcaaggacacagaaacactttttattgacagtattgatttgtcttctcccttatgagaatgtgaggagatagaagtcaacacacatagttagttaagagtgagtgcttcctgccccaaatgttcccagtctttcagcacagttgcttctcttagcagtggaaggtggccatcttcaatatcagtaaccatcctgacctttctgagaccaaaggccaagtagcgatggaccaacctgagaaattgctctcatgtattcatgccaagtttccactcctttattgttttatatgacacaggtaatatacatttcttatagaacatttagaaaacaaacatagccaacaagaagatgatattcacttgtatctcgtaacccagataaattaaccactaccaatgttccgtgatgctcctctgtaattgcaattgcgtacagatgtgtttagtttgaaatataatgagttttagttaacaggtatccctgataatgttgcacactctcactcacacagtcatgcttttttttttctgccttgtattataattatggttttctaccttgcttttaccacttagtaacatgttatgaattcctgttattagtaaaataaaaataagaactaaaagtactttaaaatatatttaaagacaatgtaaaagtgtataaaaatcattaaaaagagctgagcccagggcctcatgcctgtaatccagcacttaaggaggccaaggcaagtggattgcctgagcccaggagttcgagaccagcctgggcaatatggcaaaacctcatctctacaaaagtccaaaaaaaaaaaaaaattatcaaggtgtggtgctgcacacctgtagtcccagctactcgagaggctgaggtggaaggatcacctgagtccagggagattaaagtttcagtaagctgtgattgcttcactgcactctagcctgggcagcagggcgagaccctgtctcacatttaaaaaaaaaaaagcataaaaaagtattaaagcgtaaacaataaagcaatagctttatgtttaatggctgcataaattccaatgtacaaatgcactttgttaaataaccttccaatcttcagcattttaaattgcctacttttttgttaaaataagcaacagtctatgaacatctttgaatcttagctaattcattttacaatttaagtaatttcagatgtaaaatatgtggcaaaatgattatgtattttgtaagagtttgacaaatattttcaagttatcctacagaaagatgaaccagtttatgcccaggagttgcttcttagttaaaaccttgataggataaactgagaaacccaccaaaattagaatgcccatctcagaattaaaaaaaaaaaacattaaaaaacagactaaatagatactagttttgttatcagaaacagttgagtttaaggtgtgaggtgctcttatgttaattctctgaccaaacctagcaaagatcctgccattacatcaaagtgttgcactggggttgtcagaaataccaactgtatggctgttggtttgcagccaataaacaagcaaaaaagctcaacatcactgatctttagagaaaattaaaaccacaatgagatacaatttcacaccagtcagaatgacaattattaaaaagtcaaggaacaacagatggtgcggagagatacgaacacttttacactgttggcgggcatgtaaattagttcagctattgtggaaggccaagaaccataaataccatttgacctagcaatcccattactgtgtatatacccaaaggactataaaacattctattataaaggtacatgcacatatatgtttactgcagcactatttacaatatcaaagatatggaatcaacccagatgcccatcagtgatagattggataaagaaaaggtggtacatatacacctggagtactatgcagctataaaaaagaatgaaatcatgtcatttacaggggcataaatggaattggaagccattatcctcagcaaactaacacaggaacagaaaaccaaatgccgtatgctctcattcataagtaggagctgaacaatgagaacatatagacataggaaggggaataacacacactagggcctgtgagacaggggagggagagcatcagaagaaaatagctaatgtatgctgggcttaatacttaggtgatgagttgataggtgcagcaaaccaccatggtacacatttatctctgtaacaaacctgcacaccctgcacatgtaccccagaactttaaaaaaaattgagaactttttgatgatcatataccatgtaatatcttttgtcgataaattctcatatacactggaaatctccgcttcttgttacagtagcctctaccagagtaattaaaatcatgtaggagtggtacaacctttcttaacacagccaatatagatttcatggtataatagttgagtacttaggcaccagccaataatccatccctatgaatccaaggaagattgtccttcatccattccaaagaaattgacctttatccagtccaaaagtcatttaattttgtctttaatatttctggtaatatagtgtccattacccatgtgaaaaattagtgtgcacttaacatccattacgatggctactatcaaaaaaacagaaaataacaactgttgacaagaatgtggaaacattggaatgcttgtacactgttgatgggattgtaaaatggtgcaaccaccatggaaaactgtatggaggttcctcaaagcacaaaaatagatttaccagatgagtcaacaatcccacttctaggtatgtagccaaaagaatcaaaagtagggtctccaagagatatttgcccacccatgtttataccagcactattcacaatagctaagaagtggaagcaacacaactggacactgatgaatgaattgatttaaaaatgtggtgtgtgtatgtatatatatgtacatgtgtatgtacgtatatatacatatacacaatattattcagccttaaaaaggaaggaaatcctgtcacacactacaacacgaatgaacctggaagacatgccaagtgaaataagccagtcacacacacacacaaccaaatactgtttgagtccacatatatgaggtatctaaattagtcaaattcctagaaacagaaagtagaatggtggttactagggaccaaggagaggggaaaatggggagttgtttaatggatataacatttctattttgcaaaaaaaaaaaagttctggagatgtgaatgtacctcacactattgaactgtaaacttaaaaataattaaaatggtaaattttatgttaggtggtttttaccacaattaaaaaatggtgaattacatgtaatgtcaattatattttaattttaaaattaaaaaatagtttcccataaatcttatatagagttttaaaaacatgtttaattctctcacgcctataataccagcactttgggatgcttaggcggttggatcatgaggtcatgagatcgagaccatcctggttaacacggtgaaaccctgtctctactaaaaatacaaaaaattagccaggcgtggtggcgggcgcatgtagtcccagctactccggaggctgaggcaggagaatggcgaacctgggaggcggagcttgcagtgagccgagatcacgccacagcactccagcctgggccaaagagcgagactccatctaaaaaaaaaaaaaaagaaaagaaaaaaatgtttaattctctgtgtgcggtttgctaaatatttttaagtgttattatattttcttatgtagactaaggtttcttactgtagttgtttttacatggcatcaatttcttcatgtttttgatataaactcttttctcgctactaatatatgagatccatattattctgttgaaattcaacataacaaaatgtatcttggataaagtctagacataggaaagaagtttattgtgttaaatactagaaacttaggacaatttttcaagtcatacccgtcctttttgaaatgtaatttggaaatattcttaagatccacataaacttatatattttcttatctacagggtattttatccattaaagatgctacattagttatatagttgttatacacttaactactctaagacccttagcaacagtccatgcataattgcttggagttttaaatgctaaagaaaaatggtgaatttgcactcactaggttttgtagtgaattcttgacatgcatagccaatgcaccatcaggctaaatagtactcatgaagaaacagagataagacacttctggaagtgtgaaaattctgatttgagagaaatgtatgcagaattgatatttatagtacttattttctggctctaatatgttatatattctgctcttggatattggctaattatcatgtcagtaaatgctgtatctggaaaacattttgtcaagtgaataagacttttcatatttctggtaaaagaacagtatatatacttttatacatgtttccaaagatcaaacagctttaaaaaggtgtacatctggctattatttaaccagactgaataatgcatgaaagaatgtagactctttggaataatgtgttattttaattcttacatgactctgttacagagcaagtttatttccattctgaggtttgatgtataatctttctagtcatagaaccatatgaaccaatcactgtctcttacctcccttcaaacacacacacacacacacacacacacacacacacacacacacacagaaagtttaatgataatagcactttttctactcatatactcatagattatgatgagactcagttgaggcaacttagttcattgaaaagaccatggatttcatgtaaagacaatttggggtttaaatttggcctctatattttattataattggaacattaagctatgaatgaaatcttagacaattttctaatttaaaaaatgggaatagatgccaatgcctacctaaagttgttgtgtagagcaaaatttgataatattaagtgtctaatgtaaactctgacatccaataaaagtttcttccttctccttcatttcctacagaaagatttgaattttttacttttgtttccccttacttttctttcatcttgaaaaaacacaaacaaacatgtcaagtttataactgaagacagataagaaaaattttgaatagtaccctgtttataatcctgagcttttagtggaattatttctgaggattaatcttgtcctgcaaatttcttggtttaaaaataatatatatattcttatatatacatatatgtgtgtgtgtgtgtatatattcttacatatatgtatatatgtgttcatacatatatgtattatgtatattctcacatatatgtatgtatggcatagataaattacaataaaagaatattctaaatgttatatataataaaatatataaaatatatatttttatatattctctatatataacattttaaaagttattttattatttaattgtaatctcttatctatgctatccatatgattctgtagaaactcagtataacaaaatataacttggacaaaagctaggcatagaatacaatttattgtgtttaataccagaaacccagtacagtttttcaagtcaagttttttccatattagaataccagttaaaattagtgtgaggctgtgttattattaggatatgtatataactatatgttaggtatgttattagaatatattatatatattattattatgatatataatgtcccttgtatgtaaccaatctcacattgttgctgttccttcccccttgtgggcacctttccccacttggtcatgctctgatatcccatgcaaggtagctcctccttcccaatgtcctccttcaccttctcaggctctgacacctttctgacactttcactgtgtagttccacccactggataacactttctcagcctgcttaggttcccacacaccgcactcggctttcctcttttgcatatgtgtacctccctgctcttttggggctctgtcttcccatgccaagctgccttcctctcccactgcatggtcaccatttttaacctgctcatgctctgtcagcacactctaggacacccattcacatagccctctttacctttgtcaagctccagaatcccattttggtcattctttctcaaaatgtggacactttccacccttcttggtttctgtcaccccgtaccaggcctcttgctgttgaatgctcttgctatcctactccgactctaaatatttcacaccaggcaattcctccctcttttggcaggatatcctccgcacccaacttcaaatttaacacccctcattgagctttcctcttgcatgaatgtcctcatcaccctgctcagactccgttaccccatgccaagctgcactcacatgcagattcccttcctattacactgggttccaaatcccctttgctgtgccttcttcctgtgtggatgcttcattcaccttgcttagacctaaaaccataaaagctgcagaagaaaacctaggcaataccattcaggatataggcatgggcagggacttcgtgtctaaaacaccaaaagcaatggcaacaaaagtcaaaattgacaaatgggatctaattaaactaaagagcttctgcacagcaaaagaaactaccatcagagtgaacaggcaacctacagaatgggagaacatttttgcaatctactcatctgacaaaaggctaatatccagaatctacgatgaactcaaacaaatttacaagaaaaaaacaaacaaccccatcaacaagtgggcaaaggatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttatgctgttggtgggactgtaaactagttcaaccattgtggaagtcagtgtggtgatttctcagggatctagaactagaaataccatttgacccagcaatgccattactgggtatatacccaaaggattataaatcatgctgctataagacacatgcacaggtatgtttattgtggcactattgacaatagcaaagacttggaaccaacccaaatgtccaaccattatagactggattaagaaaatgtggcacatatacaccatggaatactatgcagccataaaaaatgatgagttcatgtcctttgtagggacatggatgaagctggaaaccatcattctcagcaaactatctcaaggacagaaaaccaagtaccgcatgttctcattcatagtgagaactgaacaatgagaacacatggacacaagaaggggaacatcacacagtggggcctgttgtgggatggggggatgggggagggatagcattgggagatatacttaatgtaaataatgagttaatgggtgcagcacaccaacatggcacatgtatacatatgtaacaaacctgcaccttgtgcacatgtacgctagaacttaaagtataataaaaaaattaaaaaaaaattccaccatcccttaaaaggctgctctctccataggcagttagcgctaccaacctaatggctctatggtggaattgtccatgaagggaaaggaaagaaagggagaggatacagaaaagattattagtgacttgctctctattttaaatatttaattgcatttataaaagtaaatattttattctagaatagcttcaggtttgcagaaggcttgcaaaggttgttcagggagttctggtataccctgcacccagtatacctaagatcttccattggtgtgatatattcatcacaactaataaaccaatattatggtacattttgtatcaacatccataattgactatgatttccagtaacatttttaaagaggagaaaaggatttcatctgtttttttgcatttatcctgtatcttacaatttccccccctgaactgaactgttattccaatagaggaacactgaaattactggtgtgataggaattccctaggatattgtcctcctctttatagatttttgtggggagttgctattgtaacctataatctgcagcccagcattccttttttactggacagataattttgtgagatgaggcctgtaaagtgcttggcattgtgctcaggccactttatttctcaggcactggagcagagtgctaggggactataggtttttcagtgactgtaaaagaaaaagtttgagatgaggaaaagaaattgtccctggaacctatttttaaaacagcaaaatctataataaatgaataaatgttttattaaatgtccatgaagcataacattatatcaacttcatgagctattaaacttattagtcacaaaaatgtcattatacttgaaaaaatatctgtaggttagattttcttcaccaaaaatctcgagttggcataaagtcattgctgataaattagggattatcctaattaaataaataacatatagccaaaaattttggaagcaaaggggataataattatgtccatttttttcttagaaaaatatatattaatgaaagatagtcaattttaatataccgttatgatgcacatgaaagtaataaaaatgtcccacctacaatgtagtgagtgatcagcaaattttacttctctttctttcttctataaacaaatattttgtatcatggggaattataagataataatgtagaaaatgcatgcattggcaaattccaacaggagatttgattatttgagttcattttgaggggattccatagcataggatataggaaaaataaacttagacttgtagtcagaagccctgggtgactttctcctctgccacttagttactcattaatgttagaaggctgtgtgttgcctcagagctttgatatcattatctgtatagtgggaatgctaatcatatctgtgtatcaacactaaagtactgctcatgaaatcactcaatgaactgtcaggtctatcacaatattagatgaaattgctggtcattattcttgttgttgtactactatgtcctttctttagaagtatgtcagaaccagtgaggttgatataattagaacattttaggctcctcatacagctttcaatgtcaattttcagaaaaatacagattatttaaataaacagcagcaggagatagtagcgtgattgactgtattttcttcactgcccattgtgataccctgtgaaagtatatccacattttcttttttttgttttgttttgttttttgagacaaagtctctttccgtcacccaggctggaatgcagtggcgcgatcgtggctcactgtaacctccacctcccaggttcaagcaattctcctgcctcagcctcttgagtagctaggaccactggtgcatgcctccacacctggctattttttttttcttgtatttttagtagagacgaggtttcaccatgttggtgaggctggcctcgaactcctgacttcaagtgatcagcctgcctcagcctcccaaagtgctggaattacaggtgtgagccaccgtgcctggccagtatgtccacattttctatgtctccttgatttattgatggttccaatgaagagggggttacctgaggcattttggggcagacacctcatgatagatcccaccaacttctttctgcctgctctcttggaagatatatacccatcttgaatgtttcctgcttactgacttgtcctagggacacaaaagtgctaagtgtatacacttttatcataagttttaaaaatccacaaataaaattaaaaaactattaaaaaatttccccttcaataattatatgaagaacatgaattgctaggtagaaagtcattataaaaatacatatacatttaacagtttcattgttttccaaaaaatttagcgcaattattctgaaaattaaaagaaattatgattccactgcttgaaatcctggcatttattgaagattcctcaaaagaactgacccatttgtattggcagggtcataaaactgctcagagttttgctcaggaagcatagtttgtcctgtgaagcttcttaagggtaacttttcaacacattataaatattttaaatcaattggttgaacttaatgtcatttaagttgtaatgaaagctctactcaaatgctgtgccctgaaaggacaagataataaataaagatatatatttttgccacttattttttagcaagtcctgctgaaatgggagaatgttttaaattacaaagcaatttaagaattctaaggagggcatatagattcataacttgttgcatcttttgtaggatacagccagcctgtacttcatgatacaaaacattctacaaaaatatgtttgagaagtcaaatgtctaaaaaaatacaatagacttttttatggtatgggtataatatttcacttttgggaagctatcaatgagtaccatttcttaagcatcatccctgctggcagtgcctttgcctcctagggttcaggtgttccagtgagtgggttcagaccttcacaggcagcaggagaggcaattgcctgcccattatctcctgggaaaaagagaagtcaagccatgagcctccctttctcataggaacgttgtctctgtctgatcctttccatggggacttgatctgaattctgggtggcttgcagttgttaagtcacttgaagtagatgcctgtaatgttctggagcatggtgaagggaaaagtgagtgggatatgccaggcttatgtatgtggctgcctgtgggaaactctctagctgtcttctaaagcagcactgcaagttgccttttcttattgctgttctcactgcctgcaattgaatgaggactgaggaggagggaaggatttggaaagaaagagaataagttgggtaagggggtgctggcagtgacggtgacaatgtgtgaactgataggtgtctgagagtcctaggaatctgcatgggacccctcagcattgaagagagaagggaggggagaaaagactgtgaatatgctgcagtgagaattgtcagaaagcagtttgttttttggcttggctggtgctgctacaattaatagcctaaaagtgtcacagctacctcatgagggctgacttttcttcccttgctcaaacctccatgggtatctctaaatcattgtcagtcaattctggaataaaattgtgaatttggcctacagaaggtggtttagggcatgacttaaaatatacaaacatatctattatgtaaatgtcaagaatcaccttttccatgtgagtgtattgaaaaaactgttatacaccataattccctggtcacaatagctcctgaacaagtcaaatctatatcaagtccaagtctagcgagcattgctaagtgctcacattaattccaaagtacagtttgtatttacttaaatcctactttaaataaaagaattaaatgaccagatagatatgatgaatctatatgtgactttactcgatattttcagttgtttttctgtgtgttgccaataattacaaatggtgttcataaaatcccaatatttccaatacggatatactttaaattttaaaatgtatttcttgtatatgcagtaccatggaaaggaggagaatataatattgaatatagtatatttaaacaatatcctttggccacgtgcaaggttattgtaaacttgcagaaattatagaattaaaaccttataaccatctctcacaggtacttctgaaggagaaataccaaagtcaaacattcttttagaaaaatattggcttcttttctttcaaaataccatttctaactaattataaaatcaaaggaaaccactatagttttaaaagtatctgttttggctagttgaggaaagtcagttattattcagctcacgtaacatagttcatcttatatatgtagcatttttattactgttctagtactgattttagttcattgcaatttatgctatttgcgctctatttgaaacacttttttacttcatatagaagcaaaaagtatgaggaatgctggagcaccattggcttttggaaccattctattctgttattgtaatgaaattattaatttaaggtggaaatccaaaatgttctgtatggtatggtgctagtacaaacggtcattgactcctgtacaaattaagctgcaacactgtttagaaagattgtgggactgtaagaccaactaattatacttatccattttctttttatcacagtgattttcttatcagagttcttaaggcaatgcaactatataggaaagatcttttactagtgctagttgaaacttctgaaatagccttggttgtatgaagaatttttttaagtgagaaccaaagccagatttatttttatgggaactaaaaacatggatactcaacctcgattaacctcatgatagtttaaatacaactaatcttggtttcttgtttatcgagtcattttctctacttaaagtttattaatattattgtcattactgtttatagttatcgctaaatacagcccacaggccagttggtgctgaaagggaagaccttttatcctataatgtttaattacttctttcagcttgggaaagtatgggcagaaagatagtgaactttagcataagaacaattgaacaaagttctatttagtctgatggttttcctcaattgtaaaattgattctcttgatcaatagtgtagagagaaaaaaaggtaatgctgcagagaagtgaggtggaaaatggtaccattcaataggacttgacagcagcaccacaatcttgtagtggcatagattccaagaatagctctgttcatggccactagtaaatacaaataaaataagcaaacacaatttaaattattttccactttgatttagtcacatcatttgttttgtccattattttgacagagtcctctaatgaagcatttacttggtacaaagaattgtgtaagggatggcagatatattgttagaattttctatgtaagtctagttataaaaatgcaataaataggccggacacagttgctcatgcctgtaatgtcagcactttgggaggctgaggcgggtgtaccacaaggtaaggagttcaagaccagcctggccaatatggtgaaaccccatctctacaaaaaaatacaaaaattagcctggcgtagtggcagatgcctgtaatcccagctacttgagaggctgaggcaggagaattgcttaaacctgggaggcagaggttgcaatgagccaagatcgcatcactgcacagcctaggcgacagggtgagactgtctaaaaaacaaaacaaaacaaaacaaaaaaccaatacatatataaatatacaaatacattcagtgaagtcatagtgcatatatacagtagtgagtgaaatactcaaaacacaaaatactcagtgatctccatgatgcctcttgcacaggtataaacagcctggacagtaatttttcctgagaatgcaagaatatgaacttagatgtacttgagattcagatgtattatactgacaaaggtgtttgacaaattatctcctgactgatgccacaattcaagatgggataaaggattttctaatagataaaggtcaccaggagaattttaggggtctgacagggggtgccaggctcagaatcagggcatagatggtgggaaggaaggcggcaggtacgagatttcagtggggaatggcagtggtttccagtgcagtgagctgagtacaattgggtaccacccttctcagtccccaggtaccatgagcatgtggcaaattgtaaatcactagttggacaaggacagcttctactattgggatctatggatgtgctcactgatggctggacactagaaaaggaaggtgtttgcttactggcttgagagaacaatgagaagaagaggaagaaaatgtcagtaaaaaagaaaagcactgatggaagcataagacctgaagaggctacagaatgcaggaggtcctatggtggccaccccagaaagaatgagcagcagcctgaatgctcagagagaaaggaaaatgggacagctgcagatggcaactcacagattgcagcctagatgctcgctggcctgctactctatccctgacttcacatgtacaatagcctgtgtcctctggtctccatggtgcagagaggtcaaagtacactggtctggtttagccttctctacaatcccaatttttctgagagcattagaaaagacaaaagaaatgggagtgctaagcatttggtatatgagggtgatatggtttgcctttgtttccccacccatatctcatcttgaattgtaatcccataatcccacatgttgtggaagggacccagagggaagtaattgcatcatgggggcggttagcctcatgctgttcttgtgttcttgtgttgttgatggttacataagaggcatttcccccacttcctccacatttctccttgctgcctccatgtgaagaaggacatgcttcctgttccttccaccatgattgtaagtttcctgagacctccccagccatgcagaactttaagtcaattaaacctctttcttttgtgagttatccagtctcaggtatttcttcatagcactgtgagaacagactgatacgtggggctactaaatcaacatatgtacaaactttaccttatctagcaccttcaaatcaatgttgtttaaacaccacttcttgacctgttcctggccctttcatctatttcttcactatctcccataagcttgatggtgaataaagctcattttgtgttatcattgactttctggctctgtccttgatttcaaacattgcatctgatgcattccagatcgtggaaccctatcccagaattaaagttaagtttgtcttagcctttataagtgtggagtaggcagacaaaataatacgatcaaagacttacaatcagtagtaatgatcaaacaggtctatgaaggaagtttagaataaatagctaatgggttataaaagttctgaatggagaaggcaatcttaatcatgtatagctatatcactgaggggaaatccaaatgatcctggctttgaaaacggccttagaaacttctaagcctaaacaaagtcaatgacatattagagattttctggtacatttatgtcctcatctggttctgtattcaaaggcagcaccatttcaaaaaattggatggaagcgtggattggggagtgcagaaggagctgagtgggatcctgtgagagatgataatagtgcataagtgcatatctcattttccagaatcacattgctcaaaatatcagctactttatcagcaaagctagaggtcctggcagtggtggtggtaactccacagcttatgtgctatggactctctctcaataatctccaaaaatcgactaacaatgagaattttactagaaaaagaaatgactttaatttacagagtccaaagaccataggtcactagtctctgagcatctagtatatggagaaccagacataccaatcagacactctgagaccccagcagcactctcagattgcagcctgcatgctccccagcctgctactctgtccctgacttcacatgtacagtttcccacagatacctgtgtcctctgtctccacagtagagagaggtcaaagtaatataacagaatccagaaggcctggccttcagcatcactgtgtccctggctaatacaaaggccatgtcacttttccttgctggtcctcatttttctcactttttataaaagagattgagtctggatgactcctcacatctttcccagcactttgaatttttaaattcataaatcatttgagaaaattttgctcagttccatctgtacctgtatgatgatgctgctcacttaaactcttcctctgtctcatccaatatccaccaagtgccgtgtgactcagtttcctctttgtatcagtgctggcttgggtgattcctgcctcctctaagatggtgaaatatagaacaaatagttcctattttatttgtacatttcctttttgtgaagtcagttttgactgcaaaaccagcaaatcttctgtgaataactccttttgctttataataaaataggaagatttctgataacacaggtgattcaagattgctgaaaggtttaatgatatatgcacttgaagtgataaacgaattatgttgaaaaagaaaatacttagaagtgaatgatacagaattgtctgaaaaacattgtaatctcagccatcatgaataaattcaataattttactacttctaaaaaatgttctacaactgatgttatgtatttgattagagaaaatattccacaacatttcaaaaccttttaactcacataatatatcctactcataacaaattttagttttgaaaactgcttctaaacaagtcacttaacctccctgcaactacttttcctcatctgtaaactgcagagtttgaaatagctaatctctaaagtgccttccggtttgaaaatgttatgattcagttttgcttctcatttattgtatacagtgagaacaactattttagtggctaggcacaatcgaaaacctaatgataatgacttcagcaggggtctaattggagcttttagatataaattcaatttatgctaaggtctttctcatgggccttagttggatggcggctttacagaatattattggggttgggtgaattccaaagcatctttattttatagcagtatttttacttttcaatagagtcatactaatttataagttcatagtgtagaaagactttggcaatgggaattatttttaaatgaaaaatgatgaatatattttgcataggttacataatttcagagccagaagcgatcctggaaaatttatgcagtattaccaggataagaacaatgctaaaataaggaaatacatgtacctgattcattaatcagaagatttatatggataattttctaacagaaaggaatattttgggattaaataataaaagtgaatatgtttccaagataaaacagttgtccccattattcctaccagatgtcatgtggagaaataagcagcaaaacagaaaataattttgaaaattgtgtagataaatatttttcagattatattttgtgaccattatgtctgcaaaaacctattgctcaaaaatgggcactgtattcaaataaatttgggaaacactattttaaacaaagttaaatcatattttaattatagaacttttagaagccttaatattttagtgtgatatttactgttaatttccaagaggatacagtatacacagttttaaaaataaactcattaactagggaactttaaaaatttttgatacagattaaaatatatataataattataaagaaagagtactataaaattttaaattctgatctatgctatcttggaaaacattcagcttaaaatatttgtagttgcagttacttgtgcaactatatatgtgtctttgtatttacatatatgtgtttttttttttaactaaaagacaacttgggaacatattcagaaaaacttttatgttaatgttcgtttttatgctgctatttgtcttcatggtgttccagtctgggttccggggttatgtctttagtttttgccactcatttgggctctaggtgcacttttaacagtttacttttatctgtactttactatcttacttcactctcataacctcaaactgaatttggctcaacctaatttatttatccattgcccacctcgttttccctccactctgaaaaccacataaaggcgttctctgtgcagcatgccgtatttccattagtagtgctgcaacacaccctgccagaagcgtaggaccattctgaactcctttctttctccactgattactgccaaatagttaataagtcttgttgattttacctgctaatagatagctacctgaaaaagaatgaaactggagccttttctagtatcagatacaaaaatcttctttttttctatctctgctgcatgattgtaattgcctcctaattattcatcacatatacttttccaagctcttttttctttttgtcacaatgcatatttaaaacacaaatgtgatcataccttttcttcccttcatagcctctcatagcttcttcctttgtagaaaatgccaaagtccttactatggcctacaaggtcgtcagtgacatttgcactctaatgctttctgatgccatatcccctttctattttttaaaaattaactttatagaggtgtaattaatatgcaataaatgcaaccattttaagtgcacattttgcaattttgacaaatttataactttatatatttagggtataggacatttctatcacaccagaaatgtcccttgggctccttctcagtcaacttcaaactctaccccaggcctttctggtttctatgattcagtgtatttttttttccttcagtttaagtggaagagtccttgacatgttcatgcaatgcagggtcttccctagtgttgtttcctctgcctgggatcctcctctctgcctctaatgccaaacacatacccaattgcccaccaactcttatccatccattttcaatttaaacatcatttcctgagtcatttggaagagtgcctggccacatataaagcactcaagaaatgttagttattataatgaattataaattggtagcttgaaacctattgggttttcctgcaataaaattatagaaaaatggataacagtttaaaataaaaatactaatttgcatctattgagatgatcatatgatttacaaagtgagacagttttgatgagggtatattgttcattctgacatttgctttgaaaccagaagagctctctgtgtttttctttagtctgttattggtcaatacattttcttagatgccatcaaaggtagaatttagagaaaaaacccattagatcaccttacagataatatcttctgtagttgtagggtgccttaactctgtgttcttaatgcacaaaaaaaggtctatgtttacccagctactgaactgttatgtggaagagaaagagaaagaaaaggaagtaattactttgttggggcttatcccatccattatcctttgtctattattacatatctattgttttgatactttttgctatttttaagacaagatctctctctgtcacccaggctggggtgcactggtgccatcatagctcactgtagccttgaactcctgtgctcaaactcctgggctcctcccacctcaacctcccaagtagctgggactacaggtgtgtgtccctgcacctgaacatttttaatttttttaaatgatctattatgtcattgtgaaggctacattgaccaggccatagttctggattaattctcccaaagccacatagatgtgagcttgctctctaattaaatatcaagaattattttaggaaatcttcttggtgggatatcccttctggtgattaataaatcataaagctcaaagaagacagttgaaggagcagctattaaaccaatgtgatcctattaaagggaaactgagaaaaatcgttttagccagaatttgacattaaactttgtaaataaattaaaaattttaaaataatttttttctaaggaaattgaagaaagtctcatataataaagctggatactcttccacaattaaagataaaaaagagaagaagttggaagtgtgttatgttagtgactgatgtgatttgtatttatgtgctctccaaagaccttgtgtagcctggaaacattcatttgttaaaatgctaaaaagtaaaatatttattgtttcatataaaatcctctatgagatgaaaataaaggaagattatttgctttaatcataaattgtgctataatattttactctgaatatttgtgattgtactgtttgtaatagtatcatcagttatgttgattttagtcctctttatttaccttgaatcaaaatttttcacatctcaaatacatttctaaaccatttatttcagttgtttgaagaaagctagttaagctgctattttatcccttggtttatgattttacaatttcttgtgtttctactgacgttttgccatggtgtggccctggcaggatttgtttagggagtgtgctcaaatgagaataagagggaaagagaaaataatgcaaatgctgctgaaggctttcatacaaaccaaatcatactcaattactaaaaagaattagactggggcttgtgttgccaaaaggcatttaagaactcaaattatgtaattaaaatgtttatgttgatcaaattagccagagtacaaagcagtccataacaaaaatgaagttattcaagttaattcaaaagttattaacatgtacaagttagaaatttagcaaaaaaaagaaatatccacctgctacacatatatagacaaatacaaatcactttaaaactcaccacataaagataatttttcattctatttcttttgaaacccgtgtttttcaacatattgggctcctatattcatgcatttttataaccttctttttatactcaaaatgttaacacacccttacatctttttttaaacttttattttgaaataattttagactcatataaaatttgtaaaaatagtatgttttcagtgtacccagcttcttccaatgataacattttacataaccagaatacagtgatcagaaataggaaactgacattggtgaaacattattggtctacactatagcccttatttagatttcaccagtttttatgtatgccccttttgtgtgggtgcatatgtgtgtgtatttctttgaaattttatcttcaatgtagctttaatttgcatttcttttatggtgaatgagttaaatatcttttcataagtttaattacaatttttatatcttttatgtgaattatttgttcatgtatttgcccacttttgtatctggttttcatattctttttcttaaattttaacaattctttaagcattaggaatatcagctctttatttgtgatatatgttgcaaatattttagtttgtcagttttatttagattaaaaaatttttttgaaaagataacagttgtgttaaaatatagttcatataccatatatttcacacatctaaagcagacatttgaatgttttccagtatattcagagttgtgcaaccatcaccacaattagttttagaatattattgtcacttctttcctggaaacaaacaaaccttacagtcattagcagtcactatttccttcccaaattttccaactttaggtaaagaccaacctactttctattgctaaggatttgcctattcttgaaatttctccttatatcctaagacttaataggtctaacagacatgatattttgaagagctataatgtattctatggtaaaatgttgccatatttatttaagccatcatgattattaaatattttggttgtttccaaatttaaccttataaacgatgcatttgattaagttatgactacttttctgttcatttcctaaagataaattttgagaaatcaaattgtttggtcaaggactgggcacatttttaaagcttttgtcacgttttgacaaaaacaaacaaaaaaaaaattgaaagatgttttcaatttgaactccctttgagaatggataattcttgaacctttaccaaaaactataattagagattatttaaaaaattatcttatttgaaagatgcttctaactctctgattaacaggaattcaaattttttataatcacatttattagatattcttatgacagactgaccttgctctttgaccatttataattgaaatgatagtttcttactgattcctaagagcttatatatgaaatatattcacaagttttgtcaaatatattgccaatttgtctccatgttgccttttaaaattttgtttctgctctttttgttctatagatgtgaaaacatttttataaatatattaatcttttgtgttttaatcttgaaaattacacatattatgtatacacctgaaggaaagcctttttctaattcctttatttttattttatccattagtatatgtggaactttttgacttgtataaatattagggggagctctgtgtttccctaattaaacaattgtggcatatgcattctgtagaagccaatggtgatgcatttccacaggaactattcctgctcaaaaaaaaaaatcagtgaaatttgtctaacgtactcttatgccataaatacaaacaattatcataatcatttgcctgtgcttaaagttatttcagtcagcacattactaataatttgctaacttagaatatcaaacattaatcattatattttgtataccttaaaacacatactgaatgtttttaaagatgcagacaaccagcacaccttcccacccaagctaatttcagtgtaatttaaaattgatttgaatctgtatatggaagatgcgcatggcttgttcttaagttttgtggagaaatcagagaattttagacctgcacaacacagtctccttctgtacctgagataaaagcgggagctattttttgtttgtttgtttttcctttctgctctgggtttataattagaatacaaatagtcttggtcctgcaaaaaaaaaaatctagggaagaattattgatataaaatagatttgatttttttatggcatttcctgaatcagaatcaaattgtttggccgaagatgtgtttggttccatcttaactgttgctgacttcagtcattgctgtttgaaatttcccttaggccgaacctagcctatagctcactgcttgcactatcatcctgtggggaagcaaaacaaaacaatactggcacagaaatcaaccttctcccataataatgtccttaggaacaggcctgatagccacattgaaaaaagcatagttgcaccatatctgatgtagccatttcttgcactatgaactctgaggaatttaggctggaccatcgatttgaaaatacatcagtgtcagtgcagtgaggccagggcagtttgaatggtcgtcttcatgctaaaatctgattgtttttattgaatgcttttattttttaacctgttgtaaatttatatttgcataatataaatttgcaatttaatattttatatcctctttcaatatttcctttctgctttttttttttgctattctatcttccgcttaaaaaaaagtaagtattgttgacattaatcagtttcaaggatgataggaaaaagaggtttgtttttctaactagttatctcccctttctaacttcagaatatttgaggatgcaatctcacctctgttatttactgtgagaatttgaggaaattacttaacttttctgattctatttttctaatccgtaaaatgggatgaaaactgctgtcttgtaaggcagtagtgagggttaacaggttctttagctcttacaaaaaagtcaagtgattacatgtatctgacatgttgctagggagttacaatattaagatgaagaaggtagaaagtcagggacttggccctcaataaattttaggaccagtaaaagataggaaaatttagagtctgcgagtttgaaagagactggttctagaagagcaattcattatttctgctaataatataatgcaaaaaatcagttgccatcatatttgaatgtttgttttattattaacttaatggagagccttaagtctattgacctcatgtgagaaagccaagcttctcaaataatttgattgcatctctgtgaatttatttcactagggtgaggaaattgagaaccagagacttggggtgattttcttaaggctttagtgacaagatcaaggctaggtccaaatttccagtagatttatgtaacttagtgcatttttatacttatgccaaaattacttattttctttttatcagaaacactattcagaaaatgagatcagatgttttttcaggtagagtacaattaaaaaaagaaaaaacaattacagagaaagctcttatccagaaatggggctagttttcagcatctatttggaatttaaatgcattctagtgaactccaagcagattagcctgtatttgaaatataaggtcaagtgggaggttataatcagaaagaattagaactccagaaattaaagttaccttgagagtaaatggctgttctatatggaattattttttgttaaaacaattttacacaaaatgcctttataggtaactattattttaaccaaatgtaataatatacgaatgacatgaaggaatgtaggctatattgcgaattatttttgaattgtgactgttacagctattataaccaggagtgtagctaaaaacctagtattatgtattaagacaataagctgatcacacatattaattcgtgctttagaattccaatatagtctatacaagaaaaactagtcatctccagttgcttaaaagacaagtaattctaataatcttgtgaatgcagaattgaaaacgcacatgataatggataatggagttaaagtaatagaaagttcttgaagaaacttatgaaccccttctgagatttactttataatgatttatagattatcttgattggcgtgatggtattatgggtttttatatttgtcaaaatttattgaactatacgctcactttgtgtatatattttactatatatatatattatatcccaataaagtagtttgaacaaaacatcaccttaagttgaacgatgctatattgatgtcagatgctctgtttgccaaactatttttcgccattcaatctccttgttctttatactttgatactttggttgctagaaatgtagctcttgggaaaaaataaaaataatacattcttaataaaagtatgatgaaatactcacttgcaaaatgtccagaacaacatatgacagaattttgacatctatgaaaggcaccagccctctttggatttctgcagcattttcttttgtacaaggaaataatgctcatatagaaaagacactactgaactttcagaggtctcctacgaacggaactgtagtactcattgtattttaatcaattggagttttattctatttttatattactttaaaattggagtttacacattggtaatattaacattttttagtggtaataaaattacatgctgcaaggaaatcaggatacagtagcatactgctttaatttttagaagttagtgtgaacccaagatcatgaaatcacttttctatctctgttgctgaaagcttctgaagctggcaatagaagtagctacaccttcacatcaccagtactcctgattgcccccttgtgtcgatatattgaattttaatccccgtcaaaaaaggggaaccaggccttcttagagatctcattctgttgttggaggagagatcattcagaatgagcacagaattttctattattgcaaaaagcaaaaagtgtttttaaatatatcaaacctattcctgaatggacaaagaaccccactgaagaaggctatcactggccaatggataaaaatgtaagcttaaataagcttgaattcaaatgaaaataatttgaatctgtaaaaagccatgagttcaaaatataatttaaaggaaaagttacaataaaatttgcaatggtgtagttatgatgccaagaaagggtaacttcgatagtagatatttgctttttatttattttatcaactatgtagaatgtgtgtgtacaggtattctatatatgcatatacatatatcctttttcagtgtttaagattgtttcatgtatatatagttattaattataagcaaaatgaaagcaaatacctaaaagaaaaagaaaatataaatatttgagctcatataagctctgcatatgcagattgtgtgcatgtatatgtgtttgtgcatctttgtgtagctagtctatgggaaagagtaaagaggattaaatttgagtgagccaaacattctctgtaaaggtaaaaacaatttataaatgacaggatgttgtagcagatattttcttactaaacaatcctggtatatgataaccacttagaaagatactgtatcaaagggacagccaaggtatatacaagggatcaaggtgatcctttgatcacctctggcggtcatacacattaattagttaacaccacgttttgagataataggttagccaggttccaaaaagaagaattgttggggcagacttgaaccttcattttctagtagataaattgccttgattctcattctgttgaagttatagataaattccacagaagttttgaatcacaataagtgactaggtaacaacacaagaataatgaggtagcattgatcatttcaaaagtagagatcacatgttttctggaaaagatgtgaaaggcttggacttaaaagtcccatggggcagcaaatcaaatcactctggactacacaaagaatcacttggtagtcaagcaagaacaacaataacatttacattcagatagagttctatttttaaattaagtaaaattattatcattctaggaagttgctaaacgaagtatctacttcaaatacttaccctttagagggcataatactagaaataataaattataaatatataaaaatgtataaatgcacaaatgagtaaatgaatgttgatcaacattctactgaatacttgagggtctctatgcagatttccagagcatgctatctctctctctctctatgcaattcgctctttcccagtattctgtcctgcaaacacttgccacctggattccaagtctcctcacctttggaagtccatcagccttattcagaggagtgaacagggggccgatgtaggaatcacttcatttatttcctgtctgacaaggaactctgttctttgttggctgatgtccagtgttttgaaaaaccttgattaatagtttttggtttttcttttgtttgtttcagggagggcaaaactattttctgttagttcttctttgccacaagccagaaaggacatatatgtttactattattgtaacaaaataggaagtcctcataaagtttttctgctgcatatcaaaataagatggttgcccccaaaaaagcacttgtccaattgattgagttgagagctaaacaatcccctttcttcatggtacacaatatatttttttttgtaaagagtaactgacagacaaattatggttattcatgcttggctatatggcaaacatttactttaaaatgaaagaagtgatcctgtaacttcaagacaaaataagtgatcaatatttgttgccagtgataaaattgaagctgtcaaatgaaatcgaaattttggaaaacttgtgtgacatccactgtgagttgagagcttcccaatacttagatttttctgataaggatgtggtgatattaacaaataaattttttattgtttaataaaacatgttagtattggaagaactgcataactcagtgaaatcatatttttcagtgatcaatggtagaaaattatgcaaatgtgaaagaccatttaaagagtggaatatacaatttaatataacagtataatgtaacagggcataataatatttattaaatggatttcagattgcacattgtaatgaagctttaataagtcaccaattgtcaagttttagtgtagtatcaagggagaacgttcacagttatctggaaattatattaaaatattcctctttttccaactgcgtatctatgtgagactgaattttcttcaagtacttcaaaataacatattgcaacagattgtactcacaagtatatatgagaatttagctgactttcgatggccatctattaaagagatgtgcaaaaatgtaaaataccaccactaatctccccaagttttttaagaaaatatatttactttctactaaaatgtgttatttatttaaaaatataatacatgtattattgttttaaattaaattaataagtattttaatttttcaactttttcttttatgagaaatactgataaatataactgacttaaaaaaatctttgggattttcaattaatttcagggtattaagggattcacagacaaaaacattttaaaattgcttttttaatcactgtaatatcatatacagataaagccagtattattcaagtatgtatcacatgcctggtccaatcaaagctctgttaaaatacgctcaattcttttgtttgtaaggaaagtacaataagataaatactattatagcctccttatagataatggaaaaatgagacataattttcccaaatcataagctaatgtgaaaaaagtcaaaatttaaacacaggcagactgtctctcaagtttgtattcttaaacaccattttatattattctgctaagtgttttgttacatgttacagtggtttcaatattttagagtagaacacatgggatatccttgttgaagtgtttggaaaattatttgaagtatttatttggaaggggcttgaaagtatttttctataattaaaaagtgtttgcttatttttaaagctcaaaatagatttgttacctatactattaagtagattttaacatactaaatatcttttattacacattttttagtttctcctaatttacagagtacattatagtggtaagagcaggggctcagactttcttgatttgacattttagggccatggtcaaaccctgtaaactctttgtgcctttgtttcttaatcttgaaaactgagagaaatagaatctatcttgtaaagaacttttgtgagttccttgaactaataaatataaaagtctcagaaacctgcccttaacatagtaaggcttccaataaatactaactatacttgttataataactagatagtattaggtggtcacgaatgtaacctccataaataaagtcttttaagtagaatgataacttgcaccctttgatgtataatttcagttactaatacatgtaaccagacctcatacaattacggttaactgtattttccatcttcaatgcctgataactacatagttggcgtaatcacaactctcaatttgttagctttataaaaatagttgagccaaaatgttaacgtatgcttagcttatcctcactccttttccagtaggattgaggccagtttatttttacctgctatttagagttatagaaaaacctgggttcctagcatcttatctctgatcaattcttgtgatggagtcccttacatttggcaccttgagaagctgctaagttgtccacatcttaatattaggtaccaggctaagtgctttatatacctttttatatttagtcagatagcaaacccataaattcgttatgttatctgactaaatataacctaccttaggtataacataaggtatacctcctagtttccttaggaggaatactgctgtccagaaagtagagtaatatgctcaatgttgcacagctattaggtggcaaatctgagatttaaggccaggcgaatcatctcatcctttgaaagctaactactttgactttcttagcttcaagaaattgaaataattagattgaaattgaaataattagatccatctataagcttatttgcaatattagatcctgtgattctgcaacagttgagacaggagtatggagaataacacagtctttggaatcatataaagtgaagattgaatccttaaccagccatgttagcagtttaaccgagagcaggttcttcaccgagagcaggttcttcaactcttgtgcacatcatttcttcatctaaaaacaaaaataggcataataatttatacctcacaggatagtcaggaggactaaatcaaataatctatacatagcacgtggcatataataagcattcaacatataatatctcacctcctattaactgggactatttttagtttggctccttgggtgctagcccttttccattagaagagagtttgcaaagaagctgttctccaggtttctgaaagctctggttcttgtgttagccccttcatggaagatgtcaaagaattttagataatactatagaaaagtacaatacaaattgatatccattgagaaggcacattttaggagaaaaatgttcccactgaccagaacaaagttctggcacagaggcagagttctgcagccttccacagacacaggcatgtttctttgtccctgtccatggcaaagctatgctctgacctcatcatccttcaatcagttgttcatctaaagcatttcctttctaatgatcatcatcatgaaggtaatttgcttgattggcagcttattatttcctattaccgggtcctctgctaatgagtatttcccatctggataaatatgttttaaatggaacttcttttggaagagtaacaatatctagccttgtttatgcaacaattgtctgtaaaataagaatgccatgaattttatttacttcagaatagcaatagataatattaaaagtattattttgagtaatctccttaaaattggggatattagtagttgtgttgaaacctgtcaaactcagtaaacaagattctcaaaatacttaactcaacttcatttgtaggacattaaccattaaaccattttctatcagattaacttttccgggatagttttgaactgagatgagattgaattgaatacattaactaataagcactagattggacatacagaaaaccaataattagtattgtagtatttgtgttttgggaggtaggataaagtgttatgaggtgtgatgaacaagctttcttaatgagtgagaaaacagctcaaagtacacattgatctataaacaaaattgactgactataaaataaaatgacttgagattataatgctttcataagtcccaaatttggaagggttatacatccaaatacttaaaatatactcattgactgctagggaatataatatttaatagcagattattatactgtcctagttaaaataatcacatgggtaaaactagagatattctattacactcaactcttatctatcttctttaacttcacacttagataggaaatgattgttaacattccttgtatagcacataatttggcctgtccaaagaaagatatggcctttgccctaggcttttgggaggttatttacatcacacataataggaatgtcattgtttaggatgaatttggatctggatttacactggatcttagggtgatgccagccacaccccatagtcttagagtgggagctattcatgccagaaagaccaacaatgtgacttagggtgaggacttttggtcacattgtatcagttggtctggagactgagtccaaacaatgggcaatcaatctattaagtaagcccacataataaagccacaataaaaactatggacatagaaacttgggtgagctttcttagtggtaatctgtgcatattgttactcatcaatgctgggaaggtaatatgtcttgactccactgggagaagacaatggaaatttttatttggaaccttcctagactctttgtagctcttcctttggctgatttcagtttgtgtcctttctccgtaataaacagtaaccataagtacaaaagctttcagagagttgtgtaaatccttctagaaaattattcaacctgagggtgatttggggacccctccctcctgagcttttggttggtgtcagaagtaaggacagttgagggctgtgctctcaaacctcacagtttggttaactccagggattcataataaacattataagcgtcactaaaacctgtattgacttctgaattttctcagcctaaattatattcagtagaattttgctgttattttggacatactgtatttctcagaaagaggtaatcaaacactcgtgtaatacagaatttatcagttgcctactaggcatgtctagctaacatgtaagattattttattagtccagatatttcactgattgagatatgtcataatctcagctatgctctgctttctgattggactaaacaatatatactttttcattaaatgattcaatacaaatatttaagtaaaatattcatattctggtctaaatccatctcagtttttatatggggcaaatcaaataaaagtttgtatttttttctgtctgattttccctaaggttgtcttaatgacctgtgaatagcaagactaattattttgttatgtcctcatcaattgtacaaataaattgaaccagccaaataagctggttccatttgattagctcccactcactctgcttcagccattgtcatttgttgggaagtgagattacagaaaccagctctcccatgaagtggaacactgccaactctgttgggagaacataaatcatatcacagttatatctcaaatccattattaataaaactttgcactgtgggcttcagcctgcagcagacatttatgaacaggtcagaaaatgaagagtgtaaatggaaacactgtgcctttaattacagctgcacaaatggcagcactagagctacagaattgttaaaaatcagttaaggaaggttgccacctgatctgcctgcacataatctgtttaattaggtagtgtgtttctgaaatcaaatgtttctggaaactaagacttttcaacagcatgcaattttccttagaagaaatagttcagatatttactgggctctgctgcttcaaacgaactaagaatttaagaaataattgcactcctttgcacaaatggtataacctgacccaagcttgttaaagaaactcacctggtaccctcttaaaatgtaatataacttttttaagattcattctcaaatcatttgggcattttataatttttattttagttgttcactaatagaaataatattcatgattctgcaatacagaaaatacatctctaattgaaatatgttcataataatttctataatccttaaattataggaaaaaaattagaatttattttctgctttttaataaataatttgacacatgcaatgaagtttgctgtgattcttcagtagaaggactgttagaaacaaaagctgaggaatgctttgtagtagaaagtatcttttggaaaatactctagtaagggaacatttgaaattgtattattggtgtttgtggtacccctatttacaacagttccatcattcactcagttattgttgaattctagcactatttacttattagctcatttattcctcatgtaattatgaggaatttattaatattctcattttatacatgaagaaattgaaactcaaatgattgtggtaacttaagtaagtagatctatgggcatcaaaataaaacattcattaatttcctgagaattttttttatgatgtcactataaataattcttaaagagtagaataaataattaaattaataacaaaggctgggcgcggtagctcacgcctgtaatcccagcacttggggaggctgagatgggcagatcacaaggtcaggagatcgagcccatcctggctaacacggtcaaaccccgtctctactaaaaatacaaaaaattagctgggcatggtggcaggtgcctgtagtcccagctgttcgggaggctgaggcaggagaatcacttgaacctgggaggtggaggttgcagtgagccaagattgcactactgtactccagcctggctgacagagcgagactctgtctcaaaagaaaaaaaataataaataataaaataacaaatgaagacaatgtcaaacttattgtatcttacttctaaatcacaatggcaattgtaatattttaagctaatttaaaaacattttatgcaaaaagatccctattgatgccgttcatcgatctagaaaaaaataaactcttttaacaatacctggtaaacttctaattgtttataaagattaaaaaattgtttataaagattaaaaaatcttgttttttaatatgaaaatgttaaaacacatggaaaacatatagatcctaacatgactcccataaacccattatgtagagttaacaaatgttaatattttgcaaatttgtttctataacctttttgctaaattattttaacataaattacagatatgatacctcaaacttaaatactttttatcaacttaacatttctcccattataatgccaaagagtatcattactatacccaaaaatgttaactaaatttccttaatattgtctaatatcttttgcatttttcagtttcactaattaaccatgaatgtcttttaaagttaatttgtttaaaccaagatccaattaatgaggcattatttttagttggtatgtttctctggtctctttagcttctgcatcacccccaaccttcttttttgtgacattgactagttgaagagaaagttccacctatttgtctaattccttctttggcctcatagtatcatccaatctgtttctctactccctgtattattgataaacaagaagttagatttagcagcttggttaaattcatattatagtattttggaaatgattcttcataagtgattctgtaaacctactgcatttcatctgatggatacaatgtccaattgtcccattattacttttactaagagtgatctgggaattcaggtggctgcagcatgattccttcatggtagatttgtggttttcccttccccgtctgaatcttgctgtgaaaaatgcaattggaggctgtatatttttaattttctgtttcatgccaatctctgtaataccagtaccatattcttatatttcccctggtttaacacataattttgagatttataataggatatatggggagttaaataatccttaattgttgcagaccattttgtctcttgaataaacatctttaaaatgtgaaactgctcttaatatttgtggatctgcgagctggaagttctctcattaaagcaaaaccatcatagaaatccttttctgtaggtttatttttaaaagaacttagtttcctccttctttccaatcccatgaagatcaggatttgcttctggaaaacttacaaagggagacattgatgctttaataaggcaaggggtggttcaatggaaaagcatgtagcaatagctcttgccttagccagatcagttctgttttaatctattacgtgttgaacttctgattctgtgtaacatttggtttaaaaggtagaaaggtataaacagaataataaaagcacacacatatgcgcatgtgtgcgcacgcgcgcgcgcacgcgcgcgcacacacacacacacacacaataacaacacacagtatacaaaatatgccacctcttgtccacctggatcttagtacatggtgtaggagcctgagaatcacctagatggcattgccactggagaagaatctggaaatcctgaccctagctcctcttcagatgagggacaatgggtaaccatgtatgctttgctagtgtaacccacaggcatggtgcataaaatgtttctgttatttttcaaatggaactggctatttcaagctgctgacttttgctcagggtttttttttttctcttgctactgttcttccttgtttttctgccaagaaaaattttcttttttctttatgagacaggatctcacttcctttgagaaaatcttaattatccttcaaaagcagaatacaagtcacctcatctctaaaatcttccctgagcctctcttctgtcttatcacaagaactttccagtttgcaactgattgctggtataattgttttcctccctaaagtgagaggccctcaaagttgggtggcatgtccttttcatccctgttagtcagttcttaggttataataagcaataaatatttgtttaatggataaaaaatattgtaagccttctgtaaaactggaaaagaggaaaaaaaggaaagaaaaggggagaaagagagaaatcatcaacatagaagtctgagatcttatttaaatctctgactttggaatatcaccagctttcagtgcagaaaggcactggtggtcaaagatatgctgacactggcagaacattttgcattaagttgaaaatttaatttatttacttatgacattaacttaataatgccataactcttgatgtccaataaatctgttattgttttaaattttccaataagcattatttgcaatatgatttactggagcacagtcgaatacattttgcatctgtaaaaccacccgcagagtcactggtaggtactagatatgcttattgaactgagtagaaaaaaactatgtgccaaaaaagaatattcatgaaaaaacaattccagtgagaaaccagataatctgtagctttctggaagtttatagagccactacaaaaaggaggaatgaaaagtgggggataagaaacacctcaggacaaatgttatatgttatctcctcagtgccaccagggatgtgctagtcagagtgtgtaagtagacatttatccacacatcgactttagacgcctcaaggcctggcacagtcagatatgacctggagaaaaataacctgggattggagctcaactgctcacacacaatgcttatttcctaaggcccaggaaggaacaggaagaatggaggcccatttcctttttggtataacattcttttcagagggaagatgaaaaacaaaaaaagggtatatgtctatatgtgagactaccatatatatgtgtgtatatatatgtctatatgtgagactatcatatatatgtatatatgtgtgtatatatgtctacatgtgagactaccatatgtgtgtatatatatgttgttgtatatgtatatattagtgtatatatacacataaatatacacatattttatatgtaattatatacacatacatatatataaatgtgtatacacacacacacacacacacactaacaattacttaaggatatacagtaattattgttccagaaactaagaagaaaatagaaaatggcagcaaagaaatggaaaacaatcctttgatttttggcaaactatttttaatttgacatggtatctggaatacttgaagatactctcagtgtaaattagtttattaaatttagcagaattgactatcttttagaaaatataagaaaaatattaatatatatcaatgaagtgaaaaagcaaagcacagaaaactctttagcaaaattctcttcactctgatagtattcagtctcattctgtgagcataacatttttctcaactatgttaatattccatcaaaaaaaatttgttcaagaaaaactgggtttccaatgacttgttaagaaatcaaaatatttcttccttgaataagaggatccgttttttaaaaaatatatttagctttaggagcttaatttgtaaaccatttctttagctactaatttttaagcttaattttaaaactgaattattaaaatataaaataaaaggaaatttttaataaacttggaataatgtctacacaggtttgatcaggagaatcagtggaatagataatattaaatattttcttcaattaaagttatctaaatgtgggggtacagggatggttggggctcatattatcttcacaatgtttgcattccatgaggtgagatggattttaataaaataaattatgataaagtgtgatgagtgcagcagtggggaaatatgcaaaatctaaatgcacttagcatggagaagagaaaaagaaattctaaggacctggctatgcttccttaagtagtgacacctaaactattgcagttgttcttgttgtggttgtttttcagtagttgctttggttcttagttggtttgttttctaatatggatacaagttctttaagctttcatatataggaataatataaaagggaggaggaaccatgttgaaaaaccatgattcacagacatgaatcagcatatagcatttggggaattattactaatttggtatggctagagcaatggtttccaatcagaagtgattttgcccccacagggaaatttggcaatggctggaaacatttttggctttcacaaagggagtggggaacagtactacagcatccaatagggagagaacagggatgctgctataacatcctacggtacaaacaggacatcctccacagcaaataattacctaggccaaaatgtcaataacatcaaggttgagaaatgctgggttagagcatgaaagcttaggtgataaaaagagatgaagctcaacaggcagagtgtccacattatgggggcagaaggaggagctgggatggctttgaatacctgcttcaggaacaaatgagtagcatgagtattatcagtgatgaagaaattaaaggaaagatgcaggcccaaacacaactgcataggtgtgaatggcacagctaaggagtgcattcacagaggttacagtgcacttagtttttcctggagttgtgcagtgagcaaactgcaccatcagtctcagggaagaaacctttttgcagatgtaaaacctgaagaaactgtgaaatctgaaatgattgtaaagtatatttagattgagatgtttcatatgaaaatgcattttcttttttttttttttttttaaaaaacgtgtctagttttagaaattacggacttgattaggagaaaggattaagaagggcatatagattggtaaaaaaatgggaaaaagtttcggggacaagaaagatcaagaattatgtcataaaaatggtgacacaaatagaggaactagtatgggaggtgctgagccatgaggcaggaaagtttaacattgcttgacaaagagatttggatactagttgttggaagtttagatttcatgcagtaggttagaaaaagtccttgtaagttcctgaacaggagagagatggatgaaaatggcctttgagtaatattgtttttccagccgtgtgttagatagatcatagcatgaagaaaatgaggcatgacagggtgatcagctaggagactagtgaagttctgccctcaatttacaaacaaaatagctgctcactgctccccataaaatattcctttatatacatgaaacgtgctattacgtttcctttcaattttcttgggtatgtacacttagtcctttagccttttctcatcaggcacatttcccaacactgcagtgatttattttgctcttgcctttgtactctccaattttatttttccatatctcacttcatttaccatgattcaaattgaacagagtattctaataaagttcagatcaaaactgagtagaaggaaagggtcttatctatttaaaataaaatatttattttttattttttaaggaattgaagattaagaaaaatgaaaagagtgggcttaatccaacattttatatttttaattataaatattgagtaacaagatatgaataactgattagtaaatgtataagctactgtattaaaaggtatttttttatttttatttttttgagacagagtctcactctgttgcctagactggagtgcagtggcatgattttggctcactgcaacctccacctcctcagttcaagtaattcttctgcctcagactcccaagtaactgagatcacaggtgcccgccaccacacctagctaattaaaagttacttcttaaaatttaaatttaaattttattaatttattatttaaatttaaattttcttaaaatttaagcttgtctttagtgtttatagatggacatttccattcaagcctcatttaaatatatgaaaatttaaaaaaataattgcaaggttattttaaaaaaatatttgccttatttaaaaataaggcaaaattattttaaacttatggagttaagttctccctgtattcaggcctagagaaaaaaatttgacctccttctgcctttcattataaatataataaaaatgtaccagcaaaatacctgagtataaatacatgaaaagacttttttccacaagcccaggacggattaaatgattcaaataataggaagaaattctatatcagataatagactagatttatcttcctatttgaaataagtttttcaagttaaaatatgggaaacaataattctcaagacattttacgttaggcaaagagggcaaagatccctgtgaggtaaaaacaaataaggtgagccttctgccatgtgagtgcttcagtttacttcctggataaagtttccaggcacaacatggggagagggaacccaggtagagcctggctcttttttggagttaaggagataaaactggtcatccagggaatacaaggtggctaaagtttgcagaatagagtatcagaggtgagagacacacagacagaaacctgaaaatctgcatacagtctcccgtgattattcagtagagttctgatcagtgcgtgtatatgtgaaaatcatctgagactcgtggaaaaaacacccaaaaggattagcggaaacatctgggaatagtcctatttccatcaatcagagtgaaaaatcttgtaatttacaggggacagttctcagaaatctttgccccagtggggcaaaatttaccctagacaaaatgcctaagaaacttaatagcaagatccaaaaagaccaaactgtttctaagaaatttaaacatactatagagcaaagatcaataatatttatagaaaaaatatttattacccaataacttaaacatttacaatgaatggcattcaaacaagaagtaccaagcatacaaaaaagcaagacaaacaaacaaaaacaacaaaaatcattcaaaactaatccataaatgacacagattatagaattagtaaaactgtattaaaacatttattataactgtattccatatgtttagaaagccagaggaaaggttgaacatgctaaacaatcatgaaagattttttaaaagattcaaatcaggcttccaaagataaaaagtttcagtgtctgagatgaaaaatacactggttgagattaacagaagattaaacattgcagaagaaaatattagagaacttggaaacagcagtagaaaatatctaatgtgaaacataaagcaaaaagcctggaaaagaaaaatgagtagattgttggtgagttgtgaaacaacttcaggtagcctaatatatgtataaatgaagtgcctgaagaaggagtagggcataaaaatatctcaaggaataatagctgaatattttctcaattttataaaagctatacatctgcagatataataacctcaacaacaaacataagaaacataaaaaagcacaccaaagcacattaccatcaaattgcataaaagaagtgataaaatcttaaaagcagccaaaggaaaaaagacacattttgggagagaggaacaaagacaccactgacagcagatttctttggaaacaatgcaagctaaaagacagtggagcaacatctttaaaatatcgaaacaaagaaaccataatctagaattcttcacctaccaaaaataccatttaaaaacagagatgaaataaagatttttttttccagacaaagactaaatgagtgtaacactagcagacctacattataagaaatgttgaaggaattcttaagtagaaacaaaacattaccacatggaaatatggttctacaggaagaaatgaacagcatggatcagtaactatatgagtaaatataaagagttttttttcttattatttaataccctttatagtcaactgtttaaagcaacagcaataacaatgcatcatggaatttataacatatgcagaattgaaatgtgtgaaaacagtgatgcaaaatttggtaagggagaaatggatacatacttggttcttatatgtgaagtgttatagcattgagtaccatgtgatatgaaatacttcagagatgcaagtgtctgctctgaaaaaggaacatctcttgttttccattgatagtttcttcaagtctaattggcatatagtggtggtgaaaagagggcagggagttttgtcatggtagataccatggaagaaatgaagcccaagatgaaaagataagtttttaaaactttgcctcaaagagggaatgcaaaagttaaaaacacaattcagcatctggttgtacttgcagacagggcaaagttgaagcctgacaccccaagagcatccatcatgatgtattatcagaggaccagtctagtggtatttgatccctagcttccaactagtatgtatttcctagttgtaatgttagatatatttcttactatgagtcatggtcagaatagttggtattcgtttgaggatattttactgatgtgttttaagacagcttcagggattttttttacctagactgattaaggccctagaaggctaaatacctttgtgttgctcagatagcctgatttatgagtacccaacaatcacattgtagttctgctgcccaatccttgttacctggccactcccaataagactcagattaaaaatgactgaccccatgaggaaaaggacccattggctgactctccaagacacacagctgacttatgccctcttcatgatggaatccaagaaaacatctgataacaatggctaacatttaatgagtgtttactctgttccattatgatttaagcagtgtacaagacatcaatcttcatataaacatcaaataatcactttgaggacggtgttaacattttatttttgcaggtgagaaacctgaagcactgaagtaactgcaaattcacacatctagtaaatgatggagttttgattcaatgcaggcagcctgactccaaggttatgcactttatcccaataccaaactgcctcttctctaaactgataaaaactgctctcttttcttgctgaaatagaaaagatatagctttttgaggacccatggctaatcatcaaacaatggttttcctctcctccaacccatttctgtaccagaggagtgaccctaccctgcttggagtgaaaagaagctatacccctgcactcttctctagctcaaactaaggaggaatgaaaggcaacattagataggtatttgcacatgtgtgtttttatccatattctgtgaattggtgtctctgttaaaatatccaatcatctggagaaaagataacctgctttagcttcttctggcattaaaaagtcagtctttcatcagtcagacaaacgtattctgggacaagcttaagtagtggccctcacgcactgttagattttctaacagctgaagggtgaataaggaggaacacaattggaagcagagttaacagagttggcagaagaaatatgtaaaggatttatttagttttgtgttgagggttttgtgatgtcaaggctccataaaatcttaactaaaattggcactgctctcctagagttcttggtaaagttagaatgtattccgggaaatgtagagatgccagtttcaaagaagtggtcattgaaagatagctggattatgctaacattgatttttcacattctattccaagatttttttgtgctcagtagtcaatatctctctaaaatgcttaactttaaatatgtgacattatatcacattaaaatgctatatataactcaaatatagaaagttagtccccaaatattgtataaatgtgtatatatattttcactgaactatcaatgtaccaagtttctccaaattttaaatttaaattttggctaaaaatttcaccaatgtataataaccttcataaagctgagtatgcacagaaccatagatattaagatggtatgaccttcttgaaaatagattatgcttacttaattctaacattcagagctttaagcatgcataaggacttaataaatgtgtgtttattggtgctaatgataagattaaaacgtttcgagggctgttaaaattagatttagcacattgtttaaaaaccacaaattccataaagaaaatatttcaagtacatagttaataatatttttactgcgtttttcaactatttttaattctttaactaaatgtgaaaattaacattttaatatcttggtagtggtttccgtatttcttgggtctatcaacataataataatagctaacctttgtttatttttactataagccaggaaaatgtgttagacacttgaacaagttatcttattaaaaccttaaataactcgatgatgaattcaccattttaccttcattttatatgtacaaaacagaagcttaagtcatcgtttggctaatttcacacacacagaaaataagggggagcaaattcaaaccaccaagttttattccagaggctgtgctcttaagtactgcatttttctttctgtactgcatttctttctttctttctttctttcttcctttctttctttctttctttctttctttctttctttctttctttctttctttctttctttctctttcctttcctttcctttcctttcctttcctttcctttcctttccttcctttccttccttccttccttccttccttccttccttccttccttccttccttccttccttccctttattccttccctttcttcgctttttttttatgctttcagtttttgggtacatgtgcacaacgtgcaggttagttacatgtgtatacatgtgccatgttggtgtgctgcacccattaactcatcatttaacattaggtatatctcctaatactatccctcccccctcccccgaccccacaacaggccccagtgtgtgatgttccccttcctgtgtccatgtgttctcagtgttcaattcccacctatgagtgagaacacgtggtgtttggttttttgtccttgagatagtttgttgagaatgatggtttccagcttcatccatgtccctacaaaggacatgaactcatcattttttatggctgcatagtattccatggtgtatatgtgccacattttcttaatccagtctatcatggttggacatttgggttggttccaagtctttgctattgtgaatagtgccacaataaacatacctgtgcatgtgtcttatagcagcatgatttataatcctttgggtatatacccagtaatggcattgctgggtcaaatggtatttctagttctagatccctgagaaatcaccacactgacttccacaatggttgaactagtttacagtctcaccaacattgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatcctttgcccacttgttgatggggttgtttgtttttttcttgtaaatttgtttgagttcatcgtagattctggatattagccctttgtcagatgagtagattgcaaaaattttctcccattctgtaggttgcctgttcactctgatggtagtttcttttgctgtgcagaagttctttagtttaattagatcgcatttgtcaattttggcttttgttgccattgcttttggtgttttggacatgaagtccttgcccatgcctatgtcctgaatggtattgcctaggttttcttctagggtttgtatggttttaggtctaacatttaagtctttaatccatcttgaattaatttttgtataaggtgcaaggaagggatccagtttcagctttctgcatatggctagccagttttcccagcaccatttattaaatagggaatcctttccccattgcttgtttttgtcaggtttgtcaaagatcagatagttgtagatatgtggcattatttctgagggctctattctgttccattgatctatatctctgttttggtaccagtaccatgctgttttggttactgtagccttgtagtatagtttgaaatcaggtagcatgatgcctccagctttgttcttttggcttaggattgacttggcgatgcgggctcttttttcattccatatgaactttaaagtagttttttccaattctgtgaagaaagtcattggtagcttgatgggggatggcaatgaatctgtaaattaccttgggcagcatggccattttcacgatattgattcttcctacccacgagcatggaatgttcttccatttgtttgtatcctcttttatttccttgagcagtggtttgtagttctccttgaagaggtccttcacatcccttgtaagttgtattcataggtattttattctctttgaagcaactgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatacacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctagtttattgagagtttttagtatgaagggctgttgaattttgtcaaaggccttttctgcatctattgagataatcgtatgttttttgtcgttggttctgtttatatgctggattacgtttattgatttgtgtatgttgaaccagccttgcatcccagggatgaagcccacttgatcatggtggataagctttttgatgtgctgctggattcggttcgccagtattttattgaggatttttgcatccatgttcatcagggattttgaaaccaacgagaacaaagacacaacataccagaatctctgggacacattcaaagcagtgcgtggagggaaatttatggcactaaatgcccacaagagaaagcaggaaagatctaaaattgacaccctaacatcacaattaaaagaactagagaagcaagagcaaacacattcaaaagctagcagaaggcaagaaataactaagatcagagcagaactgacagaaatagagacacaaaaaaaccctccaaaaaatcaatgaatccaggagctggttttttgaaaagctcaacgaaattgatagaccactaggaagactaataaagaagaaaagagagaagaatcaaatagatgcaataaaaaatgataaaggggatatcaccaccgatcccacagaaatacaaactaccatcagagaatactatcaacaactctacacaaaaaaactagaaaatctagaagaaatggataaattcctggacacctacaccctcccaagagtaaaccaggaagacattgaatctgtgaatagaccaataacaggctctgaaattgaggcaataattaatagcttaccaaccaaaaaaagtccaggaccagatggattcacagcctcattctaccagaggtacaaggaggagctggtaccataactgctgaaagtattccaatcaatagaaaaagagggaatcctccttcattttatgaggccagcataatcctgataccaaattctttcttccctttctttctcctttcctttcttttctttttttttttttttttttttttttttttgtcactgctgcccagactggagggcagtggcacacaatctcggctcactgcaacctccacctcccaggatcaagcgatttcatgcgtcagcctcctgaatagttgggattacaggcttgtgccatcatgcccagctaatttttgtagttttagtagagacagggttttgccatgttggctatgctggtctccaactcctgacctcaggtgatctgcccacctcagcctcccaaagtgctgggattacaggtgagagccacggcacctggcctgcatttctttacctataattatctatctctcttgacctctaatgtcactaattcataaatagcaaaaaagtctaaatacttctcctcaaattaggctaacctctgagtttttcttgctgggtattactttcctagtttcctttcttcaaggtactttcaccaacataaagcctcttgtagcaattagttaaatttgataaattttatcacttattggaaggatagaaagtaactttagcaacaaaaatatgaaaataagcatgaatattacttgaagtcaaagggtagttagagatggggtgatgattctttgtttaaaattaaagccattactttttatacagttggtgattatcagagagggacagagagaatggggcatgcaatagaatttgatgaatattttatagttggtgaaaatagaaaagcagttactaaacactgccagatgatgtgctgctgtaggatccctgaagtggtagagcagaatgaacatactggggtactttgaggccaagtacagacatgattaaaaaatctcgttaacagaaaggccataatgaattatatttatagtaatattgagataataataatatcatttgaaagacttttggagacattttagcgtggataaacatagttattttccagaataatgattttgaaaataactgttagcattatgtatttgagaaaacacagcggcaacaactgtgaacttgatgccaatattttctgactttttgtttttctggttctatagctataaggtaggcatattttcaacagtaattttaggaaataaaacagcttgagatggaagattattaatgaggaggcttatgaacattccctgaatgtttaggaatggatatataaatgaacaccattatgaacgcattaaatattaatattgatatttaagtatatattttacttatcattggacctctgtctaatgagcatataggttttattgggtttattttcaggcaacgctcttcaccaatcaaatgaataagaatgaggaatttttgcttactttaggagctatgggtgtgcgtgcatgtgtgtgtttgtgtgtgtgtgctgtttctgtatgggtaatatttaggtgtagtgttttgtctatatttatctaaaaacttatgacttaatgacaactcatcagatacaactaatgagtttagcagaaaaattggattaggccattttttcatctgttttacaaaaactgatataagccagtttaataaaagggcacaagcttttctctaaatggtaattttataagacatttaaaaataataattcaatctacttttatgtgggtcatgatttatgtgagttatgtgaatcatgattcagcaaaattttatttggggaataagaatatactattctctttaattctctctttcattagtttgaataacaacttagcaccataatttacagacataatgttttctagttttgatctgacaacttaaatctaacaattaataagataatttataaataatcaggcccattaggacagaaatgctttccatagcaattatgtgcagctaaatgtttcctcaaggaaacatttgactctatgtccatgtgcatgcatatggaaatatagtgttatttagatataaactaatatctattgtttaagctaatattatataatagatatctgagtattcagaaacaacttaaaaatgtgcttttagtcaaaaggataattcctgaaatttattaccttcatttaaaaaatataaatttccttatgtacttcaaaaagaataaagttatggagctgtgtaaatttctctattgagaaaaatcaatattttataaatatttttaaattatagaaaaagtaaggttaatatttgatgttttatacctaaactttcaaaaatataatgttctcttgcgtctgttttcttttaaaatctggttacactgacttcagatataattaagaactctgctttgttatatttggaaaatcaaaacataccagatttgagctgatagaaaaagaaaatgctcttgctcagagtattacaatataaaatattgtagagggcaatagtatattcaaaacctttttctttgaagaaataaaaaatgggtaaagacttgtgtttgcagtttgtatgtgtatcatttagcagatttaatattttaatttttcagttgtttgcttgacattggagtatattttatccttcctttaaattgttacaggtgacatatttatttttgatacaataagtgaattaaaatgggatttatttgcatatttttatgtatgccctggtgggtagcaaaattatgcttggaaatttctggcttcagtaagttttttagtcttcatattcacaaataaataatctctttaattggatcaaagcaacttacccaaggttcatgtgaattctttatcagcaggattattgtattatgagaatctgagtttcatatttacagtcctgtgtctgagataattggattgttttggtaaagaattgtgctaacaaaaggaaaatgaggcagaggaagaaaagaaggaacttgatacatacaaatagacacgaatacaagaaaaaagttaggcactacattaaccaatgtgagatataaaggaatatgaataattaatttgtttaaagcagtgtacctccagaaaaaattttggtctgtatttggcatcgtcaaatgccatttaataaaatagcaccagaatattgattaagtagtgttgctttgaatggtacagttttatgctttttattccctgggcaaagtaagttattattcctggaagaaataaagttgggcaaagtctattacagaatcacactagtcaattatgctaaatttctgcccaggatgctgactgccttggtttaaactgttagtctttacctcatctacagtttcttttccttcaatagatatatattaatctactagagtgttccagatatatttttaagtgctagagaacataaagatgaatgagacacggtccttgtcgttatgaggatcccagtctactaaatgagaagtattgtaattttttaaatgggcttataacattaatggctaccattttaagcactagtcatgtattaggcattattaaatgttttcaccaactcccttaacatttccatggaattaaagaaaaagatgaagccaggaggcttctgaaactagccagcaacacacaggaaggaaacaaccttgccagcagagctgctgaggaaagaccttaagacatgttctggaaggatccagtggctggaactggaatagtacaaataccagttaatatctaactgataaaataaggcatttaatatagggtgcttaagatttcatactttatcctcagcagaaatgggaaactactacatatttttgtatggattttattgatctctcagcgatatctgtcacattttctactgtggttcctaaaacctttgatacccagtgtctccagtacagtgtcactgtaataacatatcttctatcgtaggtctgcacttactctttacagtttcagtgtacaatttacagtttcagtgtactttcaaaataagtatcttaaagaataagatatcttattcttacaggaatctgagatatgtagcacatactttaactattttggagaagggagaaatgctgagtgttccagcagctatcataataacccttgcatatttttcagtagcataagattagaattatgggaacaagaaggagatgcagccatgtgggatggaggagaagcaagagaagtgaatgctgtgttggggctggggggacccaatgctaaggacaactgacaatcacttcaacatctcccatctgccaacctcactagcaacatcacttctatagtaaactaccatctggcatggctaagaaatgagatgttttactaaataacgtactcagtttaatagaacttttgggttgaattatgtgctttcaaataagtagactaaaggacatgtagtataaaattatgcagcccatattttaaactttctttgaacatctaaaactacttcaggcctactcagtcccttggatcttcataaatttgggggaaaaaaccctcatactttcaaggcaccatgtctgacactgggaatgcaaagatgaaatcctatagcccctacccttaaggagctcgccatttagccaatcgtgcaataattacattgattatagagcatctgagtatttatgtcaaggtacatgaccagcctaggaataatgatggaggtatacaggaagacagaatggaaaattaaacccaagcaacatggaaaacaatgttatgagctgtagctaatactatagatacaacaaaattgaaagtaatagaatgttctagttgaaaatttattccacgggtcctaaagtcacccctttgtagattacttgtaacattacttgtatttttatgaaatacgtgatcactatgtaatttttgcatggtattgactaagacaagagagtaatttcccagtcagaaaatgttattgttgcatactgggctaacccaccctcttgtagtttgtaggtgccaactatgaacccaggttttgttgttttgattcatcgatgtttacgctgtcatttttttttagcttttcctgcttcacactaattatactattcactatcctgcactctgcttttcactttgcttccactcctgtctcacgctgagaaaccatttcacacctgtatcaatgcagtgctctctattcgtcatcccacatctcactgcagttaaagtaaaatttttgaatgataagcctaatcatgtcacttcccctcataatatctattagtggccatgatgataaaagcctataacatgtctacaaggccctgcagtggtctaatccacgcctctccttctagcttcatcttgtactactgtctccgtgctcactatgctacagcaacacttgcctgttttcaaatcctggaatacatcctatggcatcttgtctcatagcttttcacatgctgttctctctccctacaatgctctgatacccctgcccccgaaccctacctcggcttccttaatacttatttatcctgatgtcagtccaaatgacccttcctctacaaacatttttcttgtcctccagaaaaagctggttgtctttgttggtgtgccatgcccattcatagcttgaatatcaatctgtttttgccattttaatataattatattcactcattgaacaggtatttattgaacatttactatgttccagacactggagttacatggtcttatgtccatgtccatgttacatgtaactggagttacaaaagacaaagaagccctattttttttaacgaagtttatagtttaatggttgaaaaaaatgaaatgaataatactttaaaaactgaatttcacacatagtttctgtagatgaaataaaacaaggtgatttggtaaaaagcacaaagcagagagggacaagtgggttatttagagtggatatcaagtaaggctttctaaggaagtgacatttggactgtgattttattgctaagagaatgccaatcacaggagggccaggtggcagaactttcaaggaaagggaaaggccagtgaaaatgtctgtctggaggcagaaacaagcatggcagttggaagaagaagaccagtgtggcagatttaattaaaattggccgtcacgtgcctgtctcctccactagactgcaagtgtctgtagggtggggctctgtctcctttatgtctgaagtttattgtacaaaatcacactttaaaactctgctcagcagttaattcttttgggaagaatttgatgtcttctctcctgctctctgcccatccccaccacagaaacacacacctgcattcatcctgggtagaaatgactgctttctttttgtaattcaatgctactgccttcatatattttttcttaacatgtggaacattttctcgtatttgtttgtttttatacctctcacttctaacaatgtcttgagagtagggactatttctgattcagttacatgtttcaaatgcctagtgtaataagctcttaagcatgcaatcaaattttgttgcaatgaatgagacaacgaatatatactgccttatctctgctatggcttctatttttgtcttggtcaaggtttcttggaaaacagaacctgaggttaggtaccttaaatggtaatgtggttattgagatgtacaatctcagggccaggcaaatggaagtgatgccaggcaggatgagaatgagatgatgttacacaactggctctcaactagttgcttggccatatgagatgtctccagataggctgtttggaaaatccacccctagaggagtattcaccagaggcatgatagagagggaatttatctgctgacttcctcttgcctctagttttctattatttatcaatgtattgatgttaactcccctgggtcaactggccccacgggtaccctatggagaagtaagatctcttgcctgtacttcatctgggaccgaaagcaatgggaagaactggagattcagtgttggtctcaggcagttggtcaacaggggcccacagggtcagttgtggcagtggcagctatggtggaacaaatggccaaggacatgagattgcaggcaaatttgagctgctctgagaaagtgcataagaagtgactaataaaatctgcaaacttgattttcttctaagctctttcttctccacccataaaaatatttaacttggccggacacagtggctcatgcctgtaatcccagcactttgggaggccaaggcaggtggatcacctgaggtcaggagttcaaggccacccagactaacatagagaaaccccgtctctactaaaaatacaaaattagacaggcgtggtgacccatgcctgtaatcccagctacttgggaggctgaggcagaagaatcacttgaacccaggaggcgaaggttgtggtgagtcgagatggcaccattgcactccagcctgagcaacaagagcaagacttcgtatcaaaaaaaaaaaaaaaaaaatagaccagttacggtggcttacacccattatctcagcactttgggaggctgaggcaggaggatcacttgggcctaggagttctagatcagcctgggcaacatagggaaaccttgtctctacagaaagtaaaaaaattagctgggcatggtggtatgcacctgtggtcccagctactcctgaggctgaggtgggagaaatgcttgagcccaagaggtcaaagctgtagtgagctatgattgcaccactgtactccatcctgggtgacagagcaagaccctgtttcttcaaaatattaaataaatacatacataaatgcatatataaaatgaaaacaagaaacaaacttctgtgaccccaaattcccttttaatttcctcttagttccctctctcctttctaccaaaacttttgttccatgtgtctatgcctcacccttgacacaccatggagggccagccccctttagggttttacatctgctgtgctcttatatggctcccatctctttggtcttgctgtcatctgcgcctagagtgatcttttctacttttttatgtctttgtaactcggaccaaatgtcatctatgccacttgctgacccttttcccagcttagtctgaatgtcacgcccctccttacttaaaatggcatcctgcccttccctgaatcataatacttatcacattggtttaatatggtatgttttatacatccttccaaaaatattgtgagaccgaattctctcacttttagattcatctttgtgtattgatttttggttcaatgtcttgtccacagtaagtagtaaatacatgttagctaagcaaaactatactagttaagactaatagaataggcgactgaccagaagatcttatttaattttaacctggaaaaaaaggccagaaaataatacataaaatttcaccttataattaataaactcttgatttaattgtgatttaaaattatattatgaaaatatgttaaagtgatgattatctgtgatagagtcttcaagatggccatgatcaattatttcctttcctttgtgactttgtttcttttccatcaagaggttgtgtttattcccttccccttaatttcagaattcaggctgggtttataacttgtcttggttaacagaatgtgaaagaaatacctgaaaggaggtgaaaagcttccactttctcttttgaggcattcagctgcaatatgagtagtgtatcttcccaatatcaccatgtggtattgtgagaatgactaatctagtcgtgtgaagagaaagaggtcacattaaaaaacaaacaaaacaaaacaaaacaaacaaacaaaaaccctgacttgtgacctgacatgaagctttttgaacttttccgcccaggtctgcagccaagtaaaatgcacccaaatgagtaatcccagccagtgccacctggaacagaacaacctctcagctcagctcatctaacctacagaaccatgaaaaaataatagatcattgttctaatctacaaggtttagggtgatttgttgaatattgatagataatggaaatacccatatttagcttggcatttcctttaaaaatgagtcttaactttatgacttagtaccaaaatggttggcttctgataatgaccctagaattgattacagtcaagcctgatcattcagtttacaagagtccaccaagtgtttctgtgaaagtagaacattatagaatgcattataagatgggcacaacagaattgtgtgcattgctttgtggccatatgcacacagtagactcttattagtggaatgatgagtacataagaaacatgagaaaaataatagctggtggggaagactctaagtaaaggaaaacccttgacatcattaggagtaaacttgctgtattagggttctccagagagacagaccaataggagatatatatatatgagagaggcgatttttttagggaaattggcttacagtattatggagactgagaagtctcatgatagacaataggctgtctgcaagctggagaaccagggaagccagttgccttactgtccaaggctgaaagccttagaaacagggaagcctgtggtgtaactccatttgtggatgaaagccacagagtccaaagaccagagaacctggagttttaatatccaggggcaggagaaaaagggtgtcccagatccaagaaagagtaaacaaatttgccttttctctgcgtctttgttcatctgcatgcttcactaattgaatggtgcacacccacattaaggggggattttcctcactaagtgtacagactcacatgccaatctcctagggaaatactctcaaagacacatctagaaatcatgttgtaccagttttcttggtatcccctaatccagtcaagttgacaccttgcttacttgcaatcatgcaactttctaacaatatgttgaaaataatgttagtaataacaataacaataaaaaagcacattttattgagttcttatatatgtctagaaaatagtatctcatttaatactcagaataaccatatgagacagttgctataattatagctacttcacagttaattaaactgaaatatagagaaattgagtaacttgtaccaagccacatgacaagtggtagagtctggctgaaagcagattgtctgatactagacccctcaattgttaactgctggttatactaatatataatgtctgttagcataatcacctattatatatatgtatataaatgtgcaatattcataattctactgtgtgtgtgtgtgagtgtgtgtgtgtgtgtgtgtgtgtgtgtgtgtgtgtgtattatgcttttctttaagcaacaaatgctgccatgacaagatgttttggaataccaaggtcctctatatttcaatgtcgaaggtagtacatagctttggtaaatgacttccctttactgatagcctgactgtacctactttccccttccttctatcccttatttggatgttgtaactggaattaccttctccagtcctccttgctgctcattgaacagctcatgaaccaactgggctatgtatatccattattaaagaacaagaacctgatgttaggacagaataaaggtatttgagtataatatgtaatctattattttctcattacttctacctcaactgttattccttagttctccaaataggagaaaataatttttacctcttttgaaatcacaagcggggttgtagaagtgattttaaacattcaggcacatactcccatacacacataacaaaccctattccacccatcagcttaatgttcttggcaatttatttaactcacactgtgggcaaccactgccagcttcaattggcttgctgcctttattgatgttttcaggacccaagacctttttattcatgtttcccattaatctcagatgctttacaacatttctaaagacaggaaaacatattgggtcaaatttacagctatctttgaactcagtagttgaatctgctaagtcaaacccaggtttcagccagcaaagtagctttgaaatgctagtttgaaaaagactcaaaaagctttcttaggtgtcagttcctcctgggagaaaagagacaggaatcgcattttaatgattcaagtctaggtatatcacaagtgcagcctgtttattttatttttagtggagtgagaagaatcacctattgaagatgctttcttatatccacatatttattttatttttagtggagtgagaagaatcacctattgaagaatctttcttaaattcacatatttagtctgtttttttaaaaagtttaaacccatcacacactacagaggcaagatatttttataaatcacatgctttcatcttacatgatatcttagtaatacagtaattctttaatataaggcttacaaatattttaaaaaacttttcagcataattcttttgagaatagggctagtattggtcacaactataaaacatggcatttatttttggttccctgtcatctttcttccagtcctttgtattacccaccaggtatacctaccttggggcccatctatcagtgcttcagctctcagcaataacctattacttttaaaataaagggtgttttctctgggcaaaattaagaagttagtcagccctcctttgatctttatgacacttttcaacatttcccacccctgcttactttctcttccttcaggtgttagaaaatctttttaaaatatcccctctcactccatcagataggggaattaacagcaatatttattattttattacctaatcataagctaaaacaaatatcttttaaccaaatatatatcaaaatttgtactttaagttcaatttctgagttttaatggtggcaatgttaggtttcagcctcctttaaatatacttttgagtatgagaatatgtgtgggggtatgtctcaaagataaggaacccctggagttgcatgtttaatccaaaggtagacttgcaagtattactgacttcagaatgaagcagtgtagtggggaagggaaaatctcctaatgccttcccaaggaggacaagcaagtgcaggtccagccaaggcttcttacctaggtttcccttgcatttggaagatgtatcagccagaggtcagctgcagataaattagtaaaaccagcctagcaattttaagaagaaatggcttaaatatagggaaatatacaattataaaatagttggaagtactgaaggacaggctctgggatggcctctgtaattctaccacagaccaggccctccagggatgctgccaactgtcaccattagaaaggtgggtgattgggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaggtgggtgattggaaaacagccacttcccggttgtcttagatgaaattccaagatcaggaaactgctgcactatttcattagaactgcatcagctgacattgaattcctagaagccatggcttccctctcaatctcaattcacattcaaataaatgatttttctttaatgacaaatgactgtcagaacctaagtcactttcagaggtgtagctgcaagggagtcttgaaaatgcagatttttagctgtctgggccttatagtacagaaaaaggtgagaaaagatgccaaaaggagtcaatcctgacatattttttaaaaatgcaagtgcttgagtcatttttatgacccctgatcaaaacagttacacattgcaaaaaaaggcattgcctagataaacaaaatattcttgaatcatttgctctaaactaggatattatttctaggcctttactctatttacttggaacactttttctgtctgtattattgatgatggcaattagatatgaatatctaatatgtttgtcataaggaaagatattaattgtgttaataagattcagtaatgatataatttaatgccatttgtttctcatagttaagttctagatttcaaaaaatttttctattaaaagattgataattctcaattctgcaaggaagggagaacaacataaactgattttttattaaacccgagaaccatttaggaataaatgattgatatgttgaattgtctcctgcaaataggtgaagatacctgaaaaataaaacatggtatctttcattcttactgaggtgattaaatgagaacaagtatggctatctgaattatccctgtgaactttaataagctactctatctattagggaatctgaactgaagactatgcaggcatacaaaggctcctaagttcagtacaattaagggggaagaagagggaacacattattattataataaaaaagtaaaagtgcaatttaccccagtaaaaaaaaaggcactacaaaaacctgaaaatagtagaggaaaagtgcttttaaaatttttcaattatcaataacaattgaaagataatataaaattcattaattatatagctgaaaatatatactaataagagaataattacactatactttagtggaactgagcaaaatgtaaatattataaagaaacaaacataaaatatatatttaaacttcagtacacaatatgatgctattgtagcatttttccatttgtcgaaggcaatgataaaagtgaaaactgggctgggtgctgtggctcacacctgtaatcccagcactttggaaggccaaggctggcagatcacctgaggtcaggagttcgagaccagcctgaccaacatggagaaactccatctcaactataaaaaaatacaaaagttagccgggcgtggtggtgcatgcctgtaatcccagctactacggaggctgaggcaggagaattgcttcaacccgggaagtggaggttgtggtaagccaagattgcgccattacactccagcctgggcaacaagggtgaaactctgtctcaaaaaaaaagtgaaaactgaagtgaaagtagtaatatgtaggaaattttatgattttccaaatgtgtataatggattttcatggtgaactgtgttttgtattcaaacacaagaatttttaaaactcagacaaaaatggattaattcttaagtgtctcaggggaacttaactggaaattttgtgtatcttatttattgaaatgctataaaataggcaaacacatttaattgggattcaggcggtttaagcacagttcagtattacacagataaataatggacctgtacaaaattgaactggtgctttaaaatccacgatcatgcctgtaatctgaacaccttgggaggccaaggcaggaaaatggctttaacctagcagtttgaggctgcagtgagctatgattgcgccacttcactccagcctgagtgacagagcaagaacctctccctaaaagaaaaaaataaaatccatgatatttcttttttttctttatgttttattttatttattattattatactttaagttttagggtacgtgtgcacaatgtgcaggttagttacatatgtatacatgtgccatgctggtgcactgcacccattaactcgtcatctagcattaggtatatctcccaatgccatccctcccccctgcccccaccccacaacagtacccagagtgtgatgttccccttcctgtgtccatgtgttctcattgttcaattcccacctatgagtgagaatatgtggcgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaatatacgtgtgcatgtgtctttatagcagcatgatttatagtcctttgggtatatacccagtaatgggatggctgggtcaaatggcatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtatctcattgtggttttgatttgcatttctctgatggccattgatggtgagcattttttcatgtgttttttggctggataaatgtcttattttgagaagtgtctgttcatgtcctttgcacactttttgatggggttgtttgatttttcttgtaaatttgtttgagttcattgtagattcttgatattagccctttgtcagatgagtaggttgtgaaaatgttctcccattctgtaggttgcctgttcactctgatggtagtttcttttgctgtgcagaagctctttagtttaattagatcccatttgtcaattttggcttttgttgccattccttttggtgttttagacatgaagtccttgcccatgcctatgtcctgaatggtaatgcctaggttttcttctagggtttttatggttttaggttgaatgtttaagtctttaatccatcttgaattgatttttatacaaggtgtaaggaagggatccagtttcagctttctacatatggcgagccagttctcccagcaccatttattaaatatggaatcccttttgcattgcttgtttttctcaggtttgtcaaagatcagatagtcatagatatgcggcattatttctgagggctctgttctgttccattgatctatatctttgttttggtaccagtaccacactgttttggttactgtagccttgtagtatagtttgaagtcaggtagcatgatgcctccagctttgtccttttggcttaggattgacttggcaatgcgggctcttttttggttccatatgaactttaaagtagttttttccagttctgggaagaaagtctttggtagtttgatggggatggcattgaatctgtaaattaccttgggcagtatggccattttcatgatgttgattcttcctacccatgagcatggaatgttcttccatttgtttgtatcctcttttatttccttgagcagtggtttgtagttctccttaaagaggtccttcacatcccttgtaagttggattcctaggtattttattctctttgaagcaattgtgaatgggagttcactcatgatttggctttctgtttgtctgttgttggtgtataagaatgcttttgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttgttttcttctcctgcctaattgccctggctagaacttccaacactatgttgaataggagtggtgagagagagcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagggctgttgaattttgtcaaaggccttttctgcatctattgagataatcatgaatattagacacatcaacgagacagaaagtcaacaaggatacccaggaattgaactcagctctgcaccaagcggacctaatagacatctacagaactccccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactgaggattaagaatctcactcaaaaccgctcaactacatggaaactgaacaacctgctcctgaatgactactgggtacataacgaaatgaaggcagaaataaagatgttctttgaaaccaatgagaacaaagacaccacataccagaatctctgggacacattcaaagcagtgtgtagagggaaatttatagcactaaatgcccacaagagaaagcaggaaacatccaaaattgacaccctaatatcacaattaaaagaactagaaaagcaagagcaaacacattcaaaagctagctgaaggcaagaaataactaaaatcagagcagaactgaaggaaatagagacacaaaaaacccttcaaaaaattcatgaatccaggagctggttttttgaaaggatcaacaaaattgataaactgctagcaagactaataaagaaaaaaagagagaagaatcaaatagacgcaataaaaaatcataaaggagatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtaccattccatctgaaactattccaatcaatagaaaaagagggaatcctcgctaactcattttatgaggccagcatcgtcctgatactaaagctgggcagagacacaaccaaaaaagagaattttagaccaatatccttgatgaacattgatgcaaaaatcctaaataaaatactggcaaaccaaatccagcagcacatcaaaaagcttatccactgtgagcaagtgggcttcatccctgggatgcaaggctggttcaatatatgcaaatcaataaatgtaatccagcatataaacagaaccaaagacaaatccatgatatttctatcatgcttcttgtactctcttctcggaggaattgctttgcattttggctaatgaaatcatgtcccctctttactttctctcaagtctatctcttttactgctttcccagacagatcagttttagcttaccatagcaacctctgggacttgacccagtctttgcagacctgtcagatcagtgttctctcttgagcaaattccttaagtgactctttcctatcacattagatctaacttgctctttttgaattctctaatagggatatgtttaaattagttgaattaatttttgctgctctttctgaatgcacttctgtgagtctaatgagtctaggcttctttaatttaaataaaactataatgcttattccagcatctatacctttatttacaattatccctttgatcaaaatatctgtctgtcatttattcagttaccaaatcctcaacacttctggagatcctaggccaaacttttcttatctatcaatgagttctctgaccactaggtctattttaatccacccgctccctcacttctttactctcttgttgcatttagaataattctgtcttatattgtttgctgttaagttcatgtgttttaatcaattgtcctgcaaaaagctgtaaactccttgaaaacatgggctgtgctttcatcttcttaattaaaagcaataactagctcataggtcactttccaggagttttcaatattatgctttagctctaataaaatctttataagagaatataaatgacctagaaatgttaataaaatatacaccacttaaaaagtatgttgattaaagtgaaattttagaaatatgaattaaaaataagtaataaagacaaacatcacaatgagctttaccttaaaaacatcatctgaggtagtacaggaaattatacagagaatatttgaaaaaaaaaatatatatatatatatataatatatatatatatatatatatattttttttttttttttttttttttttttgaggcagagtctccctctgtcacccaggctggagtgcagtggcacgatctcagctcactgaaacctccacctcccaggttcaagtgattctcatgcctcagcctcctgagtagctgggattacaggtgtgtgccactagggaaaatagaattttaaaaagcaaaatgactaatcaagtctgtgtagatactgactgataagtagaaagtagaacatttctcactctctctcagcattagaaccctgagatcaacattagccaagtcatgaatttgtaggtatatgtagaattagaaagaagcaatttggaaacaactgttaaataattgattgatttatattaaaagagatgaaatctgtaatacatatctatctgaaggtattataatttgaattccagtccctcttattttaggggttaaatggatattaagggagtgtgaaccagtggttaaaatctctttgggacttagaagtatctgagataaaatcctgtctcttctattaattaaggtgtgattgtggcctagttacttagcttccccacccagtttcagtctttataaaataagcataataatagtgtctacctcatagagtgagtagaagattaaatgtgatacagaatttatagcggggaaaaattcttggcatatgaaagtattaaatacatgtttgctgttattgctattattattttcataaaatatattatcttttacattcactcagaaccagagccaatatttctataaactgtattgttttggaattaaatgaaaagttgtgtgataatatgttactcgtttcaatacataaggaatttatacttcttccttacaaaaatagaggttttgagaatattcctcattatttcagaggtgaaacaacagaatatgacagaaaatactgaaaaatactattgtaaaaaagatgcggttaaatcatcattggccattgcaagtaaaattttgggattaagtatactgttaaattagtcaatatgtacattttaactgaaataaataattagcttagataatacttctaacttaagataactcattattctcatttgaacttaaaattcttccactggtggtaatttgaaatgggctataatcccattggtaccttttttatgacaagggttttggatcctcctgtcagaattcaactcagatttaaaaccagactctggtctcactttctccattagataacaccaaagattgccctatttccctttagaatttattatttatatcacattttaaaaaatttggtaatttgaggccttgtcttgcaacttactacctcatggatatatgtcttaacaactcaattttaattttatagaggatagattactcagtattctcatctgtaaaacagatataataagggtgtctgcctgatgagaatggtataggaatcaagagtaaacataagtaaaatgcttagaagagtgtctggcatatattcaaacctatttgttaaataaaaactagatttcttttgcatttttttaatcacctatactatgctatttttgacaatgaaaacaaaattgtacttgaaataatcatgaagaaattggccatttgggataataatgtacttttatgctgaaggctgcttttaactaatacaaatgcatccaatatagataaattagtaaaatcttaatgagataaataaatcagtttgcctttgtaaaactttaaatgtatctaaatttagtgacttaatttagtgacttttccaattaatttgttgtctacaccatcttctaaatatactacttaaattcctgttcccatgtcttaacttttgcagttatgcccaaataccttatgcttccgctcctctagtcctcattctactcatgcttcagtacatcagcgtcacagaccactctgccaggcaatattaggttcacgatgaaaagggagaagaagaaatgttggcagattcccgcgatactcagaaaacagtataaaaaggaccaagtggtttgaaacaggatttaagatgcaagagattacaaagaagccttccttgtagattgaatgttagcgtcaattactgatataaacatctttggaggagacctcgtttgagcaaagttaatgacttctgttctggatgtgtacaatttaaagggcctataatatgttttacccatgcatcctcaacaaggatgatattgccaccaaagggggtaaaaattggttgctggggagtaaaaaaaatcttactttttatgcacaaagtatagaaaggcatatagtacataaacatttatgctactgcatatttatcaaaatttcatggagggcaattaggaaaatattgtctataacacttatgggaagcacagataatgtgaagaagtatgaagttattcaagaagtatggaatttatgtgagaatatgtgtgggagatcatatgtgtgtatgtatgcacatacacatatacatctaaaggaagtcagtgtacacacaggaattgaagccccatgcatagaagagtttaccagggtcagtaaattccaactcacattaagaacattaggagaggtttaaaaatctttctggaccgcaccctgtggaaattcaatttttaaagcttcccgagttaagtctaaagtgtaggtagagttaaaagccacttgaaggcaggcatggtggctcatgcctgtcatgccagcactttgagaggctgaggcaggcggattgcttgagctcagaagttagagaccagcctgggaaacatggtgaaaccccgtttctccaaaaaatacaaaaattagtcgggtgtagtggcagacacctgtattccgagctatgcaggagactgaggcaggagaattgcttgagcccaggaggtggagattgcagtgagccaagatcgtgccactgcactctagcctctaccctgggctacacagcgagactgtcttaaaaaagaaaaaaaaaaaccacttatctggggagaggagtaattaacgaataaaagttgttctgtgacagtcttatggaattagttcccagagcaactgatatgaaagataatttggaacttcagaaaatatggtgttttgctagcagagtcaagggaaaatttgctataaagaggctgagttgtgcagtttgtaatctgaattgtacagaatctgcagttcataatcagtttcagcttttgctgagaatttgaagaatgccataaaaatatttactggatttaacaaaatggagttcattggttttggcaaagcagatgacaagttgaaaacagattacagtagaaatagtttattctatatagattatctaatttctattttttcccaaaaacaccgtggttataatcttttgtctaacatctgttggattgtcattttcttactgatacataacaatgtcttgtaatttaaacattactgaatttattacatattttaaagtctttataaaaattgctttgttgtcttaattttatttttaatttaatgttcttttggttttgtcatttcaaagtttaaaatattatgcagtagaatttaccaatctgatacagtaaactaagggaagacactgggcaggagcaatttatacacaatgagacaaaccaaggaagaaaattttaattaaatttttcttatgtgtaattgaggatattgattaaaaattgatgactttccattttcaatatggtgattattaattttgcttcttttgtcttcctttcatgtatgaatatttgtactgttctaacatctattaccttaatttaatggctagtgaacattattttaatggaaaattctttaaacgttaaggcatttagtgaggtagataatagaagcaaataaacactatttaagatttatattattatctaaccattgcacaaaaggcatctcataactctaactcatagtaaaatgagtatattgatctctccatttcccaaatagtgttttaaagataaaatgaataatatgtcttcatcattattaaattattgtggagatatttaaaattatgatagaaggtttaggattcttaatggactataggttatttataaaaataaatgaatggattgcatttagaaagaatatttataaagctaattttcatacaactttattttgccatccaaataatattttttggacaattgaaacctagatctctgaaaaagaatttcagtctgtactcataaaaatactatgagattatattgctgagttagcaccatgagaacagtgtttctgcaaattttttcttctaggtgcccaccccacagcagattcttcaccaatatttgttagaatttaaatttagcccaattctttaaataagaatgcagagatttcatggtctaagaatagaacaatcagcactctttgtgttctattttactgcttcataaataaagttcttcagtccaagacatctgaacatgtatcagaatattcactaattattgtgaacatattttaaaatggcttaggctacagattctttccttacaaatccatcccattgtttggggaatccaattgtagggtgcttcatatcaggacaaaaaaaataaattagtaaacttgtttctttttctaaaaacgtcataatagatttgcaattttccattatatatttattcagcttatttttggaagatgttggtcttgttaagatatcactgagaatactacattactatgtacaacttatattctgggaactgtaagtaacatttagctgcttaccccaaatggccaagtaaatgaacaactgttatgtcttatcttagaaataaaggttcacataatcatctttcagtgcagagtattaacatttgtttgagaagagctcttcagtagaaaatatagctaatatagacactattattctcaataaaaccaaaacaaagctgtaactctgagtctgttctctttcaccccattgcctctgtaggagaaaacataacgaaagctccagtgctcagcaccagctcatgagcacatttgcctcacttagtgtttaagattgtatgcagaagggcttcatttttagaattaacaatggtgcaattcttcattaaaacatgtatgcctaaagaacatgagcagacacttttcaaaagaagacatacaaatggccaataatatattaaaaaatgctcaacgtcagtaatcatcagagaaatgcaaattaaaaccacaatgaaataccatttcacaccagttagaattgctattattaaaaagtaaaaacttacagttattggtgaggctgcagagaaaaggggacgcttatacactgatggtgggaatgtaaattagtttagccactgtggaaagcagtttggagatttctcaaagaacttaaaacagagcttccatttgacccagcaatctcattagtgggtgtatacccaaaagaaaataaattgttctacgaagaaacaacatgcacttgtatgttggttgcagtactattcacaataacaaagacaagaaatcaacccaggtgcccatcagtggttgactggataaagaaaatgtggcaaatatgcgccatggaaaagaatgagatcatgtcatttgtggcaacacgagtgcagctagaccataagtctaagtgaattaatgcaggaatggaaaaacaaatactgaattttcttgcttacaagtgggagctaaacatttagcattacacacggacataaaagtgggaacagtagatactggggggactattacagcggggaaggaggaaggggacaagggttgaaaaattacctattgagtactatgcacctgggtcacaggatcactcatatctcaaacctcagtgtcatgtaatacccccatgtaacaaatctgcacatgtaccccctgaatctaaaatgaaaattgaaattaaaaaatgtcttccaaataattttttaaatgactatgctttctacaaaaatagaagaaaaaaattttaaaaaaattccctctgggttaaacatggtagagaattgtcacacaaaagaagcatttgccagccatcatttgcaaatttcaagatgtctaggaatctcataaggaaattgtttaaaatgattatttacagcctccactgccagagattttgatctcatcaggttgggatccagggaactccagagactgcatgcatcacattttgacaaacagtgaaaaagaatcctttttttctttgtcttccacgtgtttaaaattaggcagagagttggtgtttcctctttgtgcatacaactagactagatttaccagacattgttacataaggcatggccatataactgagctgtagacaatggaaagtgagtggaaggcaattattggtcctgactcataaaaccttactcaacacacttgtccaagctcttttcccctttcagcctagcttaagtggaggtgaccactatggtggcattgaaagtcaacaaaatgtataggagcaaacatcttctaagttagcagttctcctcaacttcagcacagacacaaatcaaatcatatgcttgttaaacccacagattataaaattctaccaccaaagattttgatttgataggtctagaagaaatgcacaggaatccgtattttaaaaatcatgaggcaattccgatttgtgtgattctggttctataagttgagaagcactgaatgtgtgtatgtgtgtatgtgtgtgtttaagtaatagtgtagttaatgctagtgttggttactaattatatgtcacttatcaaactacatctatttctgcatctttttatatatttattttagaagacaataacattataggttacagaaaaaactggatctccagaaatcacattatagattacagaaaaagaaaattggatctcaagaaatcatctagtttaatggagatcctaatgaaggcagatgtctaatctcactttttctcaaactaaataataccagctacttcaactcttcccttagggtattattttatatgtctataatgattttatcttttttttttctgagcactctccatattctttacctccttaaaaaataaggagagcaaagtaaatatattgataaatgttattaatgcagagtattacacaaaaataatttataggctttacataagtagccattatttatattatatgtattttaaatacagaggatattatttaatttccttaatgtattggagactttaaaatgaaaagtacatgtatcttgttcatttttatatgtctgacttacattggttatcttttgcttctcatatatttattttgctttatatctatatatctatttatcatctgtatctatctatcttctatctatctaattttggcgttttatcttaaagtttaaaaaaatctatggcactatatacacctatatgaccttgattctcctccagtggtttcctatttgtatgttgaggagctattatattttagacaagaagcttggcattttatataaatttcatatttcaaatagcaatttatattgcctattatatgacagatggagaaatgagattgatatgtaataacttacttgcccaatatcatttacctagtaaattgcattgtaatttaacatgttttcatgctcttttgtcttaaaaaaattaaagcttatgagaaaaatttttataatgaacatccttatatagataatttttatttcattatgaaatgaattttaaccagaattatgttgtctttgagtggaagtcaccataatggcagtctacaattatgtttattagtctcgtccattgaatcaaggtgcacatatttcccttctagaaggctactaataataattttctctcaatgcttttccactttgagcttaaggtgctcccgaataaattactacactaaatcctgccatcaaccaatgcaaaagaggaagcatttcaatgcatatataatttgtatccctacttgaaatgcagcattagatttctagtcacctcatattggattattcttatttttgggtaaaattcagtttatgtactaaagattccatcaccaaagtgaaaatagttgggcattatattacattatctgctaccttcctcagagcaggaatttttattttgcataaaaatgtcctttgtttttccctgagtattgaaatgttcatggtttagagtccaaatctctaaatgagatcactagcttgtatttactatgctaatttatcttttctcatagaacaataccgggttttctctgtgactgctgcttttcagtgacgtattgatctgattttggctaaacaatacaatattgctaaaatctggctaagaagaggaccatatcagataattcagtagaactgtatatcattttctattagagaatttatgttttccccttgaatagtctatttttcctaagtttggaccatattaaatatgcagatgtacaaagaacaactataagcaattacaacatactagatatgaaaaatgttttgataaaaagtctattaggaattatatctcctttctgcatctttcagaaattagttttttacttttcataagttttacttttcatagttttcttaagattacttaaagagaatatcttcttgtcattgtgaaatcgataaaatataaaagccatcttatatgcgtctgtttaaacctgctgaaacattataatgaaattgaaaatcaccatacattgtgtgcaataaaataatgcattattagttatattagcactcagatcattaagaaaataaaatgttctttatcaaattttcaagtcaaccttttgctctgaaatttatcactgcagaaaatatttaaatgggaagtctgaatttaatgcttttgtatctatctgttcttttcaggaatttgaggcattttgttagttttccattaaccacaaatatatatcttacatttcaccataagatatgaacataatttaggagacgaattagttcaaaacaatggaccatatttataggatcattaatgcaaataaaggagcagttgtacatttattccaaaattttatctgaaatttgggaggttttgtggtgatggtagatggattagggatgatactcttcctatacagatttcttgctctgcatggatgtatatttgtaggtgtgggtaggtgttgatgtctacttgacagtggagggtgggaggagaggagcagaaaagataactattgtgtattgggcttaatacctgggtgatgaagtaatctttacaacaaacccctgtgacatgagtttacctatgtaacgaaccttcacctgttgtttaaaaacatatttttgcattaaattcagacttcccatttaaatattttctgcagtgataaatttcagagcaaaaggttgacttgaaatttgataaagaacattttattttcttaatgatctgagtgctaatataactaataatgcattattttattgcacacaatgtatggtgattttcaatttcattataatgtttcagcaggtttaaacagacgcatataagatggcttttatattttatcgatttcacaatgacaagaagatattctctttaagtaatcttaagaaaactatgaaaagtaaaacttatgaaaagtaaaaaactaatttctgaaagatgcagaaaggagatataattcctaatagactttttatcaaaacatttttcatatctagtatattgtaattgcttatagttgttctttgtacatctgcatatttaatatggtccaaacttaggaaaaatagactattcaaggggaaaaacataaattctctaatagaaaatgatatacagttctactgaattatctgatatggtcctcttcttagccagattttagctcaatatcactgatcattaaggaaatgcaaatcaaaaccacaatgatactgtctcacacctgtcagaatggctactataaaaagtcaaaaaatagcagatgctgacaagattgcggagacaagggaactcttccctgtaataggcagcaccatcattaaatcatttctttagaaaacaaaaatgcatttttttcatgtttgtgatgtttgttggccatttgtatgtcttcttttgagaagtgtctgtttaagtcctctgcccactttttaatggggttgtttttctcttgtaaatttgtttaagttccatatagatgctggatattagacctttgtcggatgcatactttgcaaatattttctccaagtctgtaggttgtctgtttttatagtttggggttttacatttaagtctttaatccatcttgagttcatttttgtatatggtgtaatgaagggatccagctttaatcttctgcatatggctagccagttaccccagcaccatttattgaacagggagtcttttccctattccttgttcttgctagctttgtcaaagatcagctggtcataggtgtgcagccttatttctgagctctctattctgttccactgtaaaccactttttaaaaaataatgagccctttccatatattctaattgtgaatcttgatcataattatattatgcccagcttatgttttacaaagtgttaaaataagctctgcatgagttcattgtaaaaaaaaaaaaagtgcagatttgtatttaccccatgcatatctttgtacactttctgctcattactacgatcctacccagtctccacaaacacacacagatgtggctttgatattaagttttacatttgcttatatatgtatattctttaaaaaacacaggaatgtatatatatatctgagaattgctatttcaaaaatatatgtattactgaaaatttcagtgctagtaatacatattgtcacttttttactggctctatagttgcagttatataaatctattatattttactttaatatgttcctatagatggacatcattatgcccaaatgataattttaaaaatttagttttatgggctgggcatggtggctcacgcctgtaatcccagcgctttgggtggctgaagtgggcagatcacgaggtcaggacttcgagaccagtctggccaacatggcgaaaccccatctctatgaaaagtataaaaaattagccaggcgtggtggggggtgcctgtaatcctggctacttgggaggttgaggcaagagaatcacttgaacctgggatgcagaggttgcagtgagccgagaccatggcaccgcactccagcctgggcgacagagggagagtctgcctcaaaaatatatatatattagttttatgatcatctattaatacaattagttatcatcaccaatgatttacgtatttatgatacttttacagttggtcttctatgtttacagacaccgtatccataatttagctctgaaagatgattaatgccagaaactgtagagcaattaacacacctgaaacattttatcacaagtagaaaaaaaagactgattgcctatcagacaatattgaaaaattgatatttttattactataactgtttgaatgttttacaatgaaaaaatttcattattttgatcatgctactctgttttacttaagcattttagtattttaaagaggtaggattgtaatccctgaccctgttttttgtttttcgttttgttttgttttgtttttttaacttcaacttttgttttaaagtcacaagacacttaccggtttgttacatagatatattgcgtaaagctgaggtttgggttacaattgattgcatcacccaggtagtgagcataatgcctaatagttgttcagcccttgccctcttcctctctcctgcctcaagtagtccccagtgtctgttgttcccatctttatgctcctgtgtgctcattgtttaactcccacttattagtgagaatgtgtagtatttggtttcctgttcctgaattttgcttagggtaatagtctccagttgaatccatgttgctgcaaaggatatggtttcattcttttttatgactacatagtattcttccatggtgtatatataccatattttctttatccagtccaccactgatgggcaccgaggttgattccatgtttttgttattgtgaattgtgctgtaatgaacataggagtacatgtgtctttctggtagaatggcttattttgggggaggggtatatatccagtaatgagattgctgggtccaaggaactctattttgagttacttgagagatctccataacgatggctaaattaatttacattcccaccaacagtagataagcattcccttttctttgcagccttatcaacgtctgttattttttgactttttaataattgccattctgactagcatgagttagtgtttcattgtggttttaatttacatttctctgatgattagtgatgatgagcatttttttcatgtttgtgatgtttgttggccatttgtatgtcttcttttgagaagtgtcttttcatgccctttgcccactttttgatgggttcttgttttgtttaagttccttgtagattctggatattagacatatgccacttgcatagttggggaatatttactgccattctgtaagttacctgtttactcagttgatagtttcttttgctgtgcagaagtttttgaatttaattaagtctcacttgtcgatttttatttttgttgcaattccatttgaagacagtcataaattctttcccagggccaatgttcagaaaagtgtttcctagcttttcttctaggatttttataatttgaggtctgacatttacatctttcatccttcttcagttaatttttgtatattgtgagagataggggtctagtttcattcttctacatgtggctagccaggtaacccagcatcacttattgaacaaggagtcctttaacaaaattggaaaataaaattatattgacaataagttatttcataatacatttttgaattaggagtaattttagaaatttacgtgaagacagtagatatctataatttttatagaacacatcataataacaccttcacataagtccaaaggtactcttcagaaataatgactatatttctctgaactatttttagtattagctcttcaattttaactttgaattttaaaattatttgtatgtatgatattaagtaaagtgttcaaacaattttttaatgaataaatctcctgtaagtatttgtttgcaggtttttacatagacaggagtttgcatatcaattgagtacatgcctaggagcatgagagctggtattgcatggtaagaccatgttcagctttgtaaattgccaaaatgtcttccaaagtggctgtaccatttgccttctcactatccatgaatgagagttcttgttgctccacatttttaccagtaattgatattgtcaggttggattttagtcattctaataggagtttggtagatttctgtgcagttttaccacataggatgtttaagcattttattgtttagttgctttttttcccaaaattttattaatggaaccacgttttatggtgacattttgcttaaaaatgttttgctgagttattggtggatacatataactgcatgttcttaattttcagttctgtatattatcccactgtataaaatgtaacacaatttattcattttattataaataacatttgagttgattccaatttttcacttattcataacacatttatagtatttatcatacaaatcatgcatatgttagatttattcctagataacagtgatcttctgtggtcactgtaaatagtgccttgtttaacttttttcagttctcatcaactgacatacgtatttatctgttttgttttgttttgttttgttttatcctcctcaatagaatataggctttttgaaaacagcgttaattgtttgtgttgtttactgatatacccctaccacacacaacagtgcatgacatgtaagagaccctcaataaatatttaagttaatgaatgatatagaaacataattgagttttccatgttatccttatatattatgaccttgataatgatcgttaattctatccttatgcactgattgtagatacatctatttttgctttaagtgtgttgagactatatttgtagggtatacacttttggtattgctctctctttctagtgaatggaaattttaatcactatgtatttatttctaacaaatattttaattaaagtctattttgtccaataataatagctatatccatttttattttgtttgccttttatataattttctaccctattattcaaaccttacatgtccttatgcattatatgtctattagactatcatgtaattcactgtaatccaatctgataatctctttaacttgaagtatttattgcctttacctcgtttgaattataaatttgagaacaattctattattttattttttacattatatttgtcctgacttttctaagtagattttttttttttaacttttagcctttctttggctagttgaggctttaattcccctttttattttatttctttctctctactagtctttgttttgttttgttttgttttttgaattttgatgtttcttttttttatactttaatttctagggtacatgtgcacaacgtgcaggtttgttacatatgtatacatgtgccatgttggtgtgcttcacccattaactcatcatttacattaggtatatgctatccctcccctaccccacgacaggccctggtgtgtgatgttccccttcctgtgtccaagtgttctcattgttcaattcccacaaatcattttctgttttcagtgtttaccccaaatattttcatgtgcaaatttaacatataaaagcctaaagttatacaatatttttaccatctttcttctaaaccaaagatccttagcatgtgttacctccagccaccctactgttaacataaatgcctttactgtccagaaatatatttaaatatattaattttgatgctacaaattagatattgttgtttaatacagtaagtgtgtatttagatctacatttattttctaatttgtatgatctctgttatttccagcatcataggccttccttctcagatatttttctttattcttgaagtatagaagttatgtggtgctttagggagtatttgttttttgggtttgtttatgaagggtttgtgtctatctgtagatatcttaatttccactctaacttgtagaaaatagtttttttggggagtatctttctagctttataaacaagttttttccttctctcctatgtctctggcttccattattcttgaaaagtcattgtcattttaagtgtcagttttttgtatagagtatcttttctctttgacttcttctgtaagttctatagtttcactaccatttgcctcattgcagacttctaaaaaaatgtatccttgttgttctttgagattcctaaaaaggcaaattcacatcattaatcaattctggaaaagtcctagccattactttctttcaatatcaacttctccctctcatctccctccaaaatgttttttctttctcctgtttttgttaaactttgtacctttcatctcctggtcacttcgttcctggaaacacacattagtgggaacactaatttgggatcaattaaaagacaatttcagatttgaaatttcagatttcagttcaggtattttgaattatattggtattgttagttataactctaaacttgtttaaatgttgaattatggtcagaagttcttagaggaaactttttgattcttctcccattgtcttcctatcagagtaattttttaaacttagtttatttgcagagtgtgttgccttttgtgggggcttgtatggggttttaatgtgggttttaaatttaacctatttgctgaggttccagattttgcttcttatccctcaagcactttggtcattatatcctaaatctaggtcaacagctatcaaaagatacctccagggtaaatgccactttcagcatttgatatggtaagcacatatggattactattttattatagtttctgacctccaaggaatatagttgctttctcaccacctaagcaagtatttaaaaaggcatttcaaaaatatgtcatctaccatttttgggacatacttatctgaacatctatcatccgtattgctttattacacagatttaaaattttattattgaaatatgaacccattatttatataaaccctttaaaattattttaaaaatattgatgtatgtatttaataaatacataccctgcctgtctcctttaagatttcaaaaaaatactatatataaactatagcattatcaaagtatggataaaatatcaaaaaccatacagtagaaagtaaattatactaaagcttatgcaaataatacttattaaaatagagtgttgaacttaatagatttgacttaaaagtgtggctgccaaaggtaataggcataaggaaacttaataaggaaaaacactcagataccaacacttcccagcatttagcttgaaaagctgtgtgtcacaatgtgaagcgacattttgaaagatataatagacaatagcttccaataactttataaaacagaggaaacagtaattacatggctatttttaacttttattctcaatgtccatcagataatttgaaattaacattcattggggacattattacaagttaacttaatgtggaaaaaggatgaagcattctgatgattttctttaaaataaggaaacatcatggaaaattagataaatttattattagcatgtatctgaaataaataataccacccagtctattctccaaaatattaagatatatgtatttaataaatacataccctgcttgtctcctttaagttttcaaaaatactgtatataaactatagcattatcaaagtatggataaaacactctttataagtgttggaaaatagttaattttagattaaacattacagtgaatttctcagttgtgggcttcaatgagttaaattttaaaactatgcaatcccttttttttttttgagatggagtttcactcttgttgcccaggctggagtgcaatggcgcaatctcagcttattgcaacctctgcctcccgggttgaagtgattttcctgcctcagcctcccaagtagctgggatacagatatgcaccaccatgcccaactaactttgtatttttagtagagatggggtttcaccatgttggtcaggctggtcttaaactcctgaccttaagtgatccacccacgtcagcctcccaaagtgctgggattacagatgtgagccaccgcccctggcccaatcatacgctattaatagcatattttagattgaaaatcctaagaaaaaccatcagataacaattttatttatcaaagaatggaggcaaccaagatatccttcattaggtaaatggataaacaaactttggtaaatccatatgataaaatactattcaatgataaaaagaaatgagctgtgaagcctcaaaaagacatgaaggaaacttaaatgctattgctacaggaaggaagccagtctaaataggctatatactgcattattttgatgatataatattctagaaaagatgcaattatgaagataaaaatagatcagaggtttggggaggggggtggttaaatatatgaaacactggggattttttagggtagttaaactatcctgtataatattgagctggaggatacttgaccctatgcatttttaaaaacttctagaactctataacacaaatggtgaacattaatgtatacactttaagaagtcagggtatacctaataaagtgcaaaatgacaaaaactattaaaatgtataaaacaatctcactgatgggggtatagatttttttattttgttttgcttttctttttaaactgacctaagtaattttggaaatgaagggagattgtcaagagtaaagccaaaagaaactgtatataactactaggttctagttgacaatgttggttctcacattagaaatttaacaattatgaaatcactatacttgtacatggaagtggaacaaataagtaaatgggtggcagatggtagaagcgaagcttctcactgttaaagtgggaagttacatataagcaaggaggaaggctagaataaaccttgccatactggattagagttggatggatcaatatgacttcatgtttagcttaattagatactgatagatatacctagcaatatttataggtatgtgctagtatgcatgtgagttagtgttcatgcatgtatttcctaacactgtcccttcagagggcctagaagcgatgataccccattagcaatgagcacatccagcaccaagatcttggtttctaataccatcctccaacgaaagaaaccagcactccttagtgaaatgcatggttatgggactaggacagggtatacacaagatgagactatcctgtcttgtcttgtggtaccagaaagtaaggatgtgctcagtaaagaaaactatgaaggtttgtccaaaggacacggaagacaactgaaagagctccgaatattcaaagctggaacaagttgtgcaacagaataaactgtattggattataaccaaaagtgtaaaataaatatctatgagtttgtacttatataaatacattattgaataattaaacaggtgggggaaatagacaagttttcatgcagaagaacaccaaataaattatgtagacactgttccatcaagatgttggattataactccttactgcttatgtgcagactacacactttgatttaatttcaaagagtagagtaatggactgggggagagatagtaattgtacgttggagaaatctgacaagcactaccttaggcaggtgattagtgataagtcatgttacctttaatatgatgtgctgagaatgattatctctctggtttttgtctccaaaatccactaccctagtgtaaccatgtgaaaaacttctgaagaaatccaaatgaagcatagagtttagttcatggtaatttatcaagatggattcattagctgtttcaaatatatcatactaatataagatgccagtaatatggaaaaatgggtgagaagtacaaaggaactcattgtactgcctctggaactgttttgtgaatgtaaactattctaaaatggaaggctcatttgcatagaaaataaaaggaataatgaaactaaaatttgggatattgattacttctggcaggggagggaaagaaataaggcacatggaggcttcaaaaagattatcaatagttcataaagtgggtgatgtttacatttttattttttatttttatattcatgtatacttcatgtatgattttgtatgttgatatgccaattatttataaagtaacagtcgcctaaagaatacgtgatacagaaatggaagaaattctaagagataagtttatcagagaggtttctctgggaggtaatacttaatcatttggccaaataaataattggaatgctaaagctataattgatttggaattgaagatggagtatgacattgcaattatgtgttatgcccagtgcctttgtaagaggaaagatagaaaggttgtctttcagaagtgagaaatttatttggcagggcatttgaaagggtatgctttgagaattatgcatgttaatttttctcataaaagtgaataataatgctcatagtgataataatagctataattcatgcctattatgagttaatcacaagttgactgccttccaattcttctcaaaggctgtgcatggataattgataatcaagagagatgttcgataaacttattgcctgttgttgatattattactcttactgtacataaactgcgatagactgactgatgccaccactaaagatatccatgcattaacccccagaacctgtgcatgtgttaccttacgtagcataaggaactttgcagagaggcttaagttaaggatcttaaaatggggagatcatcctggattatctaagtaggcccaaataatcaaatgggttcttgtaagagggatgcagagggaatgggaaaagatgtcacagatgtctttggcaaaagatgtcacagtggaaccagaggttgaagtaatacgccttaaagaccatggaaggggctcaaatgcaggcatgtgggtggcttctacaggctggaaaagacaaggtaacaaattctctcctaaagtctccagaaggaatgcagtcttgctgacaccttaattttggacttctgaattccagaaatgtaggggattaaatatgtgctgtttcataccactaactggtaatttgttaccctacaataggaaactaatacattatgtcatgaaacctcaccagaactctatagattggaactcggattcctcaatttacagataaagaatcagagtctcagctaaattaaggaatgtatttgtattcagcttctcttctctgttgagtggcaaagctgagatttaaatcaaagtctctcttcctctgaagcctataccctttcagctctaatactgccagattagtgcagtggtcctggagttaagctgtctctattggaatcctactttactacttgctgggtgaagttagttaacagcttgggggaagaatagtacttttttttttttttgcgtcagattcatgataaaatgaataacagtacttaacctgcattattgtcaaaacaatctaagtatttagcagcataccttcatatctactgaaatagcctgaaggtcttttaaaccagaaatgtccaaaattgaatttattatccaaactctcaagctaccccacctccttcctatattacttctccatctttttttttttttttttttttttttttttttgagatagagtctcactctgtagcccaggctctagtgcaatggcgggatctcggctcactgcaagctccgcctcccgggttcacgccattctcctgcctcagcctcccgagtagctggaactacaggcgcccgccaccacgcccagctaattttttgtatttttagtagagacggggtttcaccctgttcgcaaggatggtctcgatctcctgaccttgtgatccacccgcctcggcctcccaacgtgctgggattacaggcgtgagccacagcgcccggccagttctccattcttatggcttcatcatcttacattctctgcatctcgtcttctcttctgacctcctactagatactttgttatccatgacgcccccttctgctgcacacacatgctagaaatctaattgttcacatgtgaaattcttcacttggaatccaaatatagttatcatgtctcatttatatggtcacacctctcccccgcttctctctcccacagtctagaggaccctcccgctgttattaacagtattttcaacatctcagtctttaccttccccttgatattgtcgaagataattttcttcaagaggattcaatttacttttgctttcaaatgctagatgcctcactgccctttatgttggtgctgaagagaggcctggtgcttgtttgctctgcagtgatgctattactggtttagtcccaacacaggtcacacgtgcctctgggctcctgcttcagggtgatagcttcactggttcacatcatcatgctcagccattgtttcctagaactgcacacaaaagacagagcggtgggtcctgaatggtcacagtcttaacccttgtctcttctagagccaatcagagccaacccttaagttccagttctgagtctaagaaacaatgcaggtacacatccccatccccaatttttggtgagttccattttagagccctttcctttctttagattccattctggtccacagtgccagagcttctgatatttgatcagtgtaaaatagatcaacacttcattcctaagatgttcaaggttgtattcagagaaattccgcattctttatatatgatatcttcaacaattttttttcttacacttcttatgcacaccaagagatattcaagaagagtagctaaaataagccaaataaatgatcctatcaaaactttctggggacggtggttacctagtcaccttatacaaaatcccataaaaaaaatctgctctaaggttacatacatttccaaatatggacaataaataggtgacaaggtttctaaaactgagccttattaggcattctgtttcaccttgtcactgtatcacccagctctgatctctttcttcactgtcatattcttcattcaagtttgcctcacctctcacttaagaattgcctcagctcctagccaatcatcttgcctccagactctccctttttttgtctacccactactttaacagttctcgaaacaaacataatggattatttgcttttttgtttaaaagcccttttttacttctcattacttctggaatcaattccaacttacttcaatttattcaagacaaggtcctctagaaaggggctacaacataactttctactgttagctcccaggaccatcatcctcagatacccatatctccttctatgtactaaaatccattttctccaaagtatgtatatagtaataaaaatctacttttaagacggaaaagaaggcaagtcctttctttctacattggtagtttacatattttatgagataattaacatatggatttcatatgtaggttaaaatgcgttcaggatgaaacactgagttttacttgacaaaaggtattgtgaattggtgtttctcaaaattcaaattttatgaatagtacagtgaaacagtaaacatgttctaaggctgtgtttaacattgaaggttgagagttctaatttattttgagattacgaaaaagatgtatatttaaaatacttattttagaacaagattggctggcatactttatgtatacagatttagaattttgtaaattcatatgatacagcaataagattgtgaatgaacaaagatgttagttcagtgcacatttttctttagattgttttatttgattctaggatttttaaaaattggcaatcgttacacatgatgaactattcagaccccttaaaaacatatttaaatggaatgaataaaactatggatattgcattcctattagattttacttgctttaaaaaagcatgtagaacaaaatatattcaaagatttacataagccagaaacttaagaaatagtttgagattaaagactatttcaaatagacagtatttttccatttgatctattaaattttcaacaataaatttcaattaaatttggtcattccaaaaacattggtcaagcatctagtatgtgtcaggcactgtgatcaatattggggaaaagagaaaaaaaaatctctttattattgaggagtatgcagtatactcccatgtgggtttagacagatatttgaacaaatattcataatataaactaataattcctataatagaatgatataaaaagtatttatgcaatctcttttgtactttagatggccatcatatttttgtttctttcctattaagttaatggaaataaattacaatgcaaagaagattagttgtgttattgaattgacccacggaaaaaaaaacattatacagaattgctctgcttgttgcttatgttcaaggcaaacaaaggtaaaatattatatttaaaatagccgtagtacatacagaattctcaaaaagtaatttaatgataaatacttctagaagtagtgacctcctattttcaatatagcatttatatactctattttaatttgctttttcaagttattagtggctttttcagccattatccagactaattttggtacataaaaggtataatcacagtgaaaattgacttttttattcaacagaaaaaaagtgttgtgagctattttccgtataattcattaaaattataacttaacagttttcccttttcaatattctttcaaagttagcatttcagtctaaaataaaagtgagcatgtaggacattaattgtacttgtctgaaatgtagttatctaaactaaaggctttaaaagaattattttccattccatatattaaaaattcatcttctcaactcatttaattactgagaattttcaaggacttttaaattatgtttccataaaattcaccacatcttaggatgagtgtttatttcttattccatgaaacgtccattatcagcataaaccaagcttgcaaattagaaatagtaaaaacaactttactatttgcattccattatccttgtacatggttttaggcttaactagagaaggtatctgcagttctcttgataattttttttctctgccatcactcatctagatatttatgtgatcttaaagtggttatattagagagagaaagagagagagagagaaagagagaaaaaaaagagtactggttttggttagatttgatccaaagacaaatttttagaaaatgaagctagaagctaggggtcttgaataaattggcctcacgatacatagttaagctgaaaagatttagaatttgaattcacatataatatttactattgttggaataattataatgagcacttagagatatgttttcttttgataagctttgtccatgtatcccaattaatgctggcttggtatgatactaaaacctaaaataacttattttgagcctatgtccttattacaattctagaggaagcctcttataaaatgtgattagaacacagtcatcaaagcaggggatcatttaaaaaatgatacatgcaaaacttagatattctaactttagtcataattgcatagatattacaacattcatcattcttttgatttagctctaaacccgatacactttctctttagtttgggggactcacaaagactttcttgactaagccacatacctcatacattgtatataaattttcattttgattttttagagtgggatacatgactattagaatcaattttaagatacaatcctaagtttttattatttcccaaaacatttcatagttgtcttatgcatatctgtttttccagcagcgcatctctatagagacttcccaaagcattcaaattaataccctagagctattacttccatttctcgttctagtacatttgctcactttacaaataaattatttaagcacaataaaagaaaaattggtaatttatttggggaaacagaggctactgattctggatgcccaaaactcactttggagtaagtgagcatcagtgagtatataacattttttctttcctgaataaatacattaaaaagaggcatttttatgttaagcaaaagttaatgtgttgagtccattaaagagataatgattaatttttttcaggagcttagattttaaaatatatgtttataagagaaaatgtaatttcctaactctttctactttaaatataatcaattctgaaagtaaatatatttaaatacactatgttataaatgaaagtttatttaaatgcataaaactgtgcctacattattttaaaatatggatacgtatctatttttgagattcagtaaaaataagaaacaaatgcagtaaattccaagatggcatttgctatttttcagcacaaataaaactatgcaaattttctgtttcaaacgtaaaatgccagtttttgattttatttatgttattattttttaaaatttcaacttttattttacatatgggagtacgtgtgcaggtttgttacatggatatattgcatgatgctgaggtttaaggtatggatcctgtcaaacaagtaataagcatagtacccaatagatagtttttcaacccatcacccttcccccttcctcccccctctaatagtctccagtgttaattgattccatctttacgtccacatgtgctcaatgttgctcccacttacaactgagaaaatgtggtagttgcttttctgttcctgcattaattgtcttaggggattatggcctccagttccaaccatattgctgcaaaggacatatggtttcattctttttaatggctgtatagtattcttccatagtgtatctgtaccacgttttctttatccagtccaccattgatgggcacctagcttgattccatatctttgtgattgtgaatagaactgtgatgaatatgcacatgcatgtgtctttttggtgtaacaatttattttcctttgggtatatacccagtactgggattgctgtgttgaatcgtagttctgttggaagttatttgagaaatctccaaaactgcttttcacagtggctgaactgctttacattcccatcaacagtgtaaaatcattcccttttctccatagcctcgccagcatctgttattttttgactttttattaatagccattctgagtagtgtgagatggtatctcattgttattttgatttgcacttccctgatgattagtgacgatgacaattttttcatgtctgttggccacttgcatgtcttcttttgagaagtatccgtccatgcccttcgcccttttttaatgagttatttggttttttgtttgttgctttaagctccttatggactctggatattagaccttgttgatgcatagtttgtgaatattttctgccattctgtaggttttctgtttactctgctgatagtttctattgttgtgcagaagctcagaaaaagagcttaactaggtcccacttgtcaatatttggttttgttgcaattgcttttggggcttagccaaaaattctttgccatggctgatgtcaagatgggtatttcttagcttttcttctaggattcttatagtttgaggtcttatatttaaatctttaatccatcttgacttaatttttgtatgtggtaaaagatagggctccagtttcattcttctgcatttggctagtcaggtatcccaacaacatttattcaacagggagtcctttccccattgctaatttttgtcagccttgtcaaagatcagatagttttaggtgtgtggacttatttctgagttttatattctgttccactggtctatgtgttcatttttgtaacagtgccatgctgttttggttcctgtagccttatagcatagtttgaagttggagagtgtgatgcttccagcttttaatactattgcttaggattgctttggctattcaggccttttttggttccacatgaattaaaaaattttttttctaattctgtgaaaaattacattgatagcttgatagaaatggcattgaatctgtaaattgctttgggtagtatggcaattttaattatattgattcttccaatccatgagcatggaatattttttatttatttgtgtcatctctgatttctttcagcagtcttttgtagtccctttgtagagaattttcatctctttggttagctgtatttcaaggtattttattttactttttgctattgtaaatgggattgtgttcttaatttaactctcagcctggatattattggtacgtagaaatgctactgatttttatacgttgattttgtatcctggaacattacaaaagatgtgtatcagttctaggagtcttttgcgagtttttagggttttccatgtatagaattattttatcagtgaaaagagatagtttgacgtcttcttttcctatttggatgccttttatttctttctcttaacttactgctctggcaaggacttgcagtcctatgttgaataggagtggtgagagtaggcatccttgtcttgttccagttctcaagggaaatgtttccaacttttgcctgtttagtataatgttagcttttggtatgttgtatatggctcttgttattttgagtcatcttcctttgacacctagcctgttaagggtttttatcatgaagggatgttggattttatcaaatgcttttcctgtgtctattgagataatcataaggtttttgcttttaatcctgtgtatgtgctgaatcacagttatttatttgcatatgtagaaccaaccttgcatcccagaggtaaagcctacttgattgtggcgaattaactttttgatgtgctgttgaatacagtatgctagttttttgttttttgttttttttttagatggagtctcactctgtcacccaggctggagtgcagtaacacgatctcagctcactgtaacctcggcctccctggttcaggcaattctcctgcctcaacctcccaaatgtctgagattacaggcatctgccaccatccctggctaattttttctatttttagtagagatggggtttcaccatgttggccaggctagccttgaactgctgacctcaggtgatctctccgccttgacctcccaagtgctgggcttacaggcaggagccaccacacctggccatagtttgctagttttttgataagtatttttgcatctatgttcatcagggatgttggcctaaagttttcattttttggtgtgtctctgccagattttggtattggatgctggcttcatagaatgagttagggataagctccttctccctgacaatttgaaatagtttcagtgggactcgtagcagttcctctttgtaaatctagtagaattcagctgttaatccatttgggttgaggcttttttttttttttttggggttgatagtttttttttttaattactgattcaatttcagaattcagtattggtctattcagggtttcaatttcttcctgattaaatctggaagattgtgtgtttccaggaatttatccattttctctagattttctgatttgttgcatatagaattgtttgtagtagtctgaagatcttttgtatttctgtagaatgggttgtaatatttgtcatttctgattgtacttatttggatcttttttttctttgtttctctagctcacagtctatcaaccgtttttgttcttttgaagaactgttgatttcactgatgttttgtgtgaatttttacatctcaattttgttcagttattctccacttttagttatttcttatcctgggattggtttgttcttttcttctagttcctttaggtgcaaagttcagttgttaacttgagatctttctaacttcttgatgaaggcagttagcactaaaaattccctgttagcactgcccagagattttggtaagttgtgtccctattttcattaatttcaaagaatttttaaatttctgccttaattgtaatgttcacccaggagttattcaggagcaagttgtttaatttccatgtgtttatgtagttttgggagatcttcttgattttgctttctatttttgtattatggtctgagggtaggcttggtatgaattatattctgttgaatttattgagatttggtttattaccaagcatgtggtcaatcttaggatatgttccatgtgcagatgaaaataatgtatattctggttgttgggtggagtgttctataggtgtctactagttctaattggtcaggtgttgagtttaagtctagagtttctttgctagttttctgcctcaacaatgtatataatgctgttaatggtgtgttaaagtttcccactattattgtatagctgtttaagtcttttcataggtcaagaagaattcattttataaatctgagtgctctgatgttgggttcatttatatttaggataattaattcttcttgttgaattgtaccctttgtcattatataatggctttctttgtccttcttaattgttataggcttacagtctgttttatctgatataagaatagtgactcttggtcttttttgttttccatttgcatgatagatatttaacttcatgtccactacaaatttggttttacccatatatttcatatttttactattagctgtctttttataaataattgcctccttaatgcagttttaaacataataattgtttagagaagcctgtgggtgttgttatgtgtgagataggtccctcgaagatagcacaaggttgagtcttgtctttttatccagttcttcactctatgttttttaactggtgtgttttgcccatttaaattcagagttaatattaatatgtgacttgtttatgtcatcatcttgttagctgattgttatgtagacttgattttgtagatgtgtgattttaaaagtcatttagtttttgtataattaaatacatgactgcttctactgctactaaggagaacaacagaagctaacattgctatagcatttaaactaatttaaatctaatttaaactaatttaatcccttatgataattttatgagtgaggtactattactatgaccattttgtagatgatgaaactgaagcacggactaactaagtagcccaaagtttggggcctttaactttgtaagtggtagaggcaacatttaaaatgagggagcatggcttcatcatgttctaagccattaccacatttttacaaaatatggaagcaaattccatgtgtttgaattttaacttccaattgtcttctaccaaacttgtatttactaaaaagattaattttaatcacctactaaataaatccatgctagccgacttaattcattcagtcagaaaaatcaggttgtttagtaagagagctggtttaactttaattttttaaaactgtattgactatttgactaaattggctgggactacatgcaaaaacaactttgttatgaattagaagcttgggaacaagcattcttgctgagattccttagttagtcagttaatcaataacatttaccaaatgcactctgaggggttgggaaggtgaaaaagatatattagacatgtagtctcagacgataaagtaattacaatctagtaggaaacttatattcttgatctctaaacatttgaatttgatggttgattggtgatattattctgagatctttaagatacattacacagatcatatttttaaataatttttttattttactttaagttttagggtatatgtgcatgctgaaacgtaatgtgtatatgtgttatactctggttgtttttctacttgtttgatcctgttttttttaatgaatgatagttactcccagaaaaataatgaacacctgtacatataatttgaaaaagtaacacatattgtaccttttctttcacagatgactaaaacaataaaattaaacttagacaagcacatcttttattatgaataaacgttgttgagaatgggtttcaaactgaccaaaaatacttctaccttcgtttacatattcatgcatcattttcaaagaatatttgcaagaacttgagagaatcttcccagtgtttttttaaaaaaattgaaccactttttcttttaatgctgacttagtaatactttcaaacacccccacccacatttgactttagagaagacgttttagaagaaggggaacattttttgctcactgcaagtgtcatctgactatttttaaagatttattcatcattcattcaaggtagcataatgtcatgagaatgccagctttgaaattagtaatctgtcatgtcttctactggccactcttgcagtttgattagatgcaagtttgcttctctttgaacatttcagtttattttttctaagaaatgattatattgttcaagataaagtataaaattatgtagctatcaggagtatttattgagatatataccactgcagatgtgagaaattaaaacatttttatggcaagtatcttgacctgaaaaagcttactacttactgaagatagatggaaaaaatcaatctttatttttaagaaattactattcaacctaattgatgagtaagcctatggcagatattggtgcatattaaatacaggtattctcagaagagttacagaaccccaaaccaaattgttccctccctatatggtcttcagttgtagtttttgctttccgttaggaagatgattataatttaaaacatgttcatcttatgaaaaactgtttttcctcatctgcatgagaagattaacaaaggtgaagaatactgtttctatgacacttgtaggtgcctatattccaattgctaattatttttcaatctgatggaaatgcgtaaggatgaaagagctgtgttgctagagtgtgtttcattttgcttcagtaagcactgaaaaggcagaagatggcagggtaggtctttaaataggtgatttaaaaaaaatcttcctctttgtttttcttctcctaaaattacagagcagacttcattttatttcctagtaaatattccactgccagagttagctcatgttttgttattaactcaagttgttcaccagtttgcttgttcaactttctctaattcaggagattttatgtcgcacaggcttggagttttcttgattgccttgttaatgctcttatttcctagcaatcaatttagtttgattgatatttgttatgcagcctagttagttccttcacttgaatttcatttacaggtttttttttttaacttacttccttagcaatcagtttgtcttgattgctatttacttcctgacttcttgatattgcaagactgcataaacgtcctaattacctttatgtccactgcaaatttagttttactcacatatttcatatttctgttattagctgccttttggtaaataatagcctctttaatgcagttttaatgcatttgttgtgaatatagacaatggtttgaatgtatatttgcttacttctaacttagaacataaaacatgtatatattatcatgagatacattataactattataaaaacaatcacattagatttaaaaacataaccagggcaaaaagtgaataggtacatacaggtaaactgtggagacagccttaggctcccttagaacacagcaagcttaacctgaacatcaggtttatctctcaccattgggaattaaaaaacacaaaataccaaacaaaaactaggtcactaataatgttctctgtttctgagagtaatttcagacagcactgataaactgaataatgtcttcagtatttccgagagcctgaagcaaacgtctcccaatttaaattgcttcaaggtgaagcagaaacttccttggaatgccatatttctaatagttccctaagaaaggtaattaagtgtctattagattagaaaaaactgctttgcttaattctatgaaccgttgtatttattttaataaatattttaaccatcaaataatcctacaatgtcttaaaaacatgaaaaattaattctctagagggccccattcagtggctggtaaatagtagatgctcattcaatgtagataaactgttcttggatctattttacaatttaagacactcaagctgtgaatctttgcatgttccttctccacatttaggtgagagaatgtttcatctgctctctaccttaagcagactgttgtataatcctgccttctgctcaatatttatggagactagatccaatgcaagcgtgattgaagaatcgtaagggaagatgttctgcaaaatgagagccatgtctctacatctagtaatgttatcagtagttgtaaaactcacaatattcttccagcaagcctttctgcatgccagagtatgcaggtgccataagagctaaaaagtttcaaatttaagagtaataaataattgtatcattgaagtaactttagaatagaggcgataggttaactggcatttgtattaggaaataagagggtggtcaaataatcagagaaaacttagagaatgtgatttgttgttttcaatcaggtcttgaagaagcttatgaatgatttggtattaaagaaaagaacagtgaaacaatgttaggataacagtttatctgaaggccgagaggttaaagtgggcacaagagcctaaaatacaggaatttatgtaagtgcgaaaggacatttgcagaaaggttcagaatcattccctaagtaggattttaccttaatcaacaataaaatgatgctttttttaatgacatttaaagctttgtagtgtatgaatgtttcttacatctcttgcctcttgaaagaaatatttttgcctacactctaccattcaaattctagtcattctctaaggcccagtacaaatgtatatatcattatataagtagttataatattatatcttatttatatgatttatatatatttatattattcttatgtatttatatttataccaacattatttttatataatttatatatttcttaaacttcttttcacctaatatattgtaaggctacaccaccagcacagagcgatatctctttctggatctctcagcaattaatcatttattctattgatgcaagcttttagttttgttgttatttttaattgaggaatactttacatacaaaataaaatgaagatcttaagtgttcagttctatgagttttataaattatacacagccatataactacatccacatcaagattagaacattttcatcactcagaaagttctgttttgcccttttctagttgatgtcccttttctgaattttgttgttataagattagtttttctggttatttatatttatggaattgcattatatatatgttatatgtgtatatctagtatcttttaagtgacatgtttttaaagttcatgcttatatttttaacttttttcctgtgtatttccaagtaatatctcatcctataaatatacagtaatttgcttatccattttcctgtcacacatttgtaatgctttgtaatgtttccaatgagaaaatggttggtgtgtgttaattgtataagcaaccacaaaaacaatcttccaaagtaattgtactattttgcactctcatcagaaatatatgagagttccttttgctccatatagtcatcaacaattgttgttgctagtctttcttactcattgtagtcttttgtaaactttctctacaaggctttaggctatttttaattggcttgcttgtcttttcattattgactgttaggagtttattatataatctggatataatctttcattagagaggtacaggaaatatattttttctaatctatggcatgcctattcattttcttaaattcttaggtttcttaacattgtttgttggtgagcaacattttttaatttagatgaagtataagttattaatttctttcttgtataattagtgtcattgctgacgctaagttcacaaatattttatgcattcttctgaaagctatatggttttgaatttcacattttgtctatgttcgtcttgggtaaacttttgtgtatagagtgagataaaggccaaagcatatttatctccaaagtttatgttttccatgaagctttgtgagtttttaaagcaaatatactaatccggctcttcatttttcttagtcaaattttcacataatagcctatcttctcaatacgtttgtaagtatattgagaaccaaaattattttttaatatttttccataactttacagtgtggattttactttgtttttaaaaagcaaattgtatttgaaacaatgattccaaatattgtgcgcattaatattgatttgtgattgattaaataaatcaaaaattctaataggagtgttacatggaacaactaaagaaaactagaaaaggaaagagtagtatttacaagatattttcttttagaagcaaccttttgcatttagattgttttcgatgttatcaaaacattagataaggtttttcgaaatgtcaacataggtagcttcctggtcaacaaagccagcattactcctttatttacacaaaagaagtgggttcacagactggcaaagagtgatatctagtgggattaccttaatgtcttgatggcatatattctcatttatttaattttcactttgctgtatgattcctaccagttaagacaggaatgtaatgtgctaattaaattattgaaatagttaagcatattatatatctttttatggagaaatcagatgtagtgtatttaggaaaccttattacttaaattcaaattcattacttctgcaagtttctctggagatagcacaacaagcagtatcttttatattctcaaggaggttagagtctgatgctttttcttcgagatggagttttgcttttgttgcccaagctggagtgcagtggtgcaatcttggcttactgcaacctctgcctcctgggttcaagtgattcttctgcctcaacctctggaggagctgggattacaggtgcctgtcaccaggcccggttaatttttttgttttttagtagatatggggtttcaccatcttggccaggctggtctcgaaatcctgacctcaggtgatccacccgcctcggcctcccaaagtgctgggattacaggcatgagccaccacgactggccagaatctggtgtatttttaagcatcatatgtactcttaaacagtgtgttgtcctctacatgacacaagtgtatatgcggatgaaataatttagctacctgtcaaaacggtaattatttctagcaaaaaatagcaaaagataacctgttttccaagaagcccaactttacttttgtgaatgcctgaggattgctaagaggcaataacattataagtattgctaaagtggcaggctgtaaatagagctgactgagcaaagttgccatgggaaacttgtagacttttccaaaaacggaaactgaaccaaaagcattgatagtagttgaagtctggggtctgagagaaagtccttctgcctcctattgaatgtgcctaccaggctgctagagaataggtgggtttgtggacatatgctctgcttatctatccctttgcaaattcccttatatcagttcaccttcaaactcagcacgtcaggtaatgaacactgagaaatgaaaaagaagtttggaaatggaaatgaatcttctcatggaaaatttgtcttgaatttagcccgtaaagggtaatctaaaatggcttacagagaggattttataggacttttttaagttgccgatagggtccatgtttggcgtgctctctcctgctccttcatttgttttttctttcacgattgcccctgctaatactctccctctagttacaaaatgaaaaacatgtgacttgaagagggtttctttcctgaggacaaatgagcaacacttgaagtggaataccaattttttgaccctagccagcagtgcctgatcattccctcgcgtattttagcaactcccttgcctgctgaaccactaacatagtaaatagtagaatcctgctctcaaataatggccagaaaatgttcaattttggtttccttgcacaattcactaatacagtatatgtttcaataattatgttttacaattaagttatatcaaaactcctgacaataattgataaaaaaaatggaaacagtacattttggaaattaaatgtaggagctaattacttcaaaggacattgttgacagatttcattttaatgtagaaaggatatttattattttggtttataagtctttgttgagtttattaagcaatttgtgttgagaaagaaaatgtgaatctaaagatttagtagaacaaagtattaccttgttataataaaaatcctttaagttaaaatttaaggcgtttctaatttggaacctcatttctgagctgttcagatttaactgaatctatttttaaaaaacttaagtagaatatagcacattatctcttcccacccttttttaatgagtagtttttattgattgatgaaacaggagttgtgttagaaatattatgtgtatacttttaggtaactgagcaccattttgatatcaatcacattttaagagaaaataattgcttatctttaatgagagtttcttctattactgatttttattttaaaagtacaattttctgacaatagaaacatttttcagataacatgtacttatactatacactgcctgccaatagattttgcctttcctgattaataatgttggcttgtgaattctaaattccaaagggacatattttcacaaacagaatcagtgacatattaaaactatacggggttaactcataaaatgctctcacaaaatattaccaatagattctattccaacttaaacagaaacttaaaaataagttcacattatggacaaattaaatagatgaacttaatgattgaaatggccttatacttttataaatagatgaaaattaatggaaaaaaatatattaggtatgtattaatgaattaattttcaaaaacagagtttttgcttcataatgactacatatgtaaaagattttgtagaagttgtactctaagtgtaggttaatagacactaaattattttcaatagacagaacttagccacatgatcctgaaaacatattctaggaaaaatttaaatattgtgttatattggaaacagggaagaattggaagaatgggaacaaagttatttatttaatgttaagattcattactaaaaattaaatatttgctgacattatagttttatcataaaaataaggatagtgtaacaatatctatgatataatatatttaaaatcatgtatttaaacatgttgtgaaagaatttgttccctatactacaaaaggtttagttaagtcatattaatgaaaataattcaaatggctcctataatgtatattttgagtgaatacatttatgattataaatcaccttaaatttttcctgtaaagaaagcaaaatgtatctgtgggcttaaaaaaaatattgatcacttaaaatgaaaactcttgtgagaaattcttgagcaatgttggtttcaaaggctctttgacttcaggagaaagaatatagaaggctactgaatttacattttccattatttattttccaaattaattaatagaactagatcccaccttctttatatttgggttgtattgaatattggatgaacatatggagagctcagatttatgtaaactcacctaggaaatatgaatgaatgatgaccattaactctcaccaacacaaaattattttttaaataaaattatgattataaggtattttctgagattcttgtatattaaaatctggcataatggtattggtaatgaaaacaatgtctgaggttctaactgaccataattgcacactctattgtattgctagtgaaccgtttagcagattccattcatcttagaagccttagattgattaaaaaattaatgattgatgacaattaagacttagactctataaaataagatgtaaacatcatgggttgctgattatttcttttttgctatttagaaatgtagaagaatgcttatttaatatatacaagttagattatatcaaacttttctgtgccttttgtttctgtcatatggcattgaaatattgtacagtcctatagtaacactttaggatgttatattatgaaatggaatactgtatattttcaaagacatattgtaatataaatccccaatatctatctgaaatttaagaaaattgttttgagaggaatatcatttgtcttaaggttatatatgtacttaagagtgttaatagtactttgtttagtgtttttaatgaaagatggtgtgttgaaatatgcaggtctagaagctttaaaattagctgtaatataatgtgtttcaaaaaaattaatattgggctgggtgcggtggctcacgcctgtaatcctagcactttgggaggccgaagcaggtggatcacctgaagtcaggagtttgagaccagcctgaccaacatggtgaaactctgtctctactaaaaatacaaaaattagccggatgtggtggcaggtgtgtgtaatcccagctacttggaaggctgaggcaggagaattgctagaacccaggaggcggaggttgcagtgagccgagatcgcaccattgcactccagcctgggggacaggataagactctgtctcaaaaaaaaactaaaaataaaaataaaaataatattcaaatggtctgaaccatgttgaatgtaatagtgtcattgtttggttggaacatgttaaaatgttaagatttttgtcaaggctgcagttgtacatgttgaaactaatgaagaatatggtgattctacagaaaatacagttaaacatttctgtcatgaaccttctatagtcatgtacaatattttggtctggtacactattgactcaagtggaagtagtgattcaacagcttactcttttaagtatgtctttggaatcaggggactgagatgctattcttggaatagagaggcatccattatatggccctcatagcagtcaactattttctgagtaaaatagtgattataagacatttttctgggaattttgcaaattacatcaagattgccaggttaaatgtaagagctagggactaaattttgatgttataatacacaaaagagggatgggttgttcattgccacaatattctagtgacagtaaaccctgacacctctgtttccattctgttttagtagaagaaaaacgtgagcaaattgaaggaaatccagaaaagttttaaagatgagaattactcagaatacacagatagatcaggaaatgaataagacagttcaaaattagtcaatatctgaaagagaggaaagcactagttaaggaaagaaattaatgatttgaaatttatccagaaataataaaaataatatgagaaatatgtgggcattattattagcaaaaactaccttggtaatgaaacttgagtaataaaagagaataatctctcatggaaagataatgcaatttctcttcatttagagaatctgaaactcagcaagctaaaccttcagcagcagtgccaatgtggtaccaaaaggactagataaacagtgagccttagatctagtattcatggttcaataaatactttcaaataagtataatccgttggcatgtgctctttaagatatgcaatgcgttagaattattggcactatttgaattatatacactattgtgtttgtaattttttggttcagttaagttataattagggaactttagatctcttactgtcaagtcaaaattcaggagcattgccggctggttcaaggaacatctgttacattaaattttatgattttcgcatgagttattgctctatctgttgagagtgtcttgtttccctcgaatttaactttaattttaaacatttgtagaaaatgtttacatcacaataaagttgtacataagatttaaacactcataatggaaaatgaattgtgtgttgtcactcatgtctctacatagccaaaagtaatgtaaataatggtacaatttttgactgttatatagcagttttcagaatgcaacttagacttgttttacacatattggaaaaccaagatgaatttttatttcagttaaatactccctggcatcggtgtccaaggcctaagagtgggattggggggtgagggggacgatagattcttcctgattctataataaaatgactcagcagttccctgtgagcttggatgtatacacatatgtttgtgataaatcctctgactatatttcttacatacagagtgaggagcaattgaaacacatcaaaggaatatgtgtccttcatcagcaaaagacaagaaaaaaggatgatggacaattttcattttacttggggcatgaaaatcaagttacttaatttttttttatggaaggagtgtttatactgctcagttttcaaatctcaatcatatattttattatgtctggatatgttacatttcacattaaagctatatgtttagatataaccaaggaggcatcattataaaccatatttctagatgcctttcttccctacttggggtgtcttggatagagctgaagcttattcatgtaaaccattgatgatgccttaagccatacttactcacaaagaagtgtagtgaaaataaaacatcttaaaatatttgtgattgaattgatgggtaatatgaaactgattcattcattggaataaataggaaaagaagttttaatgattcatgagaaaatggaagttaggttcaattgttaaccagaaaaggatgttgtattctcaaataaaggcacgatgataaaggagcctatacattgagagggacagtctttttaaagcaagacactttaacatccatttggtctcttctagaggaagcactctctattaaaacaaagattagaatgattttaagcctatacatgtcaggagaatgagatattttttgacttgttattttggctaacaagtatattttcatttctgtgattcctcatttgcaaactgattaaagtggttttagtacagtgtttcctgtggtcacgtaggactgtcttaggctgactcagaatctatgatccaggcacattgttatcgtagcatttcttaaactgcaaaagtaacagatttccctactgtaataattctgattaacagcgtaagttctgagacaggcctgattctaaatgtcagtcatgacctcttatatcctaatcattacacagttcagtagagaagaaaagtagttgaatttgtactcagacatgtgttaagtacagaagccaccagaggtgaaggtctatccttcagagcagttcaaaagagaaaacatccaagagctctgagcctgcatattacgagggaggcttgacagatgtacaaagaggaactttggctaaatacaattcaggtacagtaaagtataacattacttctcatcactaaaatacaaccaccccatgtcctggaatttgatgcacaaggttaaaaaagcaaaacaaaacaaaactttaaaatgtagaactattttaaagaattatcataaatcagaactctccttcataaaggcctgataatttagagattatcatctatgcaattgtgttgttattcaaagtaaattaactcctggcttatagtacagtattaattttgcatgactggaatcacattagagaccatgttactcctagcaacattactactaacatttacttggtgattttatactaatttacctggatatccttatgagtaaaatgcattgtacaaatacatgtaaagtagaataaactcctatatttgtgaataatttcttccataatgtattagacaaatttcaaatttggatttagaaagcagcttattgaacaatctaattcattttctcttaaacttagtttatcatcaccatatcctgggtcattatcccgtattatattaaaaaaagagttccaggcttcattaccaacctactgaatctgaatctacttagcagaaggggtgtggcatggaatcaaagaggatggaatggaaaatactagaaaattgaaatttgaaataaatcactagattttgatgatttaaatatatagaacattatctagtaaaaaaactcattttatagatacagatattaattaattcatccatgcatatatttactcagcatttcaatgcaaatatgtaattaaaaataattaaaataaaaattagatatcatccctatcggcagagactttataacctaaagtcatgagttatgtaagtatttgcgtgcaacccatgtcaacagagaataaattatcaatgtattgttagtggtatggatagcaagagttgtgatatcatggaaaagatctgaactagatatcatgattgtagctcatgtaatttttctaaaaatcagtatccttgctgataaaacgaatgcactaatttagattatttccaagattctttttagcacaataatcttaaaattatgttatttcagagaagggtgagtgtgaggtggaaggatggtggaattgtgaaaaaataggacttgagactggtagatggataaagtaggagagcgagttgggagaatgcaaagttggtggaaggagaggagtgagttaagacaaaaaactggatggtgaagtatcaagttttactaataatttcaaacatataagcacttgagagacacaggtgaataggagggacctgggactccaaaaggagctcccgaggtccgtcctttcatcaaattcacatttttggcccagagtagtagaagaggttcctctgagaagtgagttacctcacccaaagggagtattttaaattataaaacatttctattgtatgtacaaataattacatagcttatgtgacatttatagggaaccatattccacaaatgtatagaccctagatttgtttcctagaagaaatccagaaatcctaaaccatggaccacctaataaaacatttatatacattaggattcttaattcatttgcttcccgtgagaatgattactagcatgtttactagagggtgagactaggttaacctgctttctttcattctcattagtgtccccagtaataggtagaaaaatagatcatagactagcttccaaagtctttctttcccagggaaaaatgtatatgtttaggaataaacatggtatagcaagatgtcaggatctaatttgaagataaatctctattttaattgtatcaacatttaaaaaattgattggggttaatttctactgatatataactagctgtgcctcactaaagaagaatttaaagtttgaaaatgtaaaatattgtaaaagaaaagagattttatttaaaattgattcttctaactttatttcagaatacatgcttagatggcactttgtgggaacagtcggtagggagaaagaaatgactcaagattatggcacaacttcaggatcaacagaatttgattctgttcagaattttcagattcagaattttctcaacctattagtcccattctgttactgtctatattttgttaaagttaatatgcaaagtaaagcatgagatgtgcatttgttactcattttatcgctattagcttttactactggaaaaagttatcagcagttttgctgggaactgtcatatttctgaatttgatgtaataatttaaaaatatgcctttttatgagatttcaactaaaagacatcctctgtccctttaaatttattttgtggtcaccagaactcacatatcgaactaaagtttacatttgaatttttacttttcacgaattagatttttactaaactgttgcattcttaaaattactttaatgaaagttgtctctataattcatatgtatagacatttatgtattaaaggatatttatgtactaaagctaattcttgtcaacccttatacaaaatgggacttattttaattgtaactaaaagctaattacagatacatatatatatatatatacacacacactttttctaattagcctcacagaaaaatttatcacatagtctgtagggaatgtgtaatgtgctatttaccaaagtgacagcaatcaatctattatgtaattttgattttcataatagtaatttatgaaattaattaaaaaggccaacatgagatgctgcatttaggcatttttttcaattatgacttcatttttttagtataatgatttcaatatatagcctttcaataaatcagacagatgcaagttattcctcttacatctctaaaattggaaaaatatatttgagtatcaatgaaggaaataaaactgtaattttaaattacatccaattctgctaattaagtaattattgaagacaaaataactcatagagaagccctatatattccatatttttccagtctctcctcatttaatattcttatttaattatgaggtatagaatattagaatttcattactggcatctggaagcaaagataagatggttgcaggctttctggtatggcattgtgtgtgacgtgagctgactcacagcataaagggaaatgagagagagtgagtgttccttactgaacttaattgtacataagagctcctctgtagcgttgctttgggggtatctgccatagaactctctgataatgatttctcatcagtggaccaagatgccattaagtcattctccttgttaaaatctgcttattgatgagtttcacttaaaaattaaattcaggtcacttctggacaattgtcttctaatttttttgttctctacataaatggaaaataagtctataatgtttgtcatccaattaaaattttatataatgaagactgtgtttatcaaagacaaagtaactgattcaacttgttcaaaatggaccattcattgaaatgttcaccctagttatatgatgctgtagagacaaaaatatggttgacaatgtttgccttctgaaatctctgaaatgatatgatttagtgcaaatgtctctcaaatgtgtttttcttttagttaaaagtaataatgattaattctgtcatctttctcatttttcctgaggtaataggtattatcaacttgatatacatcttattacaccttattctatgctaataaacatagaaatatgtatagacatatataaaatagaagtgactttaagtttattttacaaaaataaggtcatagtagataagtttgctttctgtttttaaggtaccatgatatccctacaggtcaatagaaataattaaaatattattttaagcagccacatagcatttcataaattgaatgtaatataatttgtgtgatcattctagtgataccaatttgtgttgtttttagatttgttttggctttgctgctataaatatgcttcaataaacacatttccaactggcacacctttttctccaggatagagttccgagaatggagtttctgggtcagaggatgtatgtgttttttaaaaatattactgtattaccttcataaatggctgtagtaatttacatccccaccagtcatatgtgagatttacaatttatgtatgttcttgccattctaaatgctgttaatgattttattttattttcatttttctttttgactaatctgattggttaaaaaatctatcatatctaattattatttatatttgcaattctttgtctgcatgataccttgagcatgtgtttttgctttctttgacatattaggtttccctgtgtctgattttcctgttcttatactttagtttatacttttcttatcaatgtatagatgttcttttatgagacattaatcatgtatctcaagtgtgtgacaaatatttttccctataagcctttgtggtaggggactagctacctctcctacatcatacctttacctctataccccctgcatttacttccagctactctgatttcctgacttaactgtcaaacaagacaagcctttgtattaagtcctcaacctgggaaagctcttccacaagaaatttacatggctcactcatttcattcaagactaaaataacactgttgtaactctctctcctcatttggtgttatttttactcatagaagtagtatttctcattactgtgtattatgtatctcctgtgtgctatcacttatgttatacaatctccatgacaacaggagtgtctattttgtttactttgtgcccccgcacacccaacatttaaaacactgcctagtacacagtaaatacatatttagatttgatgaataaataatttgttttttgtttttattgatgatatcccaatttttaaaaatctaaaaatcactgaaatctctcaaataacttgtattaaaacttctggcctaggactgcattatgtctgtacttttagttagggcatttccctttccaaatctttgtttgtagtaatataggcactactcagtattctcaaatacctatcagtggactcttcattatttactagtccttagtctcacattgtaaagtttttagcaataattagatcttagagctgagcataattaccccactcactgtcctctgaggccatcaccatttacacatctcttactcttaacacttacacactccaatctcaggccctgtgccactgccgaggcgactgctgcttcctacctgttgtaggcagaatcttgttcccccaaattcatatgtcaaagacctaaccccagtacttcaaaaagtaaccattttgaagataagatctctaaataggcgactacattaacatgaggccattagggtgggttctaatttaacctgattagtgtacttataaaaatagaaaatttgggtttacagaaagggacactaaagatgcatgtgtgcggtggaaagaccacatgaggacacagagaaagtggtcatctgcaagccatggagagaggccttgggagaagataaacctgttgacagcttgaatatgaagaatactaggatattaaaaagtcgatgataatagaaaagagaaaaaagtcattgctgatgcccttctccaagaagctgaggaattctatctagctgcagcagccggctttgtaggagcaggtgtgccattaaacacggagagtagaaaggatggtgcaggttagctaaaaacagtccagtgtcaatggcaaagattctgatctagcaggcaaaggagagcatggcagaagaggaagctctgaaagtaggaaagtctaaaattagagacagtgacaaagttatgatgctaggtgatcttcagaattgtgacatgcttcctatgcaggagaataaagtagaaggcttggggaagaaaatctagccaggatgttgggagacctgcccatagactggagtcaggtactagaaagaaatggattttctaggtcaaaaatgtaaaacagaaatcttgttctagaccaagtcatcaaggaaggcagcagattggaaatactgtgactatggaaatatgtgacaatttagaattcattactgcattctggatgttaagctgaagcatctgataaaccttttaatgcaggcacatcttacggaaaaaggtagaattcatctgtgattttagtcacgaagatctgggaaatcctaggcagacatgtttaattctgttctgttcttttatttaaaatcaaaggaggccgggtgtggtggctcatgcctgtaatcctagcactttgggaggctgaggcaggcggatcacttgaggtcaggagttcaagagcagcctggtcaacatggcgaaaccccatgtctattaaaaatacaaaaaaaaaaaaaatagccgggcgtagtggtgcatgcctgtagtcccagttactcaggaggctgaggtgggctgaggtgggagaattacttgaacccgggaggcggaggaggttacactgagccgagatcacgccatagcactccagcctgggtgacagagtgagactccatctcaaaataagtaagtaaatacataaattaattaattaaaaggaactgtctacctgatatgcaaagccccatatggaagtgggaggggagtaaaatcatatcccaattttcttagctagtgtttcctaatccatctttccccatacccaacattgaaacatacatgatgccagctgctaggtgattttcctaagtccagcttccgaattacccttacagccaatgtaagataacagcaactagcaattgtgtagactttttattttttgctaaatttttttttctcattttaaaataaattatagaccacacttagatgtctgccgggtggtggggagcggggggaaagctgttctgtagtttgttgtacaagtgcagggctcctcaaaagaattaaaaagtgagtggcagcgcatacattttggggacttagtgaaaagaagtgcccttcatggtgttgttggaaatgttcctgtattcccaagtgtgccttgattatgaaagcagtgccaaaattaacagacatgttttttagcatctataagctgtatatggtaagtcacagaggagactttcaaagtggccctattgaaagcattggaagagtggcgttttagaataaaatactgttaactactctgattaaattagacatataaatgaagatgtttttcaaaagtgcttcagataatcagatacatttctgaaaaaaacagtctcattctagtaaaagcacaaactactgacacttgaaatagcaaacaatattgtggtttgatctgagaggcatttttatctaatacgttcaaacacatgaagagaaacatcacttattgaaggcctgagacaccatgctcagtctgagttgtaatttgagcatgcatagagaactgcttggatcctagaccctatacgttactcatcttataagcagcctgaaaattgccttatccctgtccttaagacaagtattgtcataggactcaagttcattgacattgattctgcagaatatttctttctctcttgctctctctctctctctgtcttgttctctctttgatctaggtgttacagtttccaataattggtttctagccccttccccaagtgatcaacacttctctttcagccacccttatttctctaacttttgtacccttaatgatttcacagttatatcctcattatcttctcacctaccattatataaactgtattcctaccttgtccttaaattaacatgcacttatgggttttttttagccatgcatgtttaattcttcttataactgaattaatatgtggaccagccttctaggagcctgcattttctgtccctgaaccccagtttatccatgagtctatccccaatatctcctaccaaacctcatcagcatgagtcattgcccatttgtatatctctaagtttcttggtctactctggctgctacagacagcctccttaacattttgttgaccagtcttccagaagctggtcaaatcaacctcttctttcttgtagaatactgttagcctttggtacggtcctttagatttacagaatcagttgtctgtcctaaaataatctactcctgactttatttctctttagagcaggacctcttatcctccccttttccactctgagccatgtatagagaactgcttgtatccttgaccctgtgtgtttctcttgcttccacctgagctctaattaggaaaacttattctgaataaatgacacttggaagaacaaactctgacttacaaagtagcattatacagttttaagtatttttagctaccagctgtgcaagcaataagtaagagactttgaagtgctaaaaatatttgggaagtgtcaagtgggagttggcaaataccctggggtgagaaaagccctagatatgatacatctggcacacatttttagaatgttctatttttagtctgtgttttgatttctgaagagatccaggggtgtttcccttaaaaagaagcaaaagtgacagaaatgcctttagagaacaaggtaatttctgaagtattctttctctcttccctctgcccttcaaattaaaattggcatgatgcctggcattattcttaaatcataaatcactctgaaatctttagaagaaaagtgttctgtaatgtgcaattatgaataagaaaacactgcttgtaacagttaagtatcttgctttttggttacagctctgaggttatcactgccattatttttttcctagttattattattgactaatcattacaaaatcttctagctaattctttttagttggctcatatatgacacttattttggacagtatattcaattgagcccttgtcattgtggctcaataaataaagaatataaccaaaggaaaaataaaatttagtgatgcaagtttgtcttttggttcaagttctaatattaccaatcctcagaatatttcctgatttctagtctcaggaaatacagtaacttgaatacagtatggagctcctagataagctctctttatcatatacagatctcttgctggaagatctcctgtggccatcaatagaaatttaactcccaagcctcctaattagtattaaaaacggggagagagactggggatgggtgtgagtgtgctcatgtattgaattggggtaagaggcaacagagagtccagtcaaaaaatcttagtgaatcttacttttctactatatccctaaggttctgaaaaaaaaaaaattagctcatgggttaagaaatgcctgaaacttacacacttaccagtacaatttgttaattaatagagttttgagttaaaaggtaagtattgattatcagcaagtctttatacagttatcacctctgatttccaataatgccatggattattaaaccttttatttcttgtcagccccatgtcacgtcttgtacagtttgtataaagacacttgatatcccagacttcctcaaggaatctgtcactttctctgtatgttcttaaaattttcagtctcctctagtgatagtattggtttgctgtaaacatttcctgattctgtctgacaagagactgttagtctttgaacaacaacaacaaaaatctctgaaaaataatctgagaaatcctattgcaatactatcattagtgtaatggtgatttaaaaatacgtttaaggtattacaattttgtgatgtcttttcacagagatttagtttataaaaaatccaactcatttgtaaatatcataaactatttgttaatatatttatgtctttacaaccatttcaagtttttaacgactaagcattttttctcgaactttcaaaaaaaatgtatcttaaaaatttagattgtttttaaagaaaggtggttccaaaatgtatgttttggttctattcagtgtaattgtggagtgtccacatagtcttaaatttatatattaaattattttttagataatttgttgagatcattaaacaaatgtttagttttcagaatgcactaggaggtgaattataggtatgggcacctataatattacctatatgctttttagtttctattttgatattgtgttacaaatgtctcaggttttaaatctcctttaaaaactcagcagaaagagaaatttatttgattatgtgttgggatatagttgcaaaaattaaagataatagcaatgttgaaatttggccagtgatctgcattaactgaggagaaatgaaaagtgtttctgtggcatcacaaacagccagctaaacctccaacaatttaaaaggcaacctacttcatcatctttaaagcagagggaaggttggcaagaaatatgcatcagcaatattttctagttgaacaaatatctgaatataattctaggcttatgtttccaaaaaatgtcccagaccatatttaaaaactgcttcaaattatgtctcttaaattatgtttatgattcatatattgaactttcattaccattaaagagacttattggatgtgtatgcatgagtgaattaagacatcgtgttttgtggtagttgataagaaagagaaggagagttaatggcctagaatgctgacgtttcatgggttcttcaagacagcgttcaccagggaaaggaaaacttttgatggcattcatcaaatttgtcagagaaattaagaattataaaatcttcctcttaccaacatgcagaatcatgcaggcgttcctttattttatagatacacctatgataatactgcaagtactaaaataataaagagagctatcaaatgattttttcccctgcaaggaaatgtccttcctgtaatcagtagctattatagcccagccatcgttagccattatattagccttctctttttggtcagtagcttaagaattgaaccataacatttataattcagtagtttctgcacacctgtctactttgtcactggctcaggggattttgatgtgcatgttttgcctcagtgagtcagtttcattgacgttcttgcaaaagttgcatacacagtataaactttcctgagaaagatacttctttgccataaggcttaaaactattcataaaataattctaattttaatctaagtgatctaaatttaagaacaaataccaaagaatcaaatccatagttaattcatgcatgatagataagtaaataattggtatttatatttgaagcaagctcagtgtttcaatgcaaaggttttatgcatctgtctgtaaaattgggattgctgttattgttctctgaattcatgaaggtcagtttaactaaaatgcaaaagttgcttatagcattatttacataaggatacaggtggaatgcaaaggaaggctgcatctgccatcatggaaataagttttatgaatctttaaatactacattagttgtctatgtatatttattttcctcattaagaaaaactgataagggataatggacatatctccttagtgtaatctggcataaacatcttaacggctctgacttcagttttatatttacttgtgttatcatctgattatctgtcttctccctttgattgtatgctccataaaatgagtccagtcagatcttgcttatcattgtattctctgaatctatcaccttgcctggaatctagtaaatgatcaataaatgtctgttgaattaacgagcaaattataagaaaagtgattcaatgttttttttaaaaaacttcaaaacacttgttcacacttgatcaattgaaacttgttaataaaaatacaaaattagactgtgtaatttaatgctagtactattggtgtttcccagaagcaaaagtgtatataggagaggaaaaatgtgttttctgtctgcccttctaagttcttggcagaggcctctgtaaaaaaaaaaagacatattaacaagagaaaagcatataaatgcatctaatgtaggttaatatgacacaggagtcttcataaggaaatgaagaaatgattaaacttgagtgcttttatgctaggcttgatgaagagtggaaagtcacagacaaaatgggtatgagctaagagtattaagctgagggaaacttggcaaggtctgtgcattcagatccctctcagcatccctctgccattgtacataagaatactcatttcctagttcatagcattaaatgactacatcaaaaagtctgaaagagtacagcttagacaacctaatgtcacaccttaaggaaccagagaaacagaacaaactaaatccaaacccagcataagaaaagaaatcacaaagatcagagcaaaaataaatgaaattgaaacaaaaaaaatacaaaagataaatgaaacaaaaagctgattctttgaaaagataaacaaaattcattgaccattagtgagattaaccaagaaaagaagacagatgatccaaatgagctcaattaaaaatgaaactggagattttaaaaccaacaccatagaaattccaaagatcattcaaggctactgtgaacacctttatgcacacaaactaaaaaatctagaggagatgggtaaattcctgaaaatatacaggctcctagattaaatcaggaagaactagagacactaagcagaccaataacaagcagcgagattgaatcagtaataataataaaaaatgcccacaaaaagtccagaactagatggattcacagatgaattctatcagacattcaagaagaattctttgaattcttcttttcaaattctcaaagaagaattggtaacattcctactgaaatgattccaaaagataaacgattccaaaagataaagagggaatcctccctaaatttttatatgaatctagtatcaccctaataccaaaaccatgaaagcacataacaacaacaaaaattacagaccaatatccctgatggacatagatgcaaaaattcccaacaaaatattagctaaccaaatccaacagaatatcaaaaatataatacaccatgatcaagtgggttttataccagggatgcagggatggcttaatatatacatgacaataaatgtgatatgtcacataaagagaattaaaaacaaaaaccacatgattatctcaatagatgcagaaaaagcatttgataaaatttaatatccctttataataaaaaacctcaaccaaatagacatagtagaaacttatctcaaagtaataaaagacatatatgacaaaccaacatcatattgaatcaggaaaagttgaaagcatttcccctgagaactggaacaagacaaggatgcacactttaaccacttctattgaacctagtactggaagtcataggcagcgcaatcaaacaagagaaagaaacaaagggcatccaaatttgaaaagaggaaatgaaactgtcgctaatcaccaatgatatgattgtatacctagaaaactctaaagtttcgttcaaaaagctcctatatctgataaattcagtaaagtctcaagatacaaaatcaacgtacgtgaatcagtagcactgctttacaccaacagtgaccaagctgagtatcaaatcatgaactcaatccattttgcaacagctgcaaaaaacaaacaaggagttgaaagatctttacgatgaaaactacaaaccactgctgaaagaaatcatagatgacacaaacaaacaaaaacacatcccattctcatggatgagtagaatcaatattgtgaaaatgaccatactgccaaaatcaacctacaaataaaatgcaattcccatcaaaataccatcatcattcttcacagaactggaaaaacaatcgtaaaatttgtattaaaccaaaaaaaaaaaaaaagcccacatagccaaagcaatactaaggagaaagaacaaatttggaggcatcacattacccaacttcaaactatactacatggctatagttaccaaaacgacatggtactggtataaaaatagacatgtagaccaataggacagaatagagaacccaaaaataaagccaaatagagccaactgatcttcaacaaagcatacaaaaacataaattggggaaaggataatctattcaataaatggggctggaaaactgacaagccacatgtagataaatataaatggttcctcatctctcactttttacaaaaatcagctcaatatggatcaaagacctgaagtcaaaaattctagaagataatttcagagaaactcttctacacatggacttaggcaaaggattcattcctaagactccaaaagcaaatgcaacaaaaacaaaaatgaataaatggtacttaataaaatgaaaaactttctgcacagcaaaagaaataatcagcagggtaaacagacaacccacagaatgggagaaaacattcacaaactgtgagtccaacaaaggaataatatccagaatctacaaggaactcaaatcggcaagaaaaaaataatcccatcaaacagaaggcaaatgatatgaatagacaattctcaagaaaggataaacaaccaacaaacataagaaaaaacatgctaaacattaccaattattagggaggtgcaaattaaaaccacaatgagataccaccttactcctgcaaaagtggtaacaattaaaaagtaaaaaaccgatagatgttggtgtcgatgtgttgaaaagtgaacacctttacattcctggtgggaatgtaaactatgaaaaacactgtgacaattccttaaagactaaacgtagaactaccattcaatccagcgatcccactactgggtatctacccagaggaaaatatattgttatacaaaaagacacatgcacatgcatgtttatagcagcacaattcataattgcaaagacatggaaccaagctaagtacccatcaaacagagtgggtaaagaaaaggttatatatatagatatatgtgtgtgtgtgtatatatatatacacacacacatacacacatacacataccatggaatactattcagccataaaaaggaacaaaagaatgtcttttgcagcaacttggatggattggaggccattattctaggtggagtaattcagaaatggaaaaccaaatatcatatgttctcacttataagtgagagctaagctatgaggatgtgaaggcataagaatgatacaatgtatatagctcaggtgacaggtgcaccagaatctcagaaatcaccactaaagaacttactcatgtaaccaaaaactacctctactcaaaaaactattgaagtaaaagtaattaaaaaaaaaaaaaaaaagaatacaccttttctggccagccatagtggctcacagctgcaatcttagcactttgggaggctgaggtgagaggatcacttgagggtaggaatttgagaccagcatgggcaacatggtgagacctcactctatttattttttattaatttttttttaataaaaagaatgctccttactttcaagtgtagggtgggcaccttccacattagggtcagaaagtctttcctgcacatgctgtttctcaaattccttcagctaaaaatactcaatgtccaagatgccatattttgagtagtctctctaaaatcctatcaaggagaaaattaaatatatgtatttattctaattcctcatttgcttagtaggtgccataagttttcaggaaaattactaaaaaaatttttttatcctatttggaagtctgttcaactactaatgacagttacaggactgaacctccttagaatctcttcttttctctgcttcttttcttgtttccttttctttcttttttcttttctcttcctttccttcttttctctttccttctcttcattctttcatctttctgttttccgatttttctttttctctctttctccctcccttcctccatttctttttttcttcctcctgcccaccctccctcttccctctctttcttccttcctttcctttccccttctctctccttccttccttcatctttcttcctttttttttttaaaaaaaataacatatgcctgtggtcctagaatactattgctgaaatgtccttggaaagcactttaagaataaaaaagttaaaagcaatgatgttcccagcattacactatcattttaatgtcagaataaaaacttggaaatagctagtgattcctaatttaaagatatctttattatgtagggaagtttatgtagaggaactttccctctgaggtttcaataacagagtcaccctgccaaattaaactgacaatagacagatgatcaaagcaaaaggcatagcaatttattaagatgcatataaacatgggagtcctgcaaatctaagacttgaagggccagatagctgaagcttaaataacctcttcatagcgaagagggaaatgggggatgtaggcaattgagaggggtagtaaatgacctttaggagaaatcaatgggcccaggagacagaaattagcttgtaaatgattctctttggaatatgagtgacactgaaagagacaatgtcttgtgacaaagtgtgtctaggtgttggttacattcttcaatcttccttcttgtgttagataatgaaatttcagggagggaatagaaggaaattgcgttccttcaggaagagcttcagataagggaacttcataaatagagttctaccttatgcttggtgggaagaaacaggagaaggtcaaaaagtccttggtgctgaggctgtttctaaggtcttttaatttccttgagttcaaaagtgctcagcatgccgaagcaccatactgtggagcgttgctctcttgagcttcaacaattacatttaagctagactgaaaaatatagccacaaagtattaataaataaaatagatataatgagaacaatgtatttaaagacatggatataaagatatattggataattctagcaaaatagcagattaggctgttggaaataggcctgctttctgccccaaacacataaatgctttgaaaaaactatgagaatagcaaaaaaaaaaaaaaaaaagtattattgctctccacataactgaatttgacagaaagaaagatttcccaggggtgaaaaacaaataatgaaaaagaaaatgacaggggaaggccaaatctctgatagtccgctggcattctggcattagataccggcaacaggactgtaggctgcagtccctaatgcccatttatagataaagaaatacttcatctcaaacaatggactagaatttaggcctctacatcaaataaagagcctaagcttattctttgctctgaataggaaaaatctatccatcgacctgcaaaatattagggaagctatttaatctagggatttgagtcagtgtgagggagaatcactgacaagcatcaaaaccccagcttccctataaatgaatgaaagttttgaagttatgttaaccatagaacacagtaatctacaggatgagaaatgatataaaaatagagtcggggtaactgatgctatttgagctctaggcaaaagcaagtttcataaataaataatctaatttcttgtaagatatccaaaagaaaaaaaatgaattagaagcaaaagtcaatgacatagtggcaaacaatgttttcagaaaagaaaaatcaatatgtgtgcacctttcatattgaagggtcacagtgagtcccaaataggatagtccaaagccctacccaagtttaactgcagcatgttaaaacaaagaaaaaactttacatctttgagagagagagattgagagaggtatgtagacaaaaagaattgaactgtgtaaaatattggaagagatttattctgagccaaatatgggtgaccgtgggctgtgacagccctcaggaggtcctgggaacatgtgcccaaggtggtaggggcgcagattggttttatacattttagagagcatgagacatcagtcaaatacacttaagaaatatattggtttggtccagaaaggtgggccaactcaaagcagggttggaagtggggagggggaggtttccaggctataggtgaatttaaacattttctggttgacaattggttgagtttgtctaaagatctaggattgatagaaagggaatgttcaggttaagataaaagattgtgcagaccaaagttcttttgaagtcttataatggctgcccttagagaaaatagatgacaagtgtttcctattcagatcttagttaatctctttaggattgggagggtctggaagaaaaagatctagctatgttaatagagcttcttttatagatgcatgttcttccccacaaagaacaactttgcggggctatttcaaaatacggcaaataaacatgttttggggtaaaatatttttattttcttccttgtctggtaatgttataccagagtcaggttggaaaatcatgatatatagggttaaataaaagccatctgatgagaatgtatgatttgtagggcatgactccccagtctctttagataggaatttgggcaagattaaaaaatcagtttagtcctcaggtatatactggctttctaaaaaatgaatgatggttagagcaaaagtggaagtctcatcagcaaaacaggaggaaaagtagaaagtactgagataaaataaccaactcagaacaatacccagcaaattaacaagaataaaactgaagtgaatatatagcaagcccaagaaaggaaaaaacaagacttaagaatctatcattcaaaaatcctcactgacagaaaaaccaccggaattatttcagaaagaagttaattaaaccttaaggaacaagtttgtttctagaaaaaaatagacaaaaattttgattaacctaaggaattcttgtcactaagttcaatattactgttaaatatactgactagttttgagtgtctaaaacaagaggaattaaatagtagacaatagtaaagtagaaagatagaatgaggaagattgaaaataaaagtgttctattttctgttgtctaagaaatgtacagttgttccttggtatccattggggattgttttcaggaacccccctgggataccaaaatttatagatgttcaaattctgtatatcaaatgcactgtatttgcatatgacctgtgtgcatcctcctttacattttaaatcaactctagattacatataatacccaatcaaatataaatattatataaatagttattgtgctctatggctttttacactgtatttttgttgttgtaatgttaatatttatttttaatatttttaatctgtgtttggttgaatccacagacagaatccacaaatatggagggccaactgtatgaaaatattgtttttatttttagtttagtttgttaaatcaagcttacttgtcaaaagaggaataaagaaaccaattaaaaagtaataataaataaaagccaccaaccattgtgttggaaatgaatctatcatgtcattccaatgaattacaatgaatataaacaaattctcccattaaaagccacagtcgtgcactagattagaaataataaatccacaaatacactatttaaaacatgatgcagaaaagataaaaataaaaagattgaaaaagatataataggaaaacgataatccaaataaagttgttaaagctgtagtgatctaataaaaaaaaaaagcttgaaagcaaaagacattgctaaagtgggtcagtatgaaataatagacagcacatttcatcaggaacatacaccactcctgaatgtattttgcattataatcccaaaatacatgataaagatgtacaagaattataagtttagattgataagtctacagtcagaggggaagatactattgtacttctttcagaaactatcttatcaaacagacaaaagtaataatatggaaaattaaaaacacaattaaaaaatcttaaattaattcatgtatttgaaagaactctttattctttttaagtgttctcacaaattaattatgtacttattcataaataccaaaggatgaactaaatatactcagatctaaatgtaataaaattagaaaaaaattatgaggagagcaatcagatacattcaaacactgagaaacatacttccaagtaatccaagaatcaaataaaaaagtataatggcaattattaaatgtttaaatcttcaaaataataaaaccaaaacttaaggaagacaagctaattttatggaaaaaaattatatggtcttaaatgagatttttataaaggagtaagaataaaaattagataagtattcaactaaagaaattcaaaaggccaaagttaaccttaataaataatacatacataagctaaaagcagaaattaatagaaacaaatgattaaaaatagaatggccaggtgtggtggctcacgcctataaccctaacagtttgaggacgaggcaggaggattgcttgagtccaggagcttgagatcagcctggacaacatagcaagacagtgtctctacaaaacttaaaagattagctgggcatggtggtgtgcacttgtggtcccagctactctggagggtaaggtgagaggattgcttgagctagggaggtagagctgcagtgagccatgatcatgcaactgcatgccagcctgggcaacaaagtgggaccctatttaaaataataataataataataataataataataataataatagaatgtatctcaagacaatgagaagaaaacctacatactgggagaaaatatttacaaaagacaatctgataaagaactgttatctaaaataatgtgatgaagtcttaaaattcaacaataagaaaataacctgattaaaaattgggtttaaaaaaatgaacagacatctcaccaaataagatattcagagggcaaataagcatatgaaaagatgcttaacatcatgttattagggaattgcaaattaaaataactaacagctatttaatattattatagcaaaaatgtaaattactgacaacataaaaagtggccaaaaatgtggagcaatagaatctctcattctttgctagtgggactccaaaatggtacaatgactttaggaaacaatttggcagtttcttataaaactaagtgtgctcttaccatacagtctatcagttggactccttggtatttacccagaggagatgaaaacatatgtctgcacaaaatcctgcacacagatatttatagcagctttattcataattgctaaaacttggaagtaaccaagatgtccttcgttgagtggataaataaactgtaatgcatttagataagggaatattattcagtgctaaaagaaaatgaactatcaagcaataaaaagacgtggtggaaatttaactgtatattactaaataaaagaagccaatttgaaaagacaacatgttgtataattccaactatatgaccttctggaaaaggaaaaattatggagacagtaaaaaagatcagtggttgttagggattaggaggagaaagagatgaacagacagagcacagatgatttttaagacagtggatctattttgtataatatataatggtaggtacatgtcattatacattcgtcaaaatccacaaaatatacaataccaggaatgaaccctaatataaattgtggactttagaagataatgttgtgtggatgaaggttgttcttggtcctttggctagagaggaccaagatctttgatgtggctttttgtggttgtgcccattgacatttctgggttgtcaacttaaatttaagtatatataaggcaaaaggaaatccaaggtaacttatcctcatgtcattccttgggccctgaagtcccttagagtttccttatgtttattttatagacaatatctaaggtttttagttgtgcctagatgaaggaagctcttccgttttctctgaaacagaaattcagtttcccactttgccaagaaaattaaaataatcctaagaaaatctacaaactcccatgaaatatgtatctactcatagttatctgtattaatatagtcttatctcatatcctagactctctatggtcttgtataaaaaaatccccaaattcatcaagattttgaaaggatctatgtgcttctacctcctcattagactacattcatctttttcattgtgccatcgcaggcaacattctgtcatacaattggtgcttagtaaattgtgacaaaaattaacaaatagtgctattatagttttcataatatgtataagaacatttaagtttccttttaattttatgagttgactttatatgtataaatgaggagagtgaatgaaatagagattgaagtagagtggaatagagtgaagggagattatgttttggtataaaagatatttgagtgagtgtgtgtgtgtgtgtgtgtgtgtgtgtgttttgcattgaattatcgtaaggtctttgttctgttcactgatatatcttttaagcttgaaaaaaaaaagcctggcatattctaggtgcttgattgatcatcttgaatgaatgcatgaataaacagtgatgtattacacttaaaaaaaaccaatggtatttaggttagaccacgtgttaccatcaaatgaaaatataaagtcttttctagtcttgggaccttatatattatgtgtgttggttcttcttggcatttatttcttaaacatttccattctcctttaagtgattttatcactgcctcttttatattcaccactgagtatcttatggcactgaatatagcagacctcatttataggagcaatattaacctgtattgatttgcagtcatgtaacatttaaatgcaaaaaggtttattaatggcattctttcccaaagaacagaaaaacagttgcatgcttaaatgtatgggtgtgacttgtcatgcatgctgatgtattctaccattgttatgcttgccagctgcaaaccacaatcagaaaacccctagtaattataatagaacaaattaaaaagaggaaaatcttctttctctctgcttagctttcgtgaatacgggaagtcaaaaataaaaatcaggacttagtaaatttttgttgttacagaaaaggtatttctctattttatgtattaataattgaagttggaaacagtttccactggagcttgttacacagcagcagccctttcacccatctccaggccttgaaagtagtggtatgtaaactacaggagtatgattaccagcataggtattgggggaaatgcaccacaatatcctttccatatgatagattctatttggacttttctgttagcaagcacttgcttacattgtagtatttttctttgtaatttccaattatgtaaaatctcaagccatacagcagtaaattaaatttgtaataaaaagttttgagtttaacttcctctgacctggagtcttcacttttgtagagaagcaaaagtatagcctttgttttcttgcttagtttagtttattgagataatacaaagtaaaactcatcctttatagagtacatttcaatgagttctgataaatataaacaatgtgactaccactacaatgaagatatgcaacattctcattaccccaaagagttgccttgtggctctgtgttttcaatctcctccccaaagttagcccctggaaaacacagatctgatttctgcacctataactttgaattttctagaatgttatataaatgggagccacattttcttttaaaagaaaatttaaagggctgtgtacctttctgtatttgtcttccgtcacttagcatatgcttttcatattcattcatttcatcgtatgtatcagttcctttttataactgaatagtattgcaatgcgtggctgtataaaaatttatccatttacagtttgttagacatttaggttattttcagtttgtgatcattatgcataaaagtgctataaatatttacaaataaatttgtgtgtagaaatatattttcctttatgttgaataaaaatccaggagatatttatgggattttggtgagtaaatgtttaacattgtactggtatctcagagtgttttccaaagtggctatatcatgttgcactcccaccagtagtctgtgagagtttaggttattccatatcgttgttaggacttggaattgccattaaaaaattaatttttgccattgtaaaaagtatgtaaaggtatcacagtgcaatttttgtttgcattttctaatgactaatgatactgaatataatttatttgtttcacttttgtatttttgtttataaagtgttcaaatattttgcttatttttattgtattttaaaattttataattattgagttgcaaggttaatatttgcattctggatgcaagttttatcatacacacatacatatgtagccatgggttctgcatctggagatttaaccaactgcagatggaaaatattcagaaaaaaacactaaaaaataataatacaacaataaaacagataaaaatacaaaaatattataacaactatttacatagtatttacatagtattaggtaataaaagtaaccagagtcatttaaaatatacaaaaggatgtgtattagttatatgcaaatataggttgagcatccctaattttaattcaaaaactggaaatctgaaatactccaaaatccaaaactttttgagtgctgacagactcaagtagaaaattctataattagtacttaacacaaaatttgtttcatgcacgaaagtattaaatatattgtataaaattacctttgggctatgtgtgtaatgtatatataaaacataaaagatggggttgtttttttcttgtaaatttgtttaagttccttgtgggttctggatattagccctttgttagatggatagattgcaaaaattttctcccattctgtaggttacatgttcactctgatgatagtttcttttcctttgtggaagctctttagtttaattagatcccatttctcaattttgacttctgttgccattgctttggtgttttagtcatgaagtctttgcacatgtctatgtcctgaatggtattgcctaggtttccttctagggtttttatggctttaggtattacgtttaagtctttaatccatcttgagttaatttttgtataaggtgtaaggaaggggtccagtttcagttttctgtagatggctagccagttttcccaacaccattttttaaataagggatcctttccctattgcttgtttttgtcaggtttgtcaaagatcagttagttgtagatgtgtggcgttatttctcaggactctgttctttttccattggtctatatatctgttttggtaccagtaccatgctgttttgtttactgtagccttgcagtatactttgaagtcaggtagcatgattcctccagctttgttctttttgctgaggattgccttggctatatgggctctgttttggttccatatgaaatttaaagtagttttttctaattctgtgaagaaagtcaatggtagcttgatggggttagcattaaatctataaattactttgggccatatggccattttcatgatattgattcttcctatacatcagcatggaatatttttccatttgtttgtgtcctctcatttccttgagcagtggtttgtagttctccttgaagagatccttcacatcccttgtaagttgtattcctaggttattttattctctttgtagcaattgtgaatgggagttcactcatgatttggctctccgtttgtctattattggtgtataggaatgcttgtgatttttgcacattgattttgtatcctgagactttgctgaagttgcttatccacttaaggagattttgggctgagatgacagggttttctaaatatgcaatcatgacatctgcaaacagagactatttgacttcctctcttcctatgtgaatacactttatttctttctcttgccttatttccctggctagaacttccaatgctatgttgaataggagtggtgaaagagagcatccttgtcctgtgccggttttcaaagggaatgtccacttttgcccattcagtatcatattggctgtgggtttgtcataaatagctcttattattttgagatacattccatcgatacctagtttattgagagtttttttttttagcatgaaagggtgttgaattttatcgaaggccttttctgcatctatttagataattatgtggtttttgtcattggttctgtttatgtgatgcattacatttattgatttgtgtatgttgaaccagccttgcatcccagggatgaagccgacttgattgtggtggataagctttttgatgtgctgatggattctgtttgccagtattttattgaggtttattgcgtcgatgttcatcagggatattgggctgaaattttcttttttttttttttttgttttatctctgctaggttttggtatcaggatgatgctggcctcataaaatgagttaggaaggagtccctctttttctattctttggaatagtttcagaaggaatggtaccatttcctctttgtatctctggtagaattaggctgtgaatccatctgttcctgtgctttttttgattggtaggctattaattactgcctcaatttcagaacttgttattggtctcttcagggatttgattcttcctggtttagtcttgggatggtgtcaaaaagtgggcaagagatatgaacggacacttctcaaaagaagacatttatgtggccaataaacatacgaaaaaaaagctcatcatcacttgtcattagagaaatgcaaatcaaaaccataatgagataccatctcacgccagttagaagggtggtaattaaaaagtcaggaagcaacagatgctggagaggatatagagaattaggaatgcttttacactttttttgggagtgtaaattagttaaaccattgtggaagacagtgtggcaattcctcaaggatctagaaccagaaataccatttgacccagcaatcccattactgggtatatacccaaaacattataaatcattctactataaagacacatgcacacatttgtttattgcagcactgttcacaatagcaaagacttggaaccaacccaaatgctcatcagtgatagaccggatagagaaaatgtggcatatatacaacatggaatacccagcagccattaaaaaggatgaattcatgtcttttgcagggacatggatgaagctggaaaccatggttctcagcagactaacacaggaacagaaaatgaaacactgcatgttctcactcataagtgggagttgaacaatgagaacacgtggacacagggaggggaacatcaaacaccagggcctgtcaggtggtggggggctaggggaagggaggggtagcattaggagacatacctaatgtagatgacaggttgatgggtgcagcaaaccaccatggcacgtgtatacctacctaacaaacctgcatgttctgtatatgtatcacagaacttaaagtatatataaaaaagaaaaaaaaacttaaaagaattttgtgtttagacttgggttccatccccaataaatctcactatgtatatgaaaatattcaaaaatccaaaagaaatctaaaatcccaaacaattctggtcccaagcatttcagataaggagtacccaatctacactgtgccatttcacataagcaacttaagcatctgtggattttggtatccacaggggtcatgcaaccaattctcaaggatactgaggaacaattgtatatgttttcacacattttatctctttgtaaattgtgttgtaattttcttaataatatctgtagtgtgctacaagtgatatttcatggttataaaattagtgatagacaaaatatctaattaagtgtcttgcaaggacaatactacctgctacttaatggtagatggtaaaagggcccaggagactttccagatctccttgataaccggagatggggacttcccagagaccccaccaggatgggattttaagaccctcatagcaaacatgcctgggtattactgggtctctatgataatgagtcctaaaaaaccctagttgttctagagacaaggtcgcctcagcacagaaacaaccttcgtgtactagccacccatccatttttttttttttttttttttttttgagatgagggtctctcttgtcaaggctggagtgcagcggtatgatcatgggccatcgcagcctcaacctccaaggctatgaactttaaaacaaagcttacccttccaagaatagcttaaagtccctttatgaaagaaatacctggtaactgacctagatttaatgccagtataagaagaggagaagaatcccccaaactctgagaatagcctccaaacagagatcctccctgactgaccccctgcctgtacctggcccatgccaccagcctgctcctgctgtccatctgataagagccctgcctaaatagacctcttgagcattagctggtgtctaagactcatctttcatgtgtaatggatggaagaagagaagtcaccccagggaagctggtcaactaggacaactggggaccaccgaagtgacattatctttacaaaaaggagaggtggtttttgttgttgttgctatttctaatgttgatggagtcctatttaccaatttatattttaggtttgtgctttttgagtcctgtttaggaaatatttttctagtccgcgatcacagaagttttatcttaacttctctagagtttcagatttagattttacattttgatctctgaccattttattttttaaaattaattttgtatgtgattacttttgtatactatgtgaagtatgagttgagaaagcgttggtgtgttttttttttaaattaacgtcatacatattttgattttttttggattgttctattctgttctgttaatctttacaactacttttccactaataccagagataaggtaatatgatcatggcgtgtaagtcatccaatcttgttctttttcaaaattgttttggtgattctagtccaaggtttctcaacccttgggacaattgaccatttgcgcttgataattatttgctatgggagggctgcctgggacactttagaatgtttagcagcatccctggcctctactcactggatgctaatagcatctttcccaattgtgatcaccaaaaatgtctccagacaatgccaaaaatcccctgggagacaaagctgtcctctgattgagaaccattattccagttctttgctatttcatttacattctagaattggcttgaaaatgtggcaaagaactgacataactttagtaacttttctaatccttgtatgtggcatatcttccatttacttaggtttttaatttcctttagcagggttttatagtttttatcatatagaaattgcagctctattgaccaatttatctaaaaataccttatatatttgatactattataaatggtgctttaaaatttactttctgattgttgtttgtaatacagtcatgtgctgcgtaaagatgttttcatcaaccacatatatgaaaatggtcctttaaggttataatatggtatttttactgttccttatgtttagatacataaatatttaccattatgctacaattgcctgcagtattcagtacagtaacatgctgtacaggtttgtagcctaggagcggtaggctatatcatgtaaagtatagtaggttatatcatctagatttgtgtcagtacacactatcatgttcacacaatggcaagtttgcctaacaatgcgtttctcagaatgtatacctgttattaagcaatgcatgacttatatagacatgcaatttatttttgtatgttaaccatatatcctgcaaccttgctaaactctcctgttagacctggtaaatctctgatagataccttaggattttctacttggacaatcatgtcataagtgaataaagatattttttctccaatgaaaagatttacgttgttatctgcagcagtagaaatatttccatgttgtttgtttaatttttatctatttatctatctaaattgtttatcagtttaattgcactgtaattaatttaattagattgtctatttatgtaactaaactgtctctgccattaagtagttttcagtaaggcatttcaaaaaatagatgattcaataagaaagctaactagagtctgttttaagttagaggtttagcatattttctaattatttactatctcattcttgcattgagagataacagtcacataaattttgaattcatgaaaacagattatttatttccttccagtggctgatatagactgtacctctgtagaacatataagacttaatgcccattttcttctatttttaagcctctgtgctattttgtaagtctttgtatacaaacagaagttcagtcaaagaagtaagaggatcatattatatacgtatagaaaatatgttttttttttctctttatgcctttgcaggttttaagaaattgctacccatatttgaattcttacatttggtataaggatcaaattagattatgtatataaaatcctattttaagctgtaaaatgagaggcaaatgctagctagatatggcttacgcatgcagtaaatactccatatatagtttttgaattgctagtccttttcagatatacagaaaatttccattgaaccttaaaagcctcaagaagaaagagaagtgagctaattttttttttttggctcagcttttactctagttactggtacataacgtacctctgaaaatattactaagcaattaggacagagttgttttatgagattgacagtgttcttttaaatgccacctatccagtgcacatagttgaatttttctactttgcaggaatttgtgcaatttctccaaataagaaatatttggaggactctagcatggcagaaaacctcagtgggtctgaattgtctaggaccatacatcggaaggatgatgcttcttttctatgttagtgcttagtctctgctattccacatttaatgctttctctgtctccttaaaaacatttccaaataaaaaattaaagaaaatctgataggtatgcacttgcagacattgcttcaacattttgtattaatatagaaccattggtcagtaattatgctgaatatgatttagaatagaaactgaatttgaatcttacctgttacctgtacatttcttcttcaaaggaaaatatattttgtgtacatacacacacatgcgcgtgcgcacgcgcacgcacatatataatgtctattatttctgtaattgattctgcaatgatagcaataatatattttatttgataatatctccaaaaaacgttgaaagttttaagatgtacttactttctgttgcaaaaattacttttacattcaagaagttcaacatctttattacaaaaggtttctgggaaaaatatagatttctataaactatatatacatggacacaggagattggtttatggagatgagcaaaatgaccatcagacactcaccaattgcactgaactcaaactttaaaacaaaacaaaacccattaatatgcaaatgtaggcaactcctgcattctttaacatatttctgaataacttctaaaaggataagtttttcttcaataaatgatgaaacttcaagtttaaaatatataaacactaaaaaaattgatttcatatccaagggtgaatttctctttatttatatctgtatccagctggtagtgggtggtatctcattcctggaaattcatgtattggaaaggaaatgcttaagagaatattcatttagctacaaagcaatggcatttcaagctctgaaatgtcatttggaggagtccctgattccatgggggagaaatgtggctgttctttggcagacttggtaaagctcacttctcagattgatgggtctcgtaaagtcctattggctttgttgactgagctgtacatatcagtatgatttgactgggcttgtgccatattcacattgtgagaattattgtcattagtatcattaatatgcatgcattctccttgttgttctttggatctgtctgaaatttttagagaaatagaatactggcgaggcctcaaactgatgactgtgtgcatttttattttaaaaataaaagcaatttattaataaccatgcatgggaccaaggtggataactaggaaaaccatgttacaattatgtggttcataacaaaatcatttttatgtgcaaatttgatttgtgttattttttgtcttatctgttaaaatatcttttatgttttagtactttgatatagctgattatagtgatgtagtcaggcttttataaatctaatattaatgcaggttacagaaggggaaagaccttccttttattgattgatttttaacagcttttgttcttaatgatcaaaataaaagagttcatgccagaaaacttggaaagtactagagcaagaaactccaaacaaaagacaccgtaatctataattcccatagatgcctttgatattttgatctgtttgtctttcccagcttagggaacactgtggcaaaaaagttgggtttctaaagaataaaaacactcacactcttcctcgatttttgttgggctgagtccacctcacacattgaatggatacatggaagagtggcaactacagtaagaatactgatcacatggtacctgattgatttgcaagtgttacttctgggtacaggcagtgggaggaatcctgttaacctattatataaaaagactagcattggtataggaattcgaagtgtttcctaccgctgtagaccaactcttacctggtgtcaggattgagttatttgtctggtccactagactcagagcttctcctaattttttatttcctttatgtttgttcttctcttgaaacttatggagacctaaaggccctatgtgattcgattccagtattccactccaaatttatgtactttcattctccagtttgctcaatcagatacagtgatacattccttctttctgatttgctctgaaacatgtcaaactcattccttgttcagagatcttaggctgtattaacataatctggaatgtccatttccctgctctaatgtcactttctcagatagacctcccttcactactctctctaaataaccctccagttaacacctatctttttgtttgaccccatttaaaaaatagaacacattatttaaaattgctttgaggtttttatttatgtatttattgtctgtcttgattttctgtcacgttcccccaacctccgagcactgtgatattagaattgaggttgtttattttgtacatctttgtatcttcattgtttagataattttagcacagaggcaatgcctaataagtaaatactgaatgaatgttggataatagagcttggttatctgtttgcatgaatgtgattattagataagttccagatcatagaatcttaagattcttctttatactcactcaagacaaagaggacctagtctcccaaaacaaaaaggttgtctaccttccccatagaaaataaggaggattttcattccttcataatataaatatatgtttaatactacacataatttttattgattgcattctattatatggatataaaatatttttaatcactaacattttactgttgatcattttattttcttccagttgttctgtattatgaatgtcacctctgtggatatttttgtccacatatttgtgtaaaactctgattatttccatagactacatttgttgaaatgaaattgctatattaaaatgtatgcccctctttcagtattttccatactaccatttgaaagtttgactgattaaatacttatggtttaaacactcataaggaaaaatagatattttcagaaaagtttgaaattcttggatacaattttttgagttttcagttttttttaatttaactgcattgttaaagtgaataaagattgacttttttttccaaagtgagaatcagagaaaactaatttgtctgtctcactctatagccattttagccaaaataggaatgtgaattgtttcaaattgtcattctttcttacttctgtttactgttactcttaaaataattgagggtaaccgaaaaataaggcttgaaacacatcagcaagagattgtattcatattgctcattgttttaatgaatagaatcctttaagctaactttgagggatgtgtatctcttttcttaaaagttaaatgttacgttttatctcacaaagatgtcaattagcatgctataagagaaactctttctaaaacatgccccccccccaccacgggtggcatgagcagatatttaatgcacctgctgccttgcaaaaatatcaatcacattgtactccaaaaatgtccaagtaaaaaaggggcaacatttaaaatgtgtggttttggggtcacctgttaaggtatctttagtttcctttcctagaaaaatgattttcttcactgataatatttcagctttgcttttaagaaaagttaatgggtgaaaggatggagtttaaattcttaacagtgggtaattcacttattttcactatttggttttacaatttgaaaaatgagcatattttagaagacacttccccaagataagaattacgtgagtctgacaggaattattaagtatagcgagggaagattggagaacaaagtcattttgaatacatcttagaaaaggagatttttgggcagttgcggctcacggttataatcctagctcttagggtggctgaggcgggaggatctcttgagctcaggagtttaaaccagcatgggcaatatcgtgagcccttgtctctatttaaaaaaaaaaaaaaggaaaaaaaagtttttttctttttaaaataactatgtggtaaatactttttgaatgagtttacataactacctgatgcaatatattttccatgaggagcctcatatttctgagtcctcaatagaaaaaatgagtttttaaaggatattccatataaacaagtatgttgctttttactataaagagtagctaaaatttctccttaagaaaagtattattttatctacatgagaggctttaatgtctttttggagctgaatattatccagaagccctcaaatttatagaacaaatgtgaagaatattaagaattctatctagctggaaaagcaagcctttgtcttaggaacctggtgtgtatatttcaatctcatattcttaacttttctgtaatccaaatcccaactggttatgatttatattctagattttaaattttttccttttcatcattttacattctacccaaatctttagtaaaaagcctatttttggatattaaactattaacacttataattgaattcagactcatctagttaaaatactagggaaacagtccaggacattggtctaggccaagattttgtggctaagacctgggaaacacagacagcataaacaaaaatagacaaatgagactatattaaactaaaaggccttctgcacagcacaggaaacaatcaacagagtgaaaagacaacctgctgaatgggagaaaatattcgcaaactactcatccaactagggactaatatccagaatatacgagaaactcaaaggcaaaaaaaaattaatttaaaagtaggcaaaggatctgaatagacatttctgaaaagaagatatacacatggcaaacaggtagattaaaagatgagcaacatcatacatcatcaggaaaatgcaaataaaccacaacaagctatcatcttactccagtaagaatggctattatcaaaaagacaaaaaataacaaatgctggtgaggatgtggagaagagagaactcctattccctgttggtgagaatgcaaattagtacagtcatcttggaaaacagtatggaggtttctcaaaaaactaaaaatggaactaccatatgatccagcaatcccagcattaggtatttatccaaaggaaagaaaaccagtgtatcaaagggatgcatgcacccttatgtttattgcaccactattaacaattgccaagatatggaatcaatctaagtgtcctaagtgtcttttacatcaaccaaattatgtcattgttaattgcacacatacataaataaaagaaaatttcaaaaacatggtttatgtcattggctttgctattagcaccttgcttatcactaaaattaataacatagcaataataatgtttatggcactctattaccatatttcaaaattttagttttatatttaaaaataaataaaattataatatcttaagtgttagagaaatgtctgccatctaaacttttaattttctaagctaaagtagtctgaaagcagaaaaaattaccctcaactggactacttctaactgggatagttttttaatatgatggaccaaggaacacagaaaaaatattaaatgtagtatatttcttctggaattaattatgaacatgttaatataaaatgttatctcatactgtgaaaatcatattggtaagactccatgccattctgtatttctctaaaattctgtacaaatgctagcaactctattttacttttgttgcatacacttttcttgtggcatgaagcttcaatttcagacagagcaaactgtgccttgacttattcatgctgcattaattagagcaacttattttcttccttatagatgaatactgcctaaaaataggagttctgacaatctgtctcttattgatgaaaaaattttttgatacactttgaattgcaactgaatgaaagctcaatgattagactttgaacatgtcactctaccattcttcattttgtgactcagcattaatattttctgtttatgaaaggaagcccatttaaagtagaaacttctggcccctttggcgctttatgttccccacatcttagagtttatccagaacacattttgtggtataataagagaacatactcacagcttgtgtttattgagatgtcttaaaccttgctttctttctaatttgatacttaagaaaccttggattgacaaccattgcattatgattttctatttgaacaatacttctagcatcaatgcatacttacttcaaggcagaataaagaggctaaagtgaattcatattggtaacctcaagcacaattatacactgatacagtatcattgtataaatattacctgaaaagtaatctgtatatgtgtgtgtttctttcatgcagagattatcaaacacatgaattaagcaaatattcaaggtctataataagtagataaaaatattttctggtattcttgcattaattatgaaagaagattgtgactgaagttttgaaaaattttatattattctcacaattgaggaatttgacttttaggtggatgagattttgagaaaaaaagtattattttgaactgaaattttccttaatatgtatgattaaattcaactctatactgttattttattgatttatttaattgttattccttctctgggtccctaaactttcttcttagtcttaaaaaattatttaataacaaaaataaatgtaaaagaagatgataattgatcatttacttctaaaatacttagtctcttcatttatataaatacgagtaaatgtgtgtgcatatgtgtgtgtgtgtgtatatatatacagagtactattatatctgtagttacagatttgctcaatatgaaatagaaaaacagaagaacacattttgttaatggcagattgtacctcacagcagtgaatctgacatcaggtgattgctttctagatttctgagcagcaaaagtaagtgttcaatacaaagtattcatttctgtgaatacttatcatggaaaacatgagctaaacaattggagcccacttggatctagaattttccttagaaattcaaatgataatgacagtaatttctttgtatgtttttatttctctcataggaaaattttattttataaattcaatggatataaacacataaaatatgtccaaaaagttcattaccttgaaaattattcataaaaatggaggctcctcgtgcatatgacaaatacacaattcaacaataattccaatgctcatgttacatgttttactaaaagaccaaaatcttttcatgtatcttattttatttatgtaactaattttgacttgtggcaagtaataatagctagggctgagtcacacagagccatccatagatatcaccatgaaatatgcctgttgtcttggcatttgccttatgctgttgtctctagtcactatgaactatgtatagtactcttaaaatggctggccaccttgtggctcaccatatgtgtgattataatatttctgactttgaatcgaaggaggtgtcacacagtttggcctttaacctacctctggagactttcagatttaatgtcacatcgaagagtaacttgttgcattttagatactgattctcatgatgtaggatgcttacattattcattacccttcacttgctcaagacaaatacagactaatgatagtgttgggaggaattctacggcactcatttcaatctgcattaatctaaaaactggagaggtggacatattatttctttcatattgtcttcccactaaggaattataattccaactaaatctccgaaagtggaatctttgttcctgtatagacatgtagtattctttcaaggtttcacctgtgattgaaaagagttcattatctttggtagtgagtatcattcacctgcctcatgcattcagcttttttgactgctttgtgagctcttactctagaggttgtctgacttttgacttttcatttgtataccaagatcatcctctctgaagtgttccccttcaatttggtaagattcatgtttctttcttgttatgtagtacacatttcttatgtattgtcattgtcagtgtttatggcaagtttacccttacaggtgaactttgtgaagaggactattcaagtgtgttatgttaccttgttactacattttacacataagcttaagtattagttaaataaatatgtgggtccagattgtttgagggaatgttttgctggttattaactagctccaagacattaaaactttcttagactagaaatgtttatgtgtttttaatacacataactgcagtcttactgtcctgaaatcttttagcctcctggaaactcttatttttattttaatattcaaataatatggctggaacctttattctactttcttgagaatatctgagagctgtcatttctccttctaagctcttcctctgatacctggtttctgccaatttgtccatccccacactgaatctcatctgcaagtacttccctcatagatttataacgtgtttgcatactgatagctgctctcatctcctcccacctctattgacacaaattcatgatagctgtgtatagtcaaagtattaattatttggagggatggaagtggtttatagcactgtacactgtgggcagcagcttaaaatgtcatattagctaccacgcaaaaattcatccatcccatgccaggggaaaccttttacaggtcatgctccttctatggccccagtttattgttatcttctgagcctctgtgaaattttcctttttttctaagttttggcacaaatattcttgataactccttgtacacaaaaattagcttgcactgtcctctgcaatgaaaattttgacctttaataatttgccctgaagaagacaaaaaagtctttaaaatgtttttttaaacaaagactgtttccccttttttaaatcaaatgtgtctgttgtacaaattattacataaattttgttatacatttattgttacagttgtttattcaattattttcaaaatatatttcaaaatgtattttaaaaataactaggtgaagattatgggctatgatctgttctgaaagacagcaccagaaataagaccccacccctaccgtcaaaatgctcagtctactggttggcagatggagaagtggtaaacagagaactatgatgtagtttgacttgagctataccaaaaataatgtggcagcaccagtggtgttatctggcctggaaaggaaaatgtgtatgtgcgggagtgggggatggtgctcacagaaggcttctaggagaaaaagttatttgagatatttgggcatgagagggaggaataagagaaggtacaaaggagaaacgtagaaataaggagggataagaaatggggcaaagtactctcttaggtgactcttaggtgagggctaagttaaaaatatacatagagtattgttagctctcttagagatctatttatttaacatattatctttgtgatttttttaagttaatagtttcttctatttatttccatgatgtcaagatacttttctcctttctgaaatatagtactgaattccacgagctttgtgaaaatatgttttgttgaaaaattacttacatgatataattagtgtgcctgagtagacttttcatctccatcagacatggtgtagctgtttttggaacaaatatttattgaaaaaaagaaaatattcaattgcctgtcagttttctgtttaaacagaaacaaacaaaaagtttgatactttttccttctgaatccaccaatgattttgtcattgacaaataaccttggataattaagatttattgaggataaaacctctgcaaggtaggaacttcagagagttttagtgtatgaaatatattttagacattaaagaactgaatgtgaatcaaaacctctgattctatcacatgtgctcttaggcacaataaaataatgaaaaaacacccaattctattccaaaaagcttttaacttgaaattgaacacatctattgcagtttaaaggaaagttttctaaataaacaataattatgtcgtgtgttgtataaataatttatccatgtatttttaaattactgttagaatttttagtgtcttattattttaaagacagcatacgttttctttgtttgggtggaaccatcattcactaatctttaacgtggttgtttgctggtgttctccaattaagcctcataggttgtgtaatttatgaatgtttagatgctaaatgaagattgattgctgtcctgcacttcagtttgaggtatccacaaaggaaacatctttagtattttttctgcatgactatttttgaagtttttatatccctaaatgcagcagtgacctctttacagcttttaaaatgaaaagaaaaaattcaagcactggtttgtaaagtacctagctgaaatgaaattcctcaagaagagctcatgagattgagtttttccatatctcttcacagaatttgccctcatgggcatgaggtaaaaaagaactcagtggttcatgattaatgtcaggaaactatgatcctggcatgacacaaactatatcaccaaaagcaaaaagtaaagaaaaatgatgattgctcagcaatttacaccagaggatgaaagggaaaggcattttaaattaatggtcccaaagccttgacgctgccctgccacatttcatcaatctggtctgagacatatctcctatgaaaaggggacttcatagtcacttaacgaataccaaacagtaaagtttttaaatagaggctccttttacattttacattagaattttctctgtaatacacaaggttttagtgtagaatttgattaaaatatactctgctgcctggaaaagcttttccttgtaaagctgcctagttttattgtcaaaatggtattcgactgcaatatctttaattgcattgaagaaactggtaatgacaattcattgtcctgaggtttttatagacctaaaatggtttatctctgcactcacttccttaaggaccagaagttgttttgtagaatttgtatagaacgctgtttatactggtaaattatggtttctcttcacacagcatcatttgctcttctctccactcaggataccatctaattctacagtttatgtagcaagcatccagccagatgacgatatgtagttgtatcagtgtagcagtcatgcattgctattcaggtttctgaaaaagagtagtgttatgggcagtgttctgatttaaacttgctcctcattgaactcagtattgctccatcttaggtcatttttgaaaaagcacagaaagaagagttcctaacgaggtggctgcgaatcgataattagaaggaacattctccatgaatgtcttgcttaggaagtatacctaagaattggggtctaagaatatataaaccatgtttttggaaatttatttcatttatggatgtgtgcagttaacgaagtgaccttgtgggatggattgtctgcttttcacagaaaagttataaatgttgttaaactcacatatatatatatatatatatatatatatatatatatatatgaatacgtatttatataattacataattataaatttatagtcttaaaaagagagaaagcatttcattcaaacattagcttagtagtttttttctgtaacagaaatgtgtacagtgctattatgaaggtatgcactcagtaggtacagccacttttatttttataatgtattttcataacatcacacagaaaaataccctagacaattaacatgtttagcttctgagttacatgaatgcagcctaattagaaaggtgccatctaagacggtctcaaaagcaaggaggagggaaggacattcccttttcatggactagaagacttaatattatgaagatgttagcactacccaaagtaatctacactttcagtataattcctaccaaaatcccaatgatgtattttcaggagtacaaaaataatgctaaaattcatacggactctgaaaggggcactgaatagccaaaacaatctataaaaaaacaaagttgagagactcatacttcctgatttaaaaacatgtacaaaggtacagtaatccaaacagtgtggtgctggcacaaagccagatatatacacccatggaatagaacagagagcacgaaagtaagtcctcatgtatatggtcaaatgattttcaataaaagtgcccaaacttttcagtgaggaaaaggcagtactttcaacagatggtgctaggaaacatggctatccaaatgcaaaaaaatgaagttgaatcctttaccttataccttatacacacatcatatacacaaattgactcgaatgaaaaatctaaacatatgagtaaaaactatgaaagctgcagaagaaaacatggggcaaaatgtttataattgcatttgcctgttatttctttgctatgactccaaagataaaggcaacaacagaaaaagaatgataagttgtatatcatcaaaattaaaaacttttttttacatcatagaatcctgttaggagatttaaaggacaacctatggaatgagaaaaggtatctgtaaatcatatacctgacaagagagtaacaatatatcaaggacttctacaaattatgaacaaacaaataaacaaaaaagtaaaataataaaatgacaaaggattgaatacacttttctctaaaaaagataaatgcccaacaaatgcatgaaaagatgatgaacatcattaatcagtagggaaatgcaaattaaaaccaccttacaactattaatatggctattactaaaagaaagctgaacaatccccaagaaaactgaatataacaagtgttggcaaggatgtggagaaattgaaacacttgtgcactgttgctgggaatgcaaaatggtgcagctgctgtggataaaaagtgtggcagttcctcagaaaacatagaattgtcatatgatccaacaattccattttactagatatacacccaaaataactgaaagcaagaacttgaacagatatttttacaccaattttcatagctgtgttattcacaattgccaaaaaggtggaaattacccaaatgtctatcaacagatgagtgaataaacaaaatgtggtatatacatacaatgaaatatttttgatcttacaaagaaattctgatctataatacaacatgggtgaacctggaaaacattacgctaagtgaagtaagctgcacacaaaatgggaaatattatataattccattaagtgagatacatagaatagtcaaattcataaagacagaaagtaggatagtggtttaccaggagtcaggaggaaagatggtgaggagttattgttttatgcatacagagtttcaattgggaatgctgaaaatttctggagataaacagtggtgatgattgtgcaacaatgtgaatgtactcagtgccactgaattgtaaacttaacaacagttaaatggtgaagttgatgttgcatatattttacaacaaaacaaaaagaagaaaactcatgtgaaacaacatgtctggtattcatataaccagtgttgtgagcactcacctttgctttctgtactactgtgggagcaaaacaggctcttagaagctcacctgaaatttgaagagagcagagctccacagctgcaaggaagtcttgcatacagcagaaacaattatataaagcttcttaaagaatctacccctatgatttccctaagtatatattgtagttcagagagaaattttgggcaaaattttactgttgaagaaaatttattttatagggtatgagggtttataacatataaggtgccaatacttgaaaagaatattgttttaataacccaggaaataagttaaacatttgaactcttaaatattaaagggtagaaacaataaaactaataaagataattttcttggtaaaacaatatcttcattctacctctaccccatcatggtgtcttcacaaatttcaccttgacttagtaccttctttccttacaaaataacttttttcctgcattataatggagtgaaatcatgtgttcagaggacttgcagagagaataggttaaagagattctctcttttgtttctctctttgttttggaagctggaatcaatggaatttctcaaccctgttattttaaaatagccctgcatgaatctttgtaagtccatgcgtagagtggatatagggctaggagctatttttttgctgttagaaagttgaatcttcatccataagaagtttaaccttgaaagggtgacaatcagtgatgaggagccttatgtgaggattgccatttttccatttacgtttggctatcacaaatacgtctgagctataaagagatgagaaacttgaaaacagatggcccatctgtttctgtctgtatgaattgtggagcatttgaaagaaatgccaatcatgtaaattgaattctaagagcactctacaattccctaagtttgtccttacaagccattgtgaatcactgccgtatctttttcttattgcagtgaattgagagtatttgctacttgtaaagattattttgctatctaatagcatatcatttatctttaagcaacactaagcaaacaaggattaagatgacaatcaatcagaatcatttcacctttctcaaatgtctttaaaaagtgcataatcctgaatgacaaacaactatgaagtagtaaatacgggtgattaagaggaaaaatttttgcaagcaaaaagtcctaagtttaaatcacctcaattaagtaaaattcttttaatatatgtgttatcttaagtgggaattgtcaaattctattatatatctaattcataagtcagttccagagaaaagatagaagctttcataatttttttgcattgactaaaccatgcagtagcccacatctttccagcatgttttgaaggaattctttattaatattatcatataataactagaattatatgtgtgtacagatattataatactttcctaaacaatatagtgttatgtataattttgttgcatatacttcttaagtaatattaatgtatgtgcaataaaaccagctttttggtgaggtgtggaaagagcagatgtaataatggacaaaatgattgtaacattaatctataactattgcaactaatcataactgtacatctgaaccacaagagtagcctgggcctcacttcttgaaattggtttggtacgtttgaactgatgccaagtatgacctgtagttttaaaagaactcctgaaaattctcagtgctcttcctccagttaatatttattgatatagaagagtgacggctcagcctttatgtattagataattgcactctaacatatgtgttattgttgtaacctatttgtagaataaataagagaagatgagttatttattttccttgctgtccttctaaactcatactaaggtgctagtcttttcctgtctgtatgtgaagttgagggtagtctccatgacttttagagtcatttacaaataataaaaggcatctagacacacacatacatacacacacacacaaacacacacaatacatatacagagagagattaaaaaaacattctcagttcaattattaatatttcaagacacgtgtaatgttgcaagtaagtctgggcctccctttgctccaccataggtgtactgattccattgcagcttgttgcacttcacaggagcctgacacttacaggatctagaattctggacttttttttttttttcaagtgtaatacaccagtccactgtgacccccaaactctgggaaacaccaggcttttaaatggtcactttggagtccctttaattttacttacatatgccttacagagttaaatagaaacctttcagtttttgatagtataaaaggaaagatgaaggagatgatgcacattgctatgaagaactatctaagactgggtaatttatggagaaaagaggtttaattgactcacagttccacaggctgtacagctgtcatggctgggggacctcaggagactttcattgcagaaaggtgaagggaagcaagaacatcttcacatgctggcaggagtgagagagcaaagggggaagtgctacacacttgtaaacaaccagatctggtgagaactcactcactattacgagggggaaatccacccccatgatccaatcatgtcctaccaggtccttcccccaacactgggaattacacttcgatgtgagatttgggtggggacacagagccaaaccacaccaatggacaagggacagaccacttcatgttaatgtctcaggttgatgaaataagcagaaatttaagaaaatgatttaaattgcaaaggtaaccaatagtattactaatagaacaatagtaaaacaccgtggggaggcagtctagagcagctgatgaataacaaacgaatacattcttatctttcagggtaggaagtcatgaatgatgactagaattgaaaaagcaaaaaaaaaaaaaaaaaaaaatcatgtgtaaagatgagattataattaggaactttaacacgagaaaatttactgtttttcaaccatcctcatccaaaattgttcctggagccagagaagggtgtgaaagagtactgtaggcctttgctaccagtaacttcattagagttaatggaaatatttagtctacagccataccaccccaaatacaccttcatctgatcttggaagctgagcagggtctttggcttggttggtaatttaactggacactgcctgggaatacaggacacttttttataaaaggaaacatttaaaaaataagagtgtgactatattctaacctttcaaaaaaaattcatcaagagagtcttctagatattcttaaaatttaataacaaaaattaagtcaaagttaaccgaatttttcaagaactaaaatggtgttagaaatttgtcatgttaatgatatttaataaggcaatattaagttgttagggaccttatgttgaaatttactaatactattgtccttttttaagcgataacttttgtcaaagtggcaaggaggtttcggatgggcagaaattagtgcacatgttgtaccttccctgatacggaaaaccctgattcatcatctttttctgattgtatcatttttgctcttgtcactaatttgtattcttttttccttcctatgaatgctttccaaatagcattctcaacactttgctctcttactatcctgatggatccatccacgttcctaggcttaaacattttaatttgttgtgttttcatgtctttctttgcctacaagattgtgttgagactgatatggtgagtgccttgaacactgcctgaaactgattgtctagaatgaataaaatgagctagacaatgaatgaatgaataaatcaatgcagttatggaagaataaggtgcatacattgctttcaaattgtaaggagacttttcagataggaaatgtcacaccaaaatatttaattacagcattaagactggactgatgagaactaaactgcctccttatcaagagttataaaaagaagtactgtgctacctcaggtagttcacaatatactgtgtacatccttaatccatattacataggttagatttatttttgaatatatataatttttcttggacacgtatcttttctacatatatgtttattgttaaatgcatattttatatgtttacaattacagtcttacatacactgtttatattaactctttatcagatcaagtaattactttctctctgtcaactgaaaattgggtttttattaaagcagctaatgtttctctaatttcctttatccaggttagaaagtgtctatctcttggttttacagatcaaataacctataacctcatcaaaataaagcatatttgctactaattacatttagtatatagtgatattaaattaattttccatgaagactctattactgaggcttcatttagttaataataataaagattctgggagtcttagtcactctcttgttgttatagcagtgcatagcttttaaaagtgaatgacttgatgttcaattgcgttttataaaacatcaaggtgcatttactttgccttgtataagaaattgatgagtatgtgagatgaggttaatgcaatgggtaaaatacatcaattccatgttacaactaatagccttaatagtttagcaaaccatataaaagtttgcctttaaatggacacttaggctaatttgacagcatgcttgccattaggcaacaattcctgtcattagagtgatgacatttttttcttccatccccactcaattctagaaaaacaagagagaggaagaaaggaggacaaactgtttacttctaacattaagttgtggtgcctgtgagtcaaactaattatgcttttgtagctgaaacaaccaataaattttcacagctggtactttgcacctgaaacactttgcatttattagctaaaattatttgctatatacatgattgcttagagaggggagatttttttctaaagctgtattttatatcacactggtagtcattttcttccaatttttgaaacaagatataaaccttctatataaattgcataaatattaggggtttaaaaattgtttcgcttagtattgtaatataacatataatagaattatttccaaaaatgagaatcttgactggcaaatacgtctgaatacagttataaaacctgaagaggtaacactcaactggtctcttcctcctttgctccttttctctttcccttcatttcccttttctccttcccttcatttcccttttctccttcctttccttcctttccttccttttttacttctccatccacctttcttccccaaagcagtaattgtgcaaagtctatgctgttttcaatgacagtagacatttaagtgacattattgtataataattgtattttattttattttgttttaagttctgggatacatgtgcaggatgtgcaggcttgttacataggtaaacatgtgccatggtggtttgctgcacccatcaacccatcacctaggtattaaagccccacatgcattagctatttattctgatgccccccccccacccccacaaccctctacactgttgtattataattttgtctatgcctctggatcaaatgacactgaaaaataaaaactttatattccaaacattttataataagtaaaccagatattctaagatttccttttgtaattttgcaggtctaatattaatttttcttttgcaaaatcaaagcagattttactgatataaattaaatattttatttcttacctatgtcgttaagaaaattgtacagaatatacagggttgggaaactgtagcccatggaagaaatcttgcccactgcctgtttctgtaaataaagttctattggaacacagctggaaaccatcattctcagcaaactatcgcaaggacaaaaaaaccaaacaccgcatgttctcactcttaggtgggaattgaacaatgagaacacaaggacacaggaaggggaacatcatacaccggggactgttgtggggtggggggaggggggagggatagcattaggaggtatacctaacgctaaatgacaagttaatgggtgcagcacaccaacatggcacatgtatacatatgtaacaaacctgcatgttgtgcacatgtaccctaaaacttaaagtataataataataaaatttaaaaaaagaacaaaaaaaaataaataaaataaagaataaaaaaataaaaaaaaaacagccttgcctattatttctttacttattgctaggctgctttcacacttcaagcaatggcagaattgagtagttgcaacagctagcagatggtcttaaaagcctaacctatttactctatagctctttcagcaaagatttgccaaatgctgcactagagtgttcacttagcttgatattttgaccgtttggtcaatgactgaagtttcatatagcattggtttgaaggtcattgctgcatactatataagtcagcatatggacatttattccttcattcagccatatcaaatgtttcttttgccaggcaataagaagacaaaactcaataagacaatttttgacaataaagaaatgtataaatatatattatcatgtacaaaactctgagatatattctgtcattcttctacagtttgtatatatattctgtcactcttctacagtttgtaaggagtactgtggaagtcatacttgttccattcacccttccaattctccaaaataattatctgcagaataaagcagtagcctttaacttctgaaattacagttctgcaaaatgttaagatatggagataaatttcatagctaatgggacacataattgtaacctaagataaaaattgtattctttttagtggcataatttttctgatttgtgcctgccttatccacctatattctactcacacatgaagatacataatttttacaatattacccttttattattatttaaacagaaaatgcattgcaccagaatttccttctagcagaatgtgcattcactctgtgaggacattctcagtgttctttgggggaaatagatactctagggacctggagtggaagagattaagtaggactccatttactgtttcatttggtttatcttttaccgcttttccagtttaccagagttgtagatctagagctgcaggtttttctaaaggagatcaaatttgacatagtgatatattgagaaataaaaacaagataaggaaacagtatttccttatcccagttcctccagaagtatttagttgtaaagtctttattgagaagccattacatgtccagcactttgctaagagatgacattgagctcaaagcttcactaaaaatggaatttgaattgtgtattttttctccatctttcaatgacttgtacaccacaagtgtgctccaatctacttatactgtctcatttctcaccagcttaaaatgtctactcttttaaactgtttccagtttctccaggcagtttttattgttctaacctgtcttaaagtagcctgttatttatctcttggtagtaatacccaatttattttattataaatcatgtatttatatgtcagactgtcttcctaaatggccagctttccaaggttaggaagctgtattttattcagtctttttccctgccaggttccaacataatgtgtcctaggtgtacctagcatagcctatgtacttaatgaagattagtgtaggattgtgatagaaaaaaagtcccctgttaattatcagtttttcataaacacacatttaatcacaaaatacaacattctattgaaaaatggaagaaagtgttgatataagaggtactttcagattgaaatttttatcatctttgaaactgtcctttaaaaaaatatagttaggagtgataatctctacactatttgaagattactgagtctgacaaaaaaaaaaccagaactccaagggttccataattcttctcactaatagtatacctgcctttaagtcaaaaatagaagatgtgtttggaaaaagaaggaaaggagaaatacaggagtacatatagcgttatgagtgacagacttgcagattgaatttctacaaacttctttgttaacaaggccttagtatgggattctgccctctgatactattcttatttcatgatttctaagaggtaaatatccatattttccaaagacagtgaatgacacatagatatcctgcagtaagagattgctaatgcaagttattgactgaatattgaagtaactattggtattttaatgttcttctctttaagaaaattctgccactctctactcccactcaagggttttttttttttgcatgatgccaagttttacatattcattaaaataatgtgcaatctttttttttacatattgtaatccattatgtaccttaagtgatataaagctattgtctctggggagaaaacttgtatccctgtgaataagtttagtttattatagaaaacacaaagctgcttacttcagagcttgtaagatatagaataataggtaccaaaagccacaagaagaatgttcagggaaaacaggccaatcctggtatgttttctgtaaatctctctctctctttttaaatctgaagtgtgatgtgttttgatcaaagatgaacatgtatcaataaaacctggaaacatacttaactgtgctttttaattttctagctagcaatgttctcttctagaacacttcgaagtataatctttttttttttaaggctgttgactcaaagttacaagacatagatatgccattagcaagagattgaaaagtgaattatttttgtacacacttttatgctacagtgacctatgcttttgatcttgggagaaaaggtgtattttattgagtatttatgagaccatgataaagctcagtgttaaacttaatagtcagtggtttctttttgtgtctagcattttgcttattagaggaaaagaaacaggaatataatgtgtatagctgtttatgtattaaatgatcttgttgaacaagaattcgtaagatgccatcatcccattgacacaactttttttaaattccttatggctctttttcctgttcttatgagaaaatagtgagatgttcattacttttctggactaccatagaaagtacaaagccctgagtttatttgaagtctcacacttagtacaattctgaagtttcagtgtctaatttctgacaataatccaaagtcatatgataaaggttgcatagtcattcctcctataggggatatatagggattcccgaagtggcagaagtcaccttctccctgactgccaactgcagatagtgaagaaaagtgttcaagacagtttcttagtgaaactctctgggcctcatgaaaatatgaaaaatagtaaacacaaatatgtaaatacatatatatgaaaatatatcagatataaatataaaatctttagagatatttaaaatactcaagttggacaacatgttgactacagttgacaatatattgtattattgaaagatgttaagaaagtggatgtaaagcattcttacaacataaatgataattatgtgaggtaaagcatgtatcagttagatttagtcattccactaatgtacatatactttaaaacatcatgtggtacatgataaatatatataattttatctggcccttagaaaaataattttaaaaaatcaatattgatagtttatctcatgttatagtctgtttgaaatctgaagttaaatcatatttactatgaacaaaaggtttaaaaattaaaattcaagctgattctttaaattttaaaattatttttaatttttatgggtatgtagtaggtgtacatatttatagggtacatgagatattttcatacaggcatacagtatgtaataatcacaggagggtaaattgggtatccatcacctcaaatatttaccatttctttgttataaacattccacttatactttattacaaaatgtataataaattattgttgacggcagtcaccctgttgtgtaagcaagtactggatctttttctttctttctaacaatatttctgtacccattaaccatttccaccccctgacttttcccagcttcttgtaaccatcactctactctctacctccagcagttctattgttttaatttttagctccccaaaataagtgagaatatgtgaaatttgtctttccatgcctggcttatttcacttaaaataatgtcttccagttctatccatttcgttgcagatgacagaatggcatttttttatagctgaatagtactccattgggcatatgtaccacatttttcttatccattcagtctgtggatggacacttagattgcctgtaaactttggctgttgtgaatagtgctgcaataaacatgggagggcagatgtctcttcaatatactgatttcctgtcttttgggtatattcctagctgtgggattgctagaccatatgaccattctatttttagtcttttgaggaaccttcattccattcttcatagtgatgttactaagttacattttcaccaacagtgtactagggttccctttttcgcacatcctcaccaatatttgatattgcttgtcttttaggaaaaaaaaagtgattttaacaaggatgagaaagtatctcattgttgttttgatttgcatatctctcatgatccttgacactgagatatacctgtttgccatttgtatgtctgcttttgagaaatctatattcagatcattgcccattcttaatcagattatgaaattttttctcattgagttgtttgaactccttatatattctggttattaagcctttgttggatgggtagtttgcaagttattctcccaatctgtgggttgtctcttcattttgttgattgtttcctttgctctgcagaagctttttaatttgatgtgattgcacttgtccatttttgctttggttgcatacaaagttgagtaatacccccaaagtgcatgcaaccaaatccagtgtcctgcagaattttgcccaatgtttccttttagtagtttaatagtttgggatctcagatttaggtttttaacccattttgatttgatttttgtatatggtgagagataggggttcattcttctgcatatgcatatccagttttcccagtgccatttattgaagagactgtcctttctccagtgtatgttcttggtacctttgttgaaaatgagttcactgtggatgtataggtttatttttgggttctctattctgttccattggtctgtagcataatttgaagtcaagtattagttctgtagtatattttgaagtcaggtaatgtaattcttccgtttttgttcttattgctcagaatggctttggatattctgttttttatggtcctataacaattttaggattattttttctatttctgtgaagaatgtccattggtattttgatagggattgaattgaatttgtagatttctttggttagtattgatatttttaacaatattgtttcttcccatttataaagatggaatatttttccattttttgtgtcctcttcaatttcttgcatcaatgttttaaattttcaatgtagagatttttttggttaattcccagatacttgattttatttgtacttattgtcaatgagattatttttacatttctttttcagactgttcgtcgctggcatatggaaatgctactggtttttgtatgttgattttgtatcctgcaactctactgaatttattagttttaatttttttggtgaactctttcagtttttccaaatatatgattatgtcatctgcaaacaggcatacataatttgaattcttcctttccagtatggatgctcttgatttctttctcttgtctgattgctctagctagggcttccagtactatattaaataacagggataaaaatgggcatctgtttcaggtttcatatattagaggaaaagctttcaggtttttcccattcactatgatactaccagtgggtctgtggtacatggctttctttgtgtgtggtatgttctttctatatgcaggctttgatggtttttatcatgaagagatgttaaagtttatcaaatggtttttcagcatcaattgaaatgatcatatggtttttgtacttcattctgttgatacgatgtatcacattgattgatttgtgtatgttgaaccattcttacattactgcgatagatctcacttggtcctgatgaaggacctttttaatgtgttattgaatttggtttgctagtattttgtagaggatttttgcatcactgttgatcagggatattggcccataaattcttttttttttgatgagtctctgtctctgcctcgttttggtatcagggtaatactggccttgtagaatgagtttggaagtattccttcatcctctatttttttttttgaatagtttgggtagcattggtattagttcttttttaaatgtttgataaaattttacaatgaagccatcagatcctgagtttttctttgatggtagactttttagtatagcctctattttactacttgttattggtctgctcaagttttgaatttcttcatggttcattcttagtaggttgtaatgtcaaggaatttatccatttcttctagcttactcaatttattagcatagagtagctcatggtagtctctaatgagcctttgaatttttgcaatatccatagtaatgtctctattttatctctgattttcttcgtttgggtctcctctcctttttattagtcttgctggagttttggcaattgtgtttttcttttcaataaactaactttttattctgttgttttcttttttcatttcaatttcatttatttctgatttgatctttattttcttttccttctactaactttggatttggtttgctcctggtcttctagttctttaagatgcatcattaggttgtgtatttaaagttttttcttttttttaatgtttgcccttattactgcaaactttcctcctaatgctgctttctctgtactccatagattttgtgtgttgtgttttgattttcgtttgtttcaagacattttaaaactttctttttaatttcttcgttgactcagttgtcattcaggaacatattgtttaattttcatgtgtttgtgtaattttcaaagtttctcttgtcattgatttctagttttattccattgtggccagagaagacacttgatataatcttaatatttttaaatgttaaagcctttttttgttgcttaaagtatggcatatctttgagaatgattcttgtgctgaagagactaatgtggattctgtagccattgagttaagtgttctgtaaattaggtctatttttatatagtgaacattcagtctgagttttctttgttgattttctgcctggaaaatctatccaatgctgaaagtgaggtgttggtcttcgtctattattgtactggggtttacctctctctttagcgctaataatatttgctttgtatatctgagtgctccagttttgggtgaatatacatttgcaattgttatatccccttgctgaattgacacctttgttatttctttatctcttcttacagtttttgtcttgaaatctatttttttctaatatgtctactactgctctctttttggtttccattgccatgtaatatctttttccctccctttattttcagtctatgtgtgtctttctaggtgaagtgtgtttcttctaggcaacagaccatttgctcttgtttttttttaatttagtcatctactctgtgtcatttaattggaaaacttagtctatttatattcaatattaagtaaagacttactactgccattttgttgtctgttttctggttgttttgtgattcattctctcccttcctccctctctccctccctgcctccctccctccctccctccttccttccttctttccttctttccttcctttcttccttcccatctttctttttgtgaaggttattttctatggtggtatttttaatttcttgatatatatgtttgtgtatccattgtgggttttaaatttgaagttaccatgagacttgcaagtaacatcttatattccattattttatactattgacaacactgattgcaaaaacaaacaaaagaccaaacatgcaagagaaagctagtaaaactttacactttaatttcatcctctgcttttaaacatttattggttctatttatattatgtgtatgtcttgaaaagttattgtagttattatttttgatcagttcattttttagtctttctactcaatatatgagtaatttatacaccacaaatacagtgttgtacaaaacacccatgtttttctttgtatttaatatcatcagtaagttttgtaacttcagatgatttctttttgctcagtaagtcccttttccttctgattgaagtactctctttagcatttcttgtaggacatgtctgtgatgatgaaatccctcagctcttgtttttctgggaaagtctttatttctctttcatgtttgaaggacaattcactggatatactatagataaaggtttttttcccctttggcactttaaacatgttatgctactctctcctggcctgtaagacttccacagaaaagcctgctgacagatgtattggagctcctttttatgttatttgctttttcctttctttcttttttctttttctttcttttttttttttgctgtttttagaattctttctttattcttgaactttgagagtttgattattaagtatcttgagatagtcttctttagttgtatctgcttcgtgttctataaccttcttgtacttttcaatattgatatgtttctctatgtttggaaagttctctgttaatatccttttgaatgaaagctttctatcccaaactctctctctacatcctctttaaggccaataactcttaaatttgcccttttgagggtattttatagattttgtaggtgtgcttcattcttttcttttttttttcttctttttcctcttactctgtattttaaataccctgtctttcagctcactaattttttcgtctgcttgatcacttgtgttgttgagaaactcctatgcattctttagtatataagttggatttttcagctgcagaatttctgcttgattcttttttttttattattatactttaagttttagggtacatgtgcacaatgtgcaggttagttacatgtgtatacatgcttgattcttttaggttattttaatctctttattacaattatctggtagcatttgaattccttctctgcattatgttgaattttgttgagcttcttcagaaaagctattttgaattctctgtctgaaaggtcacatatctctgtcagtcatggtttggtcactggtgccttatttagtttgatttttgagttcatgtgttcctggatggtcttgatacttgtggattgttggtgtttgggcattgaggagttagatattcatcgtagtcttcacagtcttggctggtttgtatctgtccttcttaggaaggttttccaaatactcaaagggaattaattgttgtgatctaagtctttgttcactgcagccatatctgcaataggaggcactccaagaccagtcatgttgtgactcttgcagactcttagagttaaccatctttgttttcttggataagatcaggaagaattctctggatttccaggcagagacttttgtttctttcccttactttccttcaaacagagtctctctcttcatgctgaactccatgaagctggggagggggtgacacaagcatcgccatggccatcaccattgggactgtgctaggtcatacctgaagacagttcagcactgggtttcacctaaagcccacagtgaccactgccttgctactgctgatgttcattcaaggcccaagtgctgtacaatttacagctgcttattccagccagcctattgtccttcccttcagaccagtgagcttctcccaagcccaagcaggtctgtaaatgccatctggaatccaaggcctggaatgtggaaacttaggaatctacttggcgctctgttctgcaactgagctgacacccaaactctaagacaaagtccttgtcactcttccctcttctttcctcaaataggagtctcttctcatagccaccacagtaggaatgtgctgtgtcacacctgaagccagcatggtgctgggtcttacccaaggttcacagcgcatactgcctgcctaccactgacgtttattcaaggcccaggggctcttggtcagaagatgataaatcctgccaggagtgagtacttcccttcaaggcagtgtgctccattctggcccatggtgtgtccagaaatgtctgggagctaggctccaaaatgggggcttaggactctacctgatgctctattctactgtggttgagctattatctaagttccaagacaaagtcttcttgctctcccctctcctctcctcaggtggaaggaaggaatctctctccgagctgtgagctacactgcctggggttgaggaaagagtaacacagcactcccttgactgcctagctggtctctcactgggttgcatgtactccaagtccactggctctgaatccagcatagcaccaggactgcagtcctagtggcctagactaccttcaggtttatttagaatgccagagaactttagcccacagtggtgggactagccaaaatttagattctgactgctagggtggatgattcccctctggctaggctggtctaaatgcttcctccatggacgccacctgaattctgccctctattgctttccttgtgatagggttgcactgaactctaatgcaaagtcccaagatcactgtgctctcctcccgcaagcatatacagattatctctctgggccaagaggctcctgctgggggatcagggagtggtggtgtagataatgcaacactgtctttcataccctctttagtgcctctttccttgatatgatgttaaaactaggtactctgctcacctcatttttgattcttataaaggagctttcttatgtggatagttattcagtttgttttttattctcgggaggatgatcactggagggttctatttgactgtcttgctctgccttctttcaagctgattctttctctcatgtctgctatctgtgacttgggggctcctttgtgaggcctctagctgcaactcccataccaggctgggtgttttccctggctgcccatccataccagccagcggtcttctatactctattgaatgcaggctctggctgtaaagtcgcctagcatctttaatgatattctcttggtcaacactttaatagtctgaggttgagtttctttcttgtagagttcatctttggaccacaagagacccacaggcatccttagttataatatctttcactgtatttgttttctcaggctgccataacaaactaccataaactgaatggcttaactaacagaaatttattttctcaatgcttcttgaaactagaaatccatgattagggcattggaagttttacttttaatggggcctctctctttggcatgcagatggctgccttcttactgtgccctcacatagttgtccccaggtctgtattgactgtgtcctaatctttcctttttataaggacaccagtcagattagattagagcccacccatgagaccttattttaccttagttacacccctctaaaggctctatgttcaaatacaattcttattctgaggtactgaggattaagacttcaatttatgaatttaggggaacagtattcaacctatatcacccacattatgacagaatgtattcccagaaacagcacaacccaccttggctcctctgccagagtgactcaccttcatcactcttactacctagatgtcatgggaaggaatctgactccagatcaccaagtcctccaaactcccaagagagacagctgaaatgcttccagtgatacccataaagtccttcttactaagctttaggtggaagaaataatgttctgtcttgctatgggagaggaaatgggactagcagttctcattccaaaaatcctccttataaaattctctcaccccactctcatattctaagcctgtgattttcaaccttagggatgccattgggattgagcaccaatgctcagaccctcagaagtacaactgtggtctggatcaaaagccttacattcctggaagcttgctagcaatgaagactctcaggtccagcatgagacctattgaatcaggttctacatttaacaagatcctcaagtgatatgtgtgcccattaaaatttgagaagtttgctgttatagactagtggttcctaaattttagtggacatcataatcatctggacagctttttaaaacacagaatgttaggccctatcttcagagttttcaattcagtacatctaggatggaccctgataatttgcacttctagtcaaatttcatggtgatgctgatgctactagtttgggaatcactctttgaaaccaccatgtgtagatactacactgtccaatactgcagccactatgcacatgttatagttatttgaaatgtgctttgcattgagatgtgctataagtaaaaaatatgcatcagatttcaaaaagacagtatgacaaggcagcatatcacatttatgattttttattgattatatgctgaaaggctagtatcttaatattgttgagttaaataaaacatattaaaattagttttactttttaatttttataatctgaatactagaaaatataaaattatatatatggttcacattatatttctgttgattggcaccgttcatcttgatctccatttggctcaggggtccctgaagtgtgtctaaagctgattcttgatcatttaccttgaaaatttattatttgctcttgtatcttactttaatatgctatatctgacaaatcttggcacctcagtgaaaattccagttttaacattccaggttacatgtataatattttggataatcttcatcaaatccataaataagacattattatctgcatttctccaaatgagaaacctaaatgaaaataacttacctaactttctctaactagcaagtaagatgcaaatatagatttgtctgccttccaagtccatgcttttccagttaaccatgcagccttcactctagcacagagatatgtggatgctcgatcttgtgaattttttgaaaactgtctgcttaagtatgtataactgcacctttgtaggagtttcatataaaagtaaatatatctagcagcagcttagtgtttaacaagacaatcatttcttcttaatggaggaatttaactagattgcaaatgttaccatctttaaggatggtgtaatcaagtaattgtgtttttgcatgtttttgtttctttgtttgttgtttacttagactcttgccaactcagactgttctcagacctggggcagcactggctatgttatattattattatatttataataattatttaatgtaagtatattcattctgtgtaactggatgctaactttgactctttcctctttgtttgtgccagacttctgaatagcccttttttctctgactttatgagtggtccagacacaagtaatagtgcagtgcaatagggagtatcaatgcaaaaattcttgaattctacattccaagttagctctccagagcaaattgactcaggccaaatacattttctctatgacactttctataacaaggtaggcagtatatttcctaagatattagattgtttctttttaaacttctaattaaatcacttagaaaaccatattgcagttgtccattgtatgtcaatatccctgattcaatggtaatcttgaggacacagattgtatattttttttaatctccagagacatgtaggcatgcaataaatggtctgccttggacttaccttacactaaaacccttgacactagaagtgggtgatttaaaaagaaacaaataaaaagtaaaaaataaataactcagagaaactctttaccttcattcatagttttcatttgactgttcaagaggaatatctaaggtcttatgatagtaaaattttcttattctttagaaagtctgactgtatctattttagaagccctatagtctatagtagtttttgataactatatgaattaatggatgaatgaatttccaaaaaattattgaaaactggatttttaaattaacatgagagaccagtaaacatttgtgtttgtttaaccaaaaaaaaaaaaaaattctattatctttgtcattttatgaaggacattctaaaaactaaagtatagaaaagatataatctcagaataaaaatcaaattttgaaaacataaatttatttttattttaaaattcaaggcactaccctatcacattccatggactctagttgttagttgtctgtggactattaggacagaaccgcttgtttgagatgcaaggtcagagtgtaaagggtgtgaagggcgatgggagagtctcatgattccctctcctttgtgcggcctctgttcactacacacagcaggagtgctttcgtagtcagctcacctatttgagctagttacccttttatctttggcttagtaaaactgccattatagaaagaggaaaaagccacaaacatttaagctgtaaaacgttagctcctcctttaatggaaagatgtgaaccaacatactttgtatatagggcaaggatcagagatactggaagattttaacaggcagagtaaccatagactttttgaaaggagaaaagtgttctataaccaccatgggtcacctgttgatcattcctcattagtaaagtcattatgtacttgccaagattaactgaatggaagcagaagtaaattcagatgtagataataccattacaggaggatatactttcttctaataggaaccaataaactctcatagtctttcaaaatgattcgtcacatgcctcaaatatttgcacaaaactggaaacataatttgcaactaattatttctctggatggatcctccatttataaaatgctagcaggagatctgcaaattctggcaaacataaaggctttgatggccatgaactacattaatataatattcaaagcaacaaagccaagacagaatgactaattatctaaatttcttctgcttttctctagttctatcccaataattgttttccaacatgatttacttcctctcatgcctcactgtatttattctcatacttccaacctcttcaaagcaagatggagctagtgatgactgatgatttgttacttttaacaattatgaaatttatttcctatcccacagcacaaaaaataccttgtctatttccctgcttttgctgtttagttttttatccagagaagcaaaactgaatatcctcccaaagtgcttcatgctcctgccaacacagaaaagttaatacagtttttaggtctaaaaattaaaaattaaaaacagtcttctctatctaacacactgggatctggtaaaaataaactgtaggaatcctagtgcactgagaaatgtcagcactctttcactttgccttctcttgtagtgggctttgttctctgttcctgacctcgtgcaatgctgtcctttgtttggcgtggcgcctagtttaccttttacttgatatagcttctctagcaatcacctttgattcaccagagatataaatctgcatttgtccttatcatggcctatttctagatctttgtgtatcttctttcctattcccaaacctagtcctggaccttgggacctcatcccaggcctcttccatcctacaaaagaagagtaagctcagagctgaacaaagttgaacaaagctaaactatttgccaaataaagttgttttgttttgttttgttttgttttaacagtacctcatttccaagtaaatcaatgtttgaagtaacagtgataatttgagataacttgagtcatttctttctttggagcctgttattcaaaattctctatcaaatagctctatgtaatatagtctgattttgttctgcctttcccataaggatggctacttacttgtccctcaactacttgattattacaattgcatgaaattttattccttactaagctctcttcatcaaacaaccaagcataccctcaccacaacatccacatgacctcagctatttctgagtgaatactgtagagcttgatttgtacagtatttatattattacaccattgtgaggaaaattgttaaaaccaagatttgtctcctgaactggactccaagtaccagaaagaaaataactatgtccctttgtctccagatgggttaaaaacccagcacatttctggatccttcctgataggaacataataaacattgaagtctggctttgtaaagaatcattagtctttctttgtaaagaatcattagtctctcttttcatatttacattttattatgagaacatatttctttttccccaggaacttaaagtactttaatttcttttgtaatttctttaagtataggcagggcaagataaaaacactttttttttaaacaacactagttaaataggcattcctttttccagtttttaatttttaggaatagataatgatacatatatgtgaggtacatttgatattttgatacaagcatacaatgtgtaacaaataagcctgggtaattgggatatccatcacccaaagcatttatcatttatttgggttgggaacattccaagtcttctcttctagctactttgaaagagataataaattattcttaacaatagttgtcttattgtgctactgaatgctggatcttattcgttgtaactgtatttttggacccattaaccaaaccttcttaatcccctcctcctcccttttcttcccagcctctggtaaccattgttctactctctacatccataaaatcatccctcctccttccttttcttctcagcctctaataaccattattctactctctacatccataaaataattttctttagctcccatttaagaatgagaacatgcgatatttgtccttgtatgcctggcttatgtcatttaacataatgtcctccagttccatccatgttcttattagtttattaaacaaaatttgtttgtagcctaatgagtaagaaaacactaaaacacattttaccaccaagaaaaataaaaacgaaaaggagctgtctatatcatgaaagtgtggattcacatacaaataaatgaagtatgtagtaaaaaaagtcactaagggaagatcagaattttattttctctattgaaaatgtggagacttggtttctgagcattatcatctgacttgtttgtcagcaagagagagatgtgctgctctattttgcatataatgacacttgatcagttgatatatcattgtgaaaaaggcaaagggcatcatgcattcactgacgtatatacagcatcaacaggtgttaataacaactattgcaaatgcttcatagaataacaaaaggagcatagatcagacaaggagtgtagatggtctgcaactgctcttttgagaaggattatgtctaacacaaagaattatttcattaccacttccagtactcttgaaaaacaacaacaaaagaatgtgaggtttagagactgattgattaaaccactctgaaaatgtgatttttaaaactgcagaagaggggaatgacataagatgaagaagagtatctctatagggagaaggaaggttaatatatgagtaagactaaaggaaacttggagaagtgagagaagaaccttttaaaacgaattcatgcaagaaggatttatataacttgctgtctatgtaaacatggctagccctcccattaaatcagtgggttccaaccttaaatgtatcttaaaatatccaggggaagatttgcaaaatactgatgcccagatcacaccctcagatattctgattcaattaaaatttcccagggttttatttattattattattattattatttgagacggagtctcactctgtcactatgctggagtgcagtggcatgatctcggctcactgcaacctctgcctcccgggttcaagggattctcctgcctcagcctcccaagtagctaggacttaattttttgtattttagtagagacggggtttcaccatgttggccaggatggtcttgatctcctgacctcgtgatctgcccaccttggcttcccaaagtgctgggattattaccagagttttaaattatctccagggttggcaaccatttcaatatgtaatttcaaaggagattttgttttgttcatattaggagagactagtcctcagtctttattcctataagataacaaaacactgagccacgttggcatctttgcatcatagtgcttgtccaacagagacacaaaacaactataccattcttctaaagctaatctcctatttctctcaaggaatagcctgaggtgtacttctggttgctctaaccaaaggcctcagaatgctcaggcttagagtttctacaaaagaatgataagtaatgcaactcctcttctccccagatgattttagaatataatcatcaccatagtcagatacctccattggccattttcccaatgatacctaatgacattcagagatagcttataattttgctcttttatgacaagaaaccaaagtagccctgtcatgtaccattataaaaaactactaattaatgacatggcatcatgtatattttcagtctgaagcccaaatgaatcactacgaaatctaaaattgaccttccctcattctttctcatattttcctctcccctaatcttccctctgaggaatgatagtgttatttatatcatctttctatctatttatctacacacctacctacctattatttatcccttctatctataatttttttcttatgaagacaacaaagttcataatagcaaatttggaaaattcagaaaaacaaaaagaatataaatcacctattgtggttctagccaatgataactaatattacttagttgtccatcttgttagtaatttaaaaatattaggatgatactatgtatataattttatatcatatacttttcatgtaacaaatatataaaaatatttttcaatgtaataaaagcttgatgcttataagactatctactgtagaaatatagtatacttcttgggcacatcatgggaagcattagatttaattttaattacataattattatgaattattttaggtctttgggtattttttaaaataagtggattgtatccttttccaaatttagttttagaaacacttgtacagatacacacacatactttctctctctctggatatacagataaatagatatccatcactgttaaactctttttgcagattatctcatttaatcctccaccaatcctttgagttaagcagttaagcattattatttttacagagtaaaaaataaaggttcagatcaaataaatttctaaagatcaggttcctctgacgttaatgttcaaaacattttcaccactctaccatattgtatcccagatattacagctaaggaaatttatcttgattttctccaacagtttcatataaatattttgaagcacagagtaaaggtgaagaattttctagtgagagtgagcactcctatccttaatatctatattttgccattaacacttttactgtatgagttttatcacatacctttgtttctactcatcttgatatccatccatttatctatattatttttatgtgtatcagtccttaatttttgagccctattataccactgcctaaactaagcaatggctatgataaatatattttggctgttttagttttgtttcttttttaacattttgttctttggtcataggtaggaatgatcaaacccaaataatattaaagatctagaaaatcacaaagttattttgcatcagtatcaccagtcattgatcttctaggaatagaaaaattaagaaatactatactgggtgaagtcaaaaatctgcttaaaaacactggggttgaaaatgtagtcattctactacttttaggtacagaggaaacaattttttgaagctatttaacactgatttgattttcctcatgattttagtcagatcccagaaggcagtgccactgctagtcctcatgatgcttttatgtatgtttgaaaaagtatccctgcctcaagatattgatttccctctgtcggaaaattgtcattatgaaggtacaagcctgcaatgtgaacatagcccgtcaggttgtggttcctgtgtagtacacaaccactgctgctgacttcagagatcctccgggaggttcctatagtggattcagtggatgatgtatatgccctgctgggcttgactctgtgacgctctggaggggatccttcccgtgagcctgctgcttaggtacctggctttgccccagcagctcctctggtgagcttctgagctgtgttcttcaaccagtttctcagaaaatccaggaatctaacctacaacatgagaatgaacaatggctcaaggggctactctctgcctgtggggtagccctcctctgctggagcagtcatagagcagtaatagagcagtaacactgccacttcagtaaagctgttttcttctaccctaccactaacttgtccttcagttctttcctgtgcaaagccaagaaaaaaacaaagtgggtcaatgaagctacatgccagagccttgtacctcaacatttcacattatgaggcttacatatgatatagctactaccatgaggtctttcattcaatggcctgaaacatagagctgaacacacagaatctcttgagataattttctaaaatgaggcaaaaaattacaatattggcatttctctttctctacgtttatttccctcctttgctgtactcttccacaattctcaggtatcataaagccttggctattcttttacttcttctatatcagctctttcttctttctgagtctggttgcagattaaacctgaggatgacagtgatgaggaaaagtttaatgtgagaattagccattgacggcttaaatggtgctaaagaatcttagaaaatcttcagtctctctctcttccaaaagtgtggtttaaggcagattatgttgctttaaagtcctattttgcataccaaaattaaatattaactctcctttttctctttacattgcttgtcaatttctcctacctttctttataccttggactaaagagaaagtcatgtgcttgtttaaatttccatgcaggtttaaataagctacccatctagattacattattatggttgcttaacaaatcactgtgccacaaatttagtggcatacaagaacacccagttattatctcatagttctatagaccaaaaatcagtgtgggttcaactgggttttctactcaggatgtcataagatatcatctgggctggccttaagcgggggctatggttaaaaaatctactttcaagctcattttagagaaaatgacttttaaatggctggtgtgattagattacactcagtgggataatctgccttttcattaactcaaagtcaactgattagtaactttaagtacatctacaaaatctttttgttacataaagtaatataatcaaggtgtgatatctcattatattcacagtcccagatattaggatacagaatcttggtggaccacttttagaattctgcctaaaataatttcttattttaaatcagaaagctaactcttgggatttctgtaactctttgtgtatagtaatcaaaatagtccttctcagagttcacagttacctgtgaggagattattctagtgataaaattgaatttatgcttttttaacttttattttaaaaataagaattttttatttgttgtatttaattatgagtgatattacaaagatcacatattttattaaaagaaaaaagcagcacaacataagaaaatggccaaactacttataaaatactagcttttaaatatttacttttttggtattctttatatatatgctttatccattatgaaatctggcatataattctaatgcatttaaaatatagaaaacatactgattttatttctttggaatattgttatatccattaggaagaaggtatgaaagaaataacactatattttgtgtaatttgtttattcattattccaaacatcacttggaccaccttcttctgagaatgttgaagtctagaaaatttaagccagattatgttgacgttttaccaaatccttgaggagcagaataatgttttgcaaagtgaggataagactacattgacatttgatgacaaaaaacttatgagaaataaaaaagtaaatttagaactagtgaaataaataccttgtttattcactacttggcttacataatttaatgaacagaaaaaaggtcaatgacccaaaaagaatagttcctatctgcactgaacaaatgctagaattatcctcttccaattactttctacaaagcttactatccaacgtcccaagcagtgctaacgaacaaagaaaccagaattaagcattcgtttatttaaaatatgtgaaaattcatgtacatgccaaaacatctatgtattgtatagacataactacaggatctcactagaggattttgagaaaagcaatgatattattggattaaggctctgctatatttatttaaaatatttatttgatttattcttattataaaactggtcagtgtgtattctgaacaataggaaaaaagatagaaaatttgaaagaaacaagtgattatacaggctctctcccaaaatattttactgtgactataatattagatgtgtttattctagactttctaagcaggtttttcagttttgatcatatatgtataggctgatgtattcacttaatattgtaacaagtatttttctatgttattacaatctcttcataaaatcagtttttccttattgattcttcatcttacatacattttataataaatattatctcacacttaattttctctgtgcttgagtgaatgtctttgtatctgagtgatttaattctttcatcatatgctaactcttcttcattaattttttttattcagctgcctcttgcctaatgctttcagttctagaaatcattgagatatgctatggcacaggttgtttatgtaaaattgagtgacaatgtttttataaaatagttttcccatttatttttgcaaaagctcttttgtactcattaaacatgcaaagatgatggatatgcatttatttatgtacctttgacagattgaaacatgcaagtgacagtgtttttcagctatttcatgacacaatcaatttgattccagaaaacaaatgccaaaaactgatgaattcttagcgaaaatttaggttagtgatttttaactttttcactgtagcctttggctacttaagtcactaattgcttcaacaaagataatactattatatatattcaggttatatccaactcaagtttacacttcagtagtctttcataaaagctatcctatctttaataccatcttttcggaataatgattctgtttagagattttccctactttgttggttcatcatagatttgatgctacagtttctcaacaacatacattaaattggagtttgccttcttttaatcacatttatttattttttatcttattcattaatctaattgggtcatgtatgagaagtttataaaaacaacttatcctcttcatcaatttcctctggattcattttgcatagagaggaaatcaaccataaaaattaattccagagtatataccagcttccggaattggagttgcatcaacacacacataagaaacatcagatggtctgggctagattgtttgattttgttgttatgtcattggctttgttttagttcctggaaaaaaatgaataagggatgactactcctttaagagcttcagattttcagaggtccttgcatatcgcctgcctatctattgccatggttctgttctccctgtgcacatcactgataagcaggagcagactggatgagagagggatagaggtgttgtaggaggaaggctctttgatttgcaagtagaaaaatagataggtcaaggatgagagtaagttggtagaaagttgaacctatatcagaaaaccaaaaacgtgtaagtagctatgaaacttaagtgataaacaatatatatgatattagcagagcatataatagatatacttactaattgacaagattttaattttatcaaattatatttcaaggacatatctaggaaacccttaggtgtagaaattccaacaaaaatgatgtatggtattatttcactatcataaaagtatgcatctgactcaagattggttttgtacaaatcaggcacattgtacatttcttcccctaggccatcctttccctaaatcccaagcattctcacctccagttggactgaaggtgtcaattcctggctagagtctggttttatgacttatgttatagaacataactcctcactctttaagggggagatgtgcttcgtgacctccttccaaagagtgctgtatggaaatgtgggaaagagtaacttcacagtagagaaacctgaaaaacaccacccgatcaaagtgagaaagttgagcattagtagtgataaattatgtctataatatatgcctttgttatgttgttatgagaatttttacctctgttgtcctcctccccaaactttataaccctagcttaatcatgagaaaaacatgagacaattctcagttgaatgacattctgcaaaatacctgaccaatactcaaagctgtgaaggtcattaaaaacaaggcaagtctgagaaattgtcagaccttagaggatctaagaagccatggcagctaaacatagtgtggcattgtagatgggatcctggaacaaaaacagaaattaaataaaatctaaggaaagctgcacgaagtatggacttcagtagataatttgtatatcaatattgattcattaatttcattgcaaatgtactctactaatataatattaaaaataggagataaaggaaaatttctctaactgtagattgtaggcattttaaaagacagtgccttgcacttcctttctctattttctgcatagaaatagtgaccctatgttatatatttctgcctaaaataacttgtaccatacaaagttaaatgtttaattctttcagaagaacgttgcattaatttctacccaactactccattgttcttctcttatgttcttgtttaccggctcttgattgcaattcttccttatattcagtgctgttggagtatccctctgacacatcttaatgaacagatttatggttgtctatctttctcaagaggttatcagcttttaactttgtctttaccatgtgtacttgaatcttgaatcattgtggttttggatgataactctgaatgcaagattctgaaataatacagtttaaaccaaacaatttaaattggcaagtgtttaaactctgtgctaaagagtgattatcacatgctgtttactttaaagctatatagagctttgtcttatacatgaattaaagcatttataaaacaaaataaattagaaaacagtgaatcagaagtacttgactaaaagcagcaaagtagcctcagaaggaatctgaacaaacttgacctagtgaggtataaagtacaaagatggttgaaattgagccaggagtgaagccctacctaccaggacatttaggttggaagatgtccatatctggagtttccttccatcagactcaacagatggacacggtaaaagttatgtgcgcatggtgtgtatgagagtatgtgtatgtgtgtgtgtataaactggacatgctgtagcatgtaaaaattgaattacttcttagaaatatttgcataatgcttttaaggcaatatgtttaactgatacacacttggaatggtgaaagtgtgaattagggacactgttccaaactatgaataaagtggtggtttcacccagcactagatccagatttgggagacaccttgagaattatctaatcagtcattaagttaacatcttttttttagagtttgttgtcatttatttaaagtggttacctcattttgtagttatcattacatccagacaataagggatgtggttgaatttcaaaagttttctaacttaacaagtcttattttgttagattatcctcacttaggtcttcatataaatttgtaactatttcttctgaagacatggagttttatttaaactactgtatttttgttttatcatagaacaacagaattcttattacagaagttgaaaatttttaatcactattggatattaactgaagttctgtttctaatcataatgatacatttaagtgcctacatgtggcatacatttctagattctttgagtaaaacatttgtatgacatcaacatctgtattgccatcaggagtgtcatttctactggcaggggcagccacctggaaacctgaaggaatcatctacccagaaaaagtgatagggcatatctgtggtactaatttttgctttatttctattgttcacagattggcttatacagccatttattcatttagaagttttctctgctaaggcaccttcctctcctatcgcaccactcaaaatttggcccatctttcggaactcagttgaaatgccattttgccattaagttgattgaaatcctctcaaatatttatgatctatcccttttcagaatgctagtaacttttttactcttttgacattctcttatgttgtgtcttgaatgacagttgttcctgtacagatcttagcactcttattagcctaccacgcctggaaagggctgtctgcccctttgtcatccttggcctcatctgacacacgacactatgccctccatgtgatgtcactgcctgtcaccttatgtttctatcctgcgttgtatactcacgttcttccatctcacttccctgctgtctcctgtctttctttagaactacattttcctctggtcctccttctttgagcatgtattatttttaatatgctccccatccatataatcctggctagcctctactcacttcttaaccacaacgctcatcactttaagggaagatatcttaaactgagagggtttggaataaagtggggaagtgggatttgtcaaacagaatgaaagcatgcatgcaggtgacagtcctgaatgtgcataaatgacattggaagaaagcagaaagacactggatggaaatgtgcaaatgaaagaagattccatggattgggagagcagagaagtgagaaatcatccttaagtgatgttcaagaagaacagaggagatgatattatctccaaatttacctgatcataagaagtatcttaccaacgtgttaagatgtagattcctgagacccgccacagtctagcaaattataatcccttgagacagcctgcaaatctgattttaagaagcttctcagtgatccctatgatatgaattttgagaaaacctggagaaattgatggtaatgtcacagaaacataaaatgttaagagaactggggatggagtagggataggaggtgggacaatttcttcctcttacaatacgggataattgggccaaaagcaggggtgcagggcagagtcctaatgcacaaagtgctttggcctccttaatgagcctgcattaactctgccagctgaaaatatttctcagtaaaatagggcaaaaggcttttacaataagattactaagattttgttaagtgtgtttgaccattaagggaaaaatgtgaaaagttgtgagatattttctactcctgaaacaatcatttcctattagcattttagtcataagtttacttcactagctcttatgttcttagtttcttcaacctactgcagaagaactgaaaacattattagagtaacatgatatgatgaaatcatgagatttcaatcagttttacaacagagctgaaaggtgatgttttagagactgtcaaattattttcagagactcacactagactatttcttactgaaaatatttaaatacagcagaatttaactcaaagttctataaaaagtacattttataatattggtattaaaatgtcttatatcagtactatataaaattgctgtttttgtttcagtctgaagactagtatagttagtgaggatgttaaaacttgacaagaattacataattcttacagatttaaattgatttctttcaactggacttatgcactggacttttcaaagagaaaagtatgaacaagggcaaattcatatttaaagggaacttttcattaaacactttgtagtctactctgtcatttttcctccaatgaggaattctatctttcgttcagtgcacacaaaaattaattgtaatcagcatttttgttgcctaatgtctcatgtagttaaattttttcttaaataaaaaataaatagtaatttgaaatttaaaatagcattttatggagaacagagtattaatgagccagcatgtaaaaatattttttcattttacaagaagcttatttaatttttaatattcaattccaaaaaatacaaagggataagcagaagcaaagtttggctgtgtgtattttataagtcacttactaaataaaacatttatttccagatattttctttagccacatattaatattcaacctagcctagtccctttgaaaattgttaacaactagattccttatttcatgtcctagtgatatgtaacagtaaaatgtgatttttactcaatgcataagtgagagatcctttgtttatttaatattttcatcatttccttgagtaaaaatgataaatatattatttaccaagaaaagataaaaagttctagctgactcttggcatgacatagactgtgtgatacaatccagttgtctcatgaggaatcaaagaagcctagagatctgttacagttgttactaaatatcctttaactggttctgtcctaattcaaagtattttcatgtactgcatgacacaaacaaacaaggtagagaatttttctgaatgtaatacaaaagtcagggtgtctcatttgaggaaagatgcactgttagcatttattttatctttaagcaaggtaataatttataattatgactgattcacatataatctgcagcaataacaaatcattaagcaatgaattgtgaaaggtaatgtcctagtaatttggttatttcagtacatcaggtgtttacttattcattttaactgtttcccaaattttgatatagttgtcaaataaaaccaaatgattgtaaggtatacaaggtgatgatttgatatacatatatttcgtgaattaatcaaattagtttacatgttttgcctcactgtgctgtatattagatcccctgaacatatttatcttccaactgaaagtttgtactctttgaccatctccctttttttcctgctcactgcctctgatagccaccattctactgtctgtttcaatgagtataacgtgtttagattccacatttaagtgagatcatgcagtatttgtctttctctgtatgacttatttcacttaggacagtgccttcacatttcactcatgttgttgcaaatggcaagatttctttcttttttatggcatcatatatatgacatttatatatatagagagatatcatatatgatatatattatatgccacaatatatattcatatatagaataatatatctaatataatatatgtatagtgatccaaaagataggtccaaattttatataatcatataataaatgtacaatctataattatatataatgtatagtataatataatatataatattatatatattattcaggggtggggatggggttggaatgatgttggtcaaagatacacaatttcagatagcaggagtaagtttaagaactctattgtacaacatggtgactatattatattatacaatatatatattatattctagaaaatgccaagaaagtggatgtaaagtgttctcaccacaaaaggaaccatgggagataatgcacatgctaattagctatatttattcttactgaaaaaataactgtgaagtaacatatatgttagttagctatatttagtcatttcacaatgaatatattcttttttttcctttccttttcttttttttttaaaagctaaatgaaagattttattagtcttgggaaaaaagacagaaacacaataaaaacttctctagtatgaacatgtgcaagtttcacaatcatgctattacattttgcactggcagacagttcaaggcgtagttatctgtcagcctgtgtcagatagcttggtagccagcagcagtcttttgaaaacacaaccaataaaaataccagatctaagcccaaggctaaactgacacagaggtcttctgaaaccaaattatggtagaaaatatgaagatgaggctttgataattcaaagcaagactcaccattataaaactgtatgatgattagggctaaatagttactttcatttaaataaaaatattaatacactgttatgtcagataatcttatagtattgagaattgaaatgcctgtcatgtacatgatgaagatatatgtaatggaataaatttgtagggttttttgggcattttgaaagtgtattttgtattattattgtccttttcttatcacaataaatatattcttaaaagcatcatgttatacagaatacatacaattttgtcaattaaaaatttttaaattaaattaaatattttaaaacataaaaatcaaatgacccttagatgttgaaacaatgaatcataaatgcccaactcatttaatcaaaaccacttttttgtaatgtattatatatttagatatataaaatgtgtgagtaatattataacacatatatttttaacattgagatcaaaaactaaaacactgttaaactaataaaaagtacaaatacagtaatatatttaaatttaaagaacttttaagcaactattggatgaaagatttgtgagtacaatttatagatgggcactaatgtttgcatttagtgcttaatttagttaagctagaaataaaatatagatttattgatactcacattgaaaaatagttaaaaatttttgagaaattcacatacaaaacctaatcctttaaacctcatatattttcccacaataacatgcttgcatttttcttgcttttcttattattgaatattgactatgtttaggtcctgttttaagcagtttacatgcagtgtatgttgtctcatttatctataacaagccaattaaatagatagcaattttcatggaaatactgtctaaatgacaaaagttatgttatgaaaggtggcattcttttttataactactagagaagggggtggaatgtagtcattttatctactatcatgttatttacctctaattgacaattttcacagatttaaaagcccttatatggtatttaaggacttaaatcagctatagtcttcttatctcatgttgaatagtatcttcaagctggctctataaataataagtgaatggatgagaaaaaaaggaagtgaaccaaatatgttaatggaaaaaatgttaacaaaaaatagaggattaatgaattcaacaactcttaaaaatcaactgttcaaactactttctatgtaagtacaatttgagtctattgtgatagagaagtaaactcaattcttgaatgtgatttcagtataactctgaaggagtctgcaatggtgattaaaggcagttattgcacaaggttaccaattacatttgttttcacacagctatatactttttttttttttcaaaatccttaccaattttcagaggaaagggttacggtaagctaatgtaccactagatccctttcagtttcattttcagagtgatagtaattgtttcatatgtgggaaggttttctgagactataatagtacatgcgtgattttgtgtgatttattcagaggctcatcagcttctttaggaggcagcaatgtaacagttctccagaggagacagtgccatagtgaaatatgggactaaggcactgcagatttagcccagacccttgactctgaaaagtcagaataatacatttagttgttttgctggacattgtgtaaatattttggaagagtgtgctttattttgctaagttcagaatgcacagtgggataatgtgtgatctggaacttgcccaatgtatgtaagagctgaggcacatcaacagagaggagatattggcaaaccttttacttgcagttcctagaaactgaagagctatgtaaccagaatatagaattactttcaatcataatattttagtatgagaatgagtcatttagcatcaactctttcaatttattgatgaagaaactaaggctcaaagaaattaagtgacttgctggaaattattactaaatggatgccagaatcagaatgaaatcaaaatgttcagattcaaagccaagtgctcttctgagtgcctcgtgctgcctcttacattagactacttctgacccacagattacattcaatttttcgacttataaatagtgttctcttttcatagccacaacatgaatcatacaggtgaaaacccatgcctttatggtaccacttcctttattatgtcaattatgtttaaaagtggtaaaatctagcctgtttgtgagtgccatagtttcaggaagagtagttttgtataggcattcttaaaacaaactttcatgcataattgtttatttaaattaaaaagtatgtaacaaaaagagaggagttttgcagtataatgtgaaaatgtgatcctgaatgagcaaaaaaaaaaaaaaaaaagggaaattacagcaggtcagattttatttttattgtgggcaaggactggtggacttggcactggtaatatctggttagagattttaaaatgtattcaaaaaagcaaatcaatgaaaattaaacaatctataaataatacttagccatcataattaaaacagctaccattataagacagacctatataagaaagggtgattttttttttgtttcccatctgactttggctatatcttttcagaaaatactttgtaaactttggaatctcatgaataatttagttattcatataaagtatgatcataaaaattaagaggatgcatatagaacagttgaattacttacacagggaatgtgactttattttatgaagctgtgggtcttgttgatttaaatagtttctggggttttttttgttcctggttgaaagattatgttgtattatgttaggctataattgtgttattcataggaatgaattgtataattatagtgtggtgacggcatgcaggtaaccatgactactactgttcttccatcaatttttgcttctttatgcagtggtgaatatttttagtggttctattatttgctcttttaaaacttagaaccaaaattataagtcatctctattaaaaaaaagtcttgcataattttacagggtcctccttttagatacttaggtatggaatatcaaaaaggaagctcatggaaagagatttctaatttaaacaaaaatgtgtatcagtggggccaccatcttcatttttctgactgtaatatttgcatttctggacatttttttctagccttcttctctgtgtaatcattaattcttggctatattttgtgtatcagatttctgaaaacttcctcttctgtttcattcacacaaacactattattgtttaggccttcaccactcatacttggattattaaagtaccattctgagtggccttcattttattcttaacagtatctatcctgggcttcatcttttcttactaatccttttggcttgactgcattctaaagtaatataaaactcacaaaaactcatcacaaaactgttccaaagctaaacatttattctttcagagactgtagatctcaaagtgaatataaaaatatttattctgtaaggagcattattttctttacagacactccaactgatgggttacaaggttacaaagcactgagtgtcagaagccttggaggctttttaggctacatagcagtgtatatcacagagaacatcacagattttgttgttgttgttgttccttttatagttatgaagtctactgcaagcagaatcacaaggtcaaggtcaaaggttatagaacatttttaatactactgtgtatgtagatggaaatacaaataagttatagctgctaattttgatgcaccaattttttattctctggtaacataaattacttgagataataaaattattcattattgaaacttcatattgaggtaaaattattctgttattgcagttgtagaatgttcccttcattacatgaaaactactcttacaaatcctagatccacttattgactctgatagcagagttatgacaaaatctgataatcaatagttatagcaaatagctcagtctttacttgcatatctcaaaaagcagaagtgtttccaaacacaacactaataaaattctctttccttctcacctctgtcattacattgcagaccttccacactccttagaaacttattctttcaccagctctaagtgatttttctccttttctacaccagattctttattatgtaaacataagtggcagttctctacaagacataattagtctttaatttacagaagaaaggagaagatgggactagatactctggctggatggaaaaggtgtggatatctatgaacaatctccagttaattcttttcaatcacaaaaataatggtttttgtaattagatttttgaaaacaatttttatgggaatatatatatcatgcaacagtatagctgactgtgctggaatttggtaacaaaacctttacatttaaacaggtctcaaagcaagggcattttttttctaggtaaaataatggcttttattttcactacaaaatcctttttaatctctcagattataatccagagacatctcaattgtcttcctccattaaaaaaatcttttagaccaatattttccctctgcttaattccatgtatttggaaggtaataacaatatcgtgcctcttatcatagatgggagaatttatcaatccatttttaaaacacctcatattttatctgttcacaattgtaaaggcattcagaagaatgtgcagtgacattatacaaaccagtcttgaaacctcatttatatcatgcattgtgaagaatgattatgttttgtttgtctgattttcaatcttgtatggagtaaaactttgaaaaatataacaaaaattagataaaataatagttattatatttatcatattaataatttaaagtatagcacaattgatgtggttagatgccatggccatattaaagtttttaaagctactttcaatgtcagtacatattcacttaagaggtaagacatagttctaataaatagttctctcaccagcaaacactgttaacagagacttcacaaggaggcatattttcaggagaggcttctccagactattcaactcacctgagctcctctgcaaatgtagattaatttttttttcttaactgatcacattattattttcttagggtgctaacaatgtcaccacaggccattgagcacttctttgtggactgacagaaggtgttccttcttcatgacagggtcaatactgcactgggcaggtggcttgaccagcagatgaagtgcgtgttggcctccatcgtcttccaactgtgtgcttctgggctgggacacgaccttcagcactatatgcagcagctgtcttacctggtccctctttctgatttcaatgcctaagtttcctttaattcattctcagcctccactgcagaggaaagcttggcagtctttgggcacaagaagttgcatataatggatgaggaatgacgttttaaaattagatttcataaagaatctagaggaggcatctcttactacctacgctaaatgagattccatctcttaattacattttacaaaacataagaggcattttacaaaatgtttacaaagtgtatcttctcgttaagctagtttatgtttctatttaatccagctcacaaggttagggtgagtataggattgggttttccgggttcaggaaacacttcaaaggaaatcatactttgaacatgttatctaaagttatccatgattttatatatatatatatatatatatatatatatatatatatgtcaacctaatataatacatataattatatataatataatatatctattataattatatataatatatatttatctattataattatatataatatatatttatatattataattatatatgattatatatatttataaatatatatatttttgtaaaaagctttgaagtatttataaaaagcagctgtatagaagcaaataattattcactgtcttatgttgacagcatggaacaaaaggcaaaatcatgactcatgaaactataaggtgaatatatgtcaaatcttttatttaactcattaattaataagagattcagtaaaatcttaggaccagctcaaaggaaacatttaaagaacataggcttccattaagtggaaataagtttgttaatatatgcaaaattagttaataacctataaagtaataaaatgtcagttttctagaaaaggaaaaccaattatatctcaatttatcagatgtaatttatttgcatttctatgaacaataattattctcatgacaatcagtcttgtgcaagttaacttctacttttacattagtctagataatagaaaatcggttaaagttattcatccctattgaattagataatccccagatagtctatcagacagcttctaccactttgttgaaatgatgcccagtaatttcatttgctgatttccaaatcttagacatttttcttgacacacccaaatatattgcatcagacaaccagtctctaaagttaaaaaaaaatcacagtttctatgtattttttcattacacaaaaaaccaaacagattcttgaagtcctactctgaatcatataaagttaatctgtgagcacccaaaaaaaacagactatcctcagtatgctcgccatttcactgagaatttcattgatgagccttgttttctccacagatactacatctgcccatgctactaagtctcagatcaattctgagaaagacaaagagctgtattgatctaacaaacacatattattgccacacatttcttaccaggtctttcctgatgcttataacattcccccaacactgtccctcaatcactcactgattccagcacagttcatgcagctggtggcagacttggttctctctcattagcttccaatatctcccactctccacattctcaccattatgagaataccttacccctacttaagaagaaatattgagaccatctggcatgatatcccgcctttattcccatctttcactcagagcactgctcatagaatcctaccaaaaaggaaaagctttcctttcactttcaagtagacccttacactctatctgctcccatctccttgaatgtagcccatgtttagcccctctgtcttaagtaactttcatttttcttttccagtgatgttttccttgttacccttgaacatgttcaggtttctctcatgctcgacatttttacctagattagctacccttctcactgtgatacagggtcatatacctgccagactcctggatcatgagtatcctaatttgctgcttccacaaggtacttgcccattttatcattaaatttctggatttgaggtccacatttgcttgacatgtgactaaaattctgttttcaaaggttatcctttggtctcagaattcttctgcaatttttgacattttgattttcacttttcttcttttatctataacacagcactttcttggttctctgacttctttatcactttcttaatctatttactaaaacatttatctgttatcctttattcttgatttctaatcattctcaatatgtgatccatagtcataatttcattgtttcaattattgaatcaaatatatgtatccactctcaatcttctcaatttcaatcacataattccatttgctcacaagataaatattttcttagggaaatttaatacctgtcaaattgaaaacactatatatcttgacaatggagcttctttcgtgtcaacctaattttaattgatgtgcaatggactgaatgtttatgtgtcccctcaagttcaaatttgaaatcttaacccccagagtgatggtattaggagaaggtggggcatttgaaaagtgatgagggcatgaaggcagagcttttatgagttagatcagtgcccttataaaagaggcctcaaagagatccctaatctcttccaccatgtgaggacacagggagaagatgctgtttatgaaccagaaagtgggacctcatcaaacaccaaatctactggcaacttcctcttggacttcccagcctccagaactgtgaactgtgagaaataaatgtctgttgttaataagccacagtgttatactattctatggtgttttgttatagaagctgaaatgaactaaggcagtgttaacacatctttccaaatcccatgggagagaagaatgtcttttaattccctatacacatttttactaaatctcattttccattatttcctcagctctaaatctatcaccaaattcttttattaagtttatatttactattttttatatctattattgtatatacatatgttatttcccatctagattataagccacctaaacaaaaggactgtttctcttatcttttcttggacctttggaacaattactgaataataaaagataataatactaataatacattgcgaagccttacctttttcaagtgacattaacatttatttttaaatttaatttcataactgacactcagagaagtcaaagaggcattgctataggattcacagcctataagggacagaaacggaaccaggaattgtttctaggatacttcttcattacagtattgattaagtggctggtcaacaaaatgatataaagtggggaaaaaagtaacccatatttacccgttaaagttgattgttactcattcttagtagagaggttctctctttctctctgtctcttttacttctggtatttaggtaacatgaaatttccttggagggttcctaaagcaagtaaaaatttagaaacttgagaagcttccatactaactgggtaacaacaatttgctcactgaaaatagtttcaataaaagcacttaatgggtttttttgcactactcagaaaggcaaatctttctgtattatttactttgttttcccacccaaaacaataaaagtagatatttttgatgtaaagagttacatgttgtaaagctctctcttttaagggctgcatttcttttctaccattataaagcaaacattattttgtgtttcaaaccagaatctaaggctgtggaaaagtcagataaaatttagtgtttcaaatgttatgttggaacatgtttctcctataaaatcctagagtttgattgctgtgttcctacacaggaaaagtccacaatgttctgttgtaaagagttaatttattattgggcaaaagtttttgattgactccaaataaaattatgtattagtccattctcatgctgctatgaagaaataccagagactgggtaatttgtaaagaaaagagattcaattgactcagagttctccatggctggggaggcctcaggaaacttacaatcatggcagaaggcacctcttcacatggtggcaggagggagaatgagtggagaatgagtgcaagcaggggaaatgtcagacacttatagaactatcagatcttgtgagactcacccattatcatgctaacagcatggggaaaacccttcccatgatccaattacctccacctggtcctgcccttgacacatgggaatcattacaattcaagatgaggtttgggtggggacacagagccaaaccatatcattctgcccctggcaccttccatatctcatgtcctcacatttcaaaacacaatggtgccctacaaacagtacccgaaagtcttaacttattccagcattaacccaaaagtccaggttaaatgtctcatctgagacaaggaagtcttttccacctatgaacctgtaaaatcaaaagcaagttagttgcttcctagatacaatagagatacaggcattgggtaaatacagctgttccaaatgggagcaattggctaaaataaagggctacagattccatgcaactccacaacccaatagggcagtcagtaaaccttaaagttccaaaatgatctcctttgacttcatgtctctcatgcaggtcacactgatgaaataagtgggctcctatggccttggggagctctgcccctatgtctttgagagtacagcccccctcgcagcttttatgggctggctttgactgtctgtagctttactaggtgcacagtgcaagctgttggtggatctattgttttgggatctggattatggtgggcctcttcgcacagctccactcagtagtgctccagtggggacactgtgggggatcaaaccctacattttccctctgcagtgccctagaagaggttctcaatgagggctctacccctgcagcaaacttctgactgaatatccaagcatttccgtacatcctctgaaagctaggcagtggctcccaaacctcaattcttgacttctgtgtactcacactttcaataacatgtttaagccaccgaagtttggggcttgcgctctctgaggcaatggcctgagctgtaccttgacccttctagccatggctgggacacaggacaccaagtcctaagactgcataaagctgaaaggccctgggccctggccacaaaaccattttttcctcctaatcatcagggcctgtgataggaggggctgccgtgaagacttctgccgtgccacagagacattttccccattgtcttggtgatcaacatttggcctctcatcactcatgcaaatttctgcagactgcttgaatttctcctcagaaaatggatttttcttttctattgcatcattaggctacaaattttccaaagttttatgctctgctttccttttaaacattccaagccatctcactcaagttcaaaattccataaatctctagtacaggggcaagaggccatcagtctttttgctaaagcataacaagggtgacctttgctccacttcccaagaagttcctcattgtcttcttgagaccacctcatcctgaacttcattgtccatatcactatcagcgttttggtcaaagccattcaacaagtctctaggaagttccaaactttcccatattttcttgtcttattctgagccctctaaactgttcaaacctctgcctgttacccagttctgaagtcacttccacatttttgggtatttttacagccaacgccccactactcccagtaccaattttctgtattaatctgttctcatgctgctatgaataaatacgcaagactgggtaatttataaagaaaagaggtttaattgattcacagttccttatggctgggtagccctcaggaaacttaacaatcatggcagaaggcacatcttcccaggatggcaggagagagaatgaatgcaagcaggggaaatgccagacacttataaaaccatcagatctcatgagactcactcatcatcatgatgacaccataggggaaccgcccccaagatccaattacctccacctggtcctgcccttgacacatggaaattattacaattcaaggtgagatttgggtagggacacagagccaaaccatatcaagttatttcaatattttgtcctgaaagtggtaagattttatcagagaaaggtaattttaaataagccatgctcctgcgagcagttaagagagaagaaacatatgagaattagaaagctagtactcactataaaaaaaaatctagttaatgaatatacttcacttaaaaatgagatattgaatctaccagcatgatctctaattttggcctgatggtggaaaggtaacttctatatacaatgagaatctatttatgtagaacataccttcctttctgcaattaagttgggatatctgagattctttatttttattttttaattgacacataataattgtgcatatttatggggcacatagtgatgttttgatacatgcaatgtatagtgattaaaacaggttaatattcacagcatctcaaacatttatcatttctttgtagggggaacattcaatattctctctttagctatttgaaattatatataattgataactctagtctagaccgttagaacgtagttctcctaactagctgtaattttgtgtcctttgacaaatctctccctttctcctcctttctcctaccctttccagcctttagtaatctctgttctactctttacttctatacaatcaactcttttaggttccacatatgaatgagaacatacaccgtttaactttctgttaccagcttattttatttaacaaccgcagggtcatttatgtcactgcgagtgacaggtttcattcctttttaagagttaagcacttgagttgactaagtatcttggcattatgaatactgctgcaataaatatgggggtgcagatatgtctttgatatttttattgccttcctttggataaatacttagtagtggaattgttgaatcatatggtagttctatttgtagttttttaggagcctctatactgttctttatagtggctataatagtttacattcccacccacagtgtataagagtttcctactctctgcaccctcaccaacattaattttttttctttttgataatagccattctaactgtggtcagatgatatctcactgtgattttgatttacgtttccctgatgattagtgattgaactttgtttttgttgtttttttagatggagtctcactctgttgcccaggctggagtgcagtggtgtggtgtgatgttggctcactgcaagctccgcctcctgggttcatgccattctcctgcctcagcctcccgagttgctgagactacaggcgcccgctgcgacgcctggctaattttttgtatttttagtagagacggggtttcaccgtgttagccagaatggttttgatctcctgaccttgtgatccacccgccttggcctcccaaagtgctgggattacaggtgtgagccaccgcgcccagcgattgaacttttgaaaaatatatttcttggccatttgtatgtctctgagaaatgtctgttcagatcatttgcccattttaaaatcaaattgtttatttgctgttgagatgtttgatatccttgtatattctagatgttaatgttcatcagaagaatagtttgcaaacattttctcccatttcataggttggctttccactctgttaattgtttgctttgttgtgcagaagttttgttgcttgatataatcacacttgtttttgtttttatcacctgttcttctgagaccttattcataaaaccttttcccagaccgatgttctgaagcatttcccctatgttttcccctagtagtcttacagtatggggatttacatttagatctttaacccattttgagttgattttttgcataaagtaagaaatggaggtctgctttcattcttctgcatatagatatcaagtgttcccagaacaacttaagagggtgtactttccttagtggatatacttgacacctttgtcaaaagttagttggctgcagctatgtgaattacttcctgggttctttattttgttccattaatctttgtttctgtttttatgccagtatcattctgttttggttcacataacttggtagtatattttgaaatctggtaatgtgatgactgtagctttgtttcttttttctttttttttaattattttatttttattttatttaattattattatactttaagattttagggtacatgggcacaatgtgcaggttagttacatatgtatacatgtgctatgctggtgtgctgcacccattaactcgtcatttagcattaggtatatctcttaaagctatccctccccgctccccccaccccacaacagtccccagagtgtaatgttccccttcctgtgtccatgtgttctcattgttcaattcccacctatgagtgagaacatgcagtgtttggttttttgtccttgcgatagtttactgagaatgatgatttccaatttcatccatgtccctacaaaggacatgaactcatcattttttatggctgcatagtattccatggtgtatatgtgtcacattttcttaatccagtctatcattgttggacatttgggttggttccaagtctttgctattgtgaatagtgccgcaataaacatacgtgtgcatgtgtcttcatagcagcatgatttatagtcctttgggtatacacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctggctttgtaatgattgccattctaactggtgtgagatggtatctcattgtggttttgatttgcatttctctgatagccagtgatggtgagcattttttcatgtgttttttggctgcataaatgtcttcttttgagaagtgtctgttcatgtcctttgcctactttttgatggggttgtttgtttttttcttgtaaatttgtttgagttcattgtagattctggatattagcgctttgtcagatgagtaggttgcaaaaattttctcccattttgtaggttgcctgttcactctgctggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaagggatccagtttcagctttctacatatggctagccagttttgccggcaccatttattaaatagggaatcctttccccattgcttgtttttctcaggtttgtcaaagatcagatagttgtagatatgtggcattatttctgagggctctgttctgttccattgatttatatgtctgttttggtaccagtaccatgctgttttggttactgtagccttgtagtatagtttgaagtcaggtagtgtgatgcctccagctttgttcttttagcttagattgacttggcgatgcgggctcctttttggttccgtatgaactttaaagtaatattttccaattctgtgaagaaagtcattggtagcttgatggggatggcattgaatctataaattaccttggcattatggccgttttcacgatattgattcttcctacccatgagcatggaatgttctttcatttgtttgtgtcctcttttatttcattgagctgtggtttgtagttctccttgaagaggtccttcacatcccttgtaagttagattcctaggtattttattctctttgaagcaattgtgaatgggagttcactcatgatttggctctctgtttgtctgctattggtgtataagaatgcttgtgatttttgtacattgatattgtatcgtgagactttgctgaagttgcttatcagcgtaaggagattttgggctgagacaatggggttttctagatatacagtcatgtcatctgcaaacagggacaatttgacttcctcttttcctaattgaatacactttatttccttctcctgccttactgccctggccagaacttccaacactatgttgaataggagtgttgagagagggcatccctgtcttgtgccagttttcaaagggaatgcttccagtttttgcccattcagtatgatattggctatgtttgtcatcagaattgctttggctatttgggatttttatgattccacatggagttgaggattatttatttttctttttctgtgaagaatatcattggtattttaatagagattagattgaatctgtagatagctttggatagtatggccattttatcgttaataatttttctagtccataaacatgggatgtctttctgttatttttgtgtgttcatcaatttctttcatcagtgttgtatcatttttcttatagagattgatcaccttcttggttaaatttgttcctaggtaatttttgtagccattttaaatgggatttcttttttcagtttttatttcagctagttccttgtttgtgtatagaaattatgttgatttttgttggttgatttttttcttctgcaattttgctgactctgttcattagttctaaaagtttttgggaagagcctttagatttttctatgcataagattgtgtcatcagccaagaggaacaagctgacttcttcctttttagttgggatgccctttattttattatcttgcctaattgttcgagctaggattttcagtattgtgtttaataaaaggaatgaaagtgggcattcttcgcatgttcgatatattagaggacaggctttccgtttttccctatacagtatgatgctagctgtgggttcatcatacatgaactttattgttttgaggtatgttccttctatatccagtttgttgagaatttttgttataaacagattttaatgttatcaaatgtttctgcatctattgagaagatcatatgattttactcttttattctgttgatgtgatgtatcatatttattgatttgcatatcttgtaccatttttgtgttccttgagtaaatctcactagatcatggtttgtgatctctttgacatgtttttgaattcaatttgctaatattttgttgaggattgcatccatgctcttcaggaatattggtctgtagtttttatggagtttttttgtagttattatgtccttattggattttggtatcagagttttgctggccttgcacaattagcttggaagaattccttccccttcaatttttggaatcgtttgagaagaattgttattagtttttcaaaattttgatagaattcagcagtgaagctggactgtgctggaatggtttttgttattgactcagtcttcttagtattggtctgttcatattttctatttctccttggttcaatcttggtaggttgtatatgtccagaaatttactttttctctaggttgttcaatttgttggatacagttgttcattagaatctctaataacctcttgcactcctgttctatcagttgtaatgtctcctgttttattcctgaccttatttatgtgtgtcttctctctttttagtctagctaatggtttattgaatttgtttatctttcaaaaaagctaactttttgtttcattgatcttttctattttgttagtctcagttttgtttagttcttttctgagccttctcatttcattctaccagttttcggtttgctttattcttgcttttctagttctttagggagcattgttagtttgtttgtttgaagcttttctactttattgatgcaggcatttattgctataaacttgcctcttactactgcttttgctgcatcccataagttttggtgtgctgtgtttttattttaatttgtttcaataattttttaaatttccttctcagtttcttccttaatgcattggatgttcaggaacatgttgcttaatttttatgtatgcatattttcagatattcctcttggtatagatttttagttttattctattgtggtctaaaacatacttgatgttatttcagtttttgaaaactttttgagatgtgttttgtattctaacatatggtcaaatgtgaagaatgttccatacactgatgaaaataatgttttctgcagctgttggttgaaatgttttgtaaatatctattaagtccatctggtctatcgtgcactgtaactttgatgtttctttgtggattttctgtatagatgagctatccaattctgaaagttgtgggtgggttgaagttcctattactgttttgtggcacaaccatctctttagatccagtagtatttaccttataaatctggaccctccaatgttagatacatatataattattatatcctcttactgaattgatcccttatttattatacaatgtcctttttgtttctttttacaatttttgacttagtctgttttagtatagctacttttgctcttctttggtttctatttgtgtgaaatatgtttttccataacttcactttatatgtttctatacaggtgagctgagtttcatgtagacagtatataattgggtcttatttattcagccagtggatatttttgattgtggaaatataatcaatttatacccaaggatattattaatatgtgaacacttactactgttttttattcttttctcatcatttcgcttcatattttctctcttattgtttatttttgaagtttgatggtttttagtagttataagttgtgacaatgcagccacccatgtgggcttgctgtaataaagatagaacctttctctttcttttttgtacataagcaatattagtgagtttcataatttagtgtgttttcatgatgatatttactgtctttttgcttccagatgcaggactctcttaagcatttcttgtaaggccaatctagtgatgataaattcttttagtttttccttgccaggaaaataatttatttcttattcatttctaaagtgtagctttgctgggtgtagtgttcttcactttcaattttttgtctgtttgttttagtattttgaatatattattccgttctcacctgacctttaagatttctgctgagaaatctgttagtgtaatggggattttcttatatgtgatttgatgcttttctcttgctgtttttagaattatttgtttatctttgacttctgtcaattagactataatctgtctcagagagggtctgtttggcttaaatctattttgtaatccttgagctttctggatgtggatatacacctttcccaagacttggaagttttcagctattatttcatttaataggttttctataccttttcacttattttcttgtttaggaattcccataatgtgcatatttgtttgcttaatggtgtcccataaatcctgtaggctttctttgttttttattcttttatgttgtatattttaattttgctcattgaattcttcagctgtaagtgttttgggttatttttatgatgtctatttcttggcttaatttctctttcaaaacatgaattgtttccctgacttcatttaattatctatattatatcgcactgaatttccttaagattattattttgacatttttttcctggcatttcatctatatcctgatgattattatctgttactagaaaattactgtgttcttttggatacgtaatattttcctgctttttaatatctgaggcatccctacactgatatctatacatgtggtagaatagtcatcttttccagttttatggagttgggttcatagagaaagacttatttctatagatggtcttagaatatcagttgaatgaggtgcacgggctttgattctaggtggatgcagtagtgcagtctttgtacattttcttcagcagcaatccattttagtgatgttttcaaatgtctcagtggcctgggctgaatatatggtggcaatgctgtggctttgcaggaggtgaactcacaggactatgtctcaggccaagggtacaaacatgaacatgatggatcagccaactgagggtgtgattcactatggttggggtgcagggtggttactctggctagggccactgttgcttggttgtctcaagggtgtgtccactgggctgtttctcaagccctagatatgggcacaaggccactcctgccaacctgattgtgtgtctgctgatggtgggcatgccaaactgtttgtcacactctgggcacaggtacatcactgctaggccagtctggtggcatgtttgctggaggtggcctgtcaggttgtttctcaggccctgggtgcagttgcagtgggtgctggtttctctgctgtgtaggacaggagtcagtcaatcctaaacctaggttttgagtagccagagttgcgacaacacagccacccatgtgggcttgctggaatgaagatacagccccagtgctggggaggtaaagtggctactggctcccagagcatagtgctctctagaagtaggtccagtcttaagattgtaccatgttgcagtggcttgggacacaaagggtcagtagggaatggggaattcacaccttgttctcctaatcagtagtaatgctgctgtgtgaattcctggcagctctctaaactgggctcagggctttcaaggactgtgggattctcctgtagtaaggactacaagtgtttgtggtgacagtgggggttggtggagtttctccacttacttttttttccacgaggggaagtctctcttgacttcaggttgatctcatcataggagacaggatagtagaggcaggatggctcattagtctctctacagtgccctcctggacttcggagcaccacagggacctctcatctcccctgctgccttctagtgctctctcttcaatactccagttaaattctatctgtttattctttgccttgtttcttttcttatggggaggatgagtgtcatgtgcctctagtcagccatcttgctgactttacattacgaacttttaaataggtatgttttaaatagtttatatgaaatcccagtaaaatctgtaaacaaacaattggaccttgatgaaggtggagatgatcctgattttctttattatccggttatgtctttgtttttattgttgttttgttttgccttcaattactatatatttttcctaaaatttcaaattgtttatgaaaatgtgatttaagtatgtcagtgtggttttgctctgaaggattactaaagggcacataggcttgtaggacagtgttttctgtaactccctagaaagaaggtttcttcatcaggagtgtcattctatgaaagaaagcttatgtgttgctttcctaattcttaaataagagcaagatatcacagaaatacttaactgttgttaacatctaccttttgcttatcgatgaaagagaacatgagctatcacatgtgagtgaagcaaggcagaacgataagtaggagaaaggaatggttagataggaaatgcaactagaagggaaaataaatgggaactcgaatattttaaggactccatcttaacccatgttaattcataagaaaaatcttacacattaggagaaaaaataactagttggataaatacacatgcacataaaaaaataactttcacaggattttgtcattaaatacatttagagaagttagcctgacccatacttctgatttcaaaatccataaataccaacatatataacaaaatgagatagtataggaatttgataggaatatttgtttcttcatatattagtaatattccaccagttctaccatcccatttctaatatttgaatagatgggtggtggccactctagatattcattttataaatgcaatttccaacagttagctgtatcatgtgagttttcctctatagtgctgactttttcaccagtgaactcaattggctgtttgttcaaattccccactgaagaaactaaagacatgtatttaagttcctagtgtaaaaatgtgttgagacaatagatgaattcatttactgagtatgctggccagtatgacttgacacagattaacattctcctacttctgtggaaaataccacaaatactttgctctgttggtggtatagaaataaaataagatgatacatgaagtttgtctaaactgtagatggcattttggtccttaaattggttaattcctctctaataaccatttcagaatatttgagcattttactagagtttatttattttttcactgggtatgtagacttgcgaaagtcttaaaagtctctccatatcactagataaagaaaaaattcatttgttcctaaccacaaggttcagcatttgtatagatttgcatgagaaacacagaaaatccatgcagagacaatgttctttacaatgctttttcattaaatatctttcatctctgttcttgattcctattttagctgctctttcctgtcagacctgagctcatatgcctaggagtttttgactgaagcacaacatcactcttgcctcatttttcatgtcacaattttcccacagaataggaagttttaaactgataataaattacaatgaaaccaagctgacatagaattcctagcttgctaaattgtgggcagcaccctgccaagtggaaggtgtctagagctgcactgtgaccatcacatatgttctcctacattccatgactatatttcttaatgcttcacattttgcattaaaacagtgaagacctcactgccaaacagctgtgattttgcagagctctcatgtctaataatatcccactggctagatgagatataacgtagactatgaataaccacttatttgtggttaagaaaaagcatacatggcttctgcttctgatagtgtccactctgtactttcctttgcaatattagatagctattaatttttcaggataatacttagggtacaaagaagtgtatttcattgcttaactcatgtcaacttattatggggctttagcttctccctactcacttgataattttagctcacaaacttagtgtttcccttccttttatatgtcatgaaacatgcagatgataatatttgtttggcatattggcatcggagtaaaatgaggctgtctctaaggttctgttcactacaaagtctggacaatcattatattagtatacatttggctgtttattagtggcatattcattaggaggctttgtaactacctctttactgacagttgctaagaaagctattacttttttttttttttttttttacaaaaagttttcaaagtcctctcagagaagagtatcattcttgaaaaaaaaaaaaaaaaaaagatgtgaaattaagagagtatccagtcctttaggttgtctagaagtcctggctgataccacattccatggacctgtgtagtctatggagccatcaactccccattcttctggttatacaaaatgatattgaagattctcgcatgttaaaatttatggagagtaatctctgagattactgttctacctcaatcacaattatcccagaatataagaaatgaaaaaaacaaacaaaaatggtccacatttttgtccaggagggaatgaggacagatgaaagctttgagcgactaattacacccatacctatagatgcagccgtacaacccacatgaccagtgtgtgatttgctcacttataccactccactcctcttctaaagtctttccaattttcttttcaaagcttactatacatttaaatttgtgatataatgattagtcttaagcattttattgattctcaagtactcataaactgagtttgagttagcagaactcagagtcagagatgttttaaattaactcaattatgatagtagtcatagactttttgctcttatgtggaatttaagtgggtggatactgtaattattgaatgacataagttttgttatttgtaatgagttaaagtctaaatgcaaacttaaacatattacagtttgagtcattagcttattaattttttatgaagctattatctatcttaagagcttggagtctaccaagtaattaaggcaatgtctccaaaaattatactattataaaaaaatgaaatttccatatgtttaatgtttcaaaagcaattatgcacgtttgcccagtgttatttagaacaaacttcctgatactataaacgtcccagaaaaacttgttttttaaaaaacaaacttattatatgttatctgacattgcccattcatctatatactcactcttagctattggcatgttgtcaatacaaagtgctaacagttcataaataatttgacttctcttcctctcccatcttgagatcaaaatattccctaagttcagctattatgtctcatgtgttatttgaatccatcatactatttaaatccttttgtttccacagtgattcagtttcttgccctcttgctcttggatcatggtagtaattaactatgtgtccaaactattttttactctactgaaattacgatttttaaaaggcaaagctaattatattattcactgacttaattataaattcactgccaaagtttcctataatctacaagttatgtttcaaactccttagcaaatttattgattaactggcccctatctaccccttcaccctgaaaccacaacttccttctccttattacatggtttacttttaattacatcagctgtatgcatgatgcattccttcaacaaatgtgcattaaatccccgtaatgtgccaagtgctgtgctaagcattggtaatttaatagcaggcaagtgaaatatgtcctcaggaagctacaatgttctaggcatgaatataacaaaattggcaatagtaatataccataacaagtgatatgatgtgcttaggagtaatgctcaataattagataggtcaagagaatggaacggggttgcccatgtaggggacaatagcttacacatttgtaattatgtttgtatcagagacagcatggaatatacaaagagctgggacacggttttgctaaagcacgggggtacacacagggggaagagcacagtgaagtggcataatatgattacatttgtatttttataaggtttatttgatttctttgtagagaataaattgaagaaaggccacattagatgcaggaagacaaactggaaactattccaaaaatttggttatgaaataatggtgacttgacctgggtataaccctgggtgtggtgagaaaaggataaatttggtaaacatttcagaggcacaaatgatagaacctaacgactgaaatgatcttgggaaaaaggagaatgagatagagaggatattgtcctggtttgtggcttagcaaatgagtttcctgatggtatcacatactagtagagcaaacccaggagaagtgagaagcctgtaataaaagatagaagttccaatttagacacgatgattttaagatttggttggacacccaaatggagcttttggtgaagagatgaatatggtggtctggctcttaggaaaaaagtctgaaccactgattcatattcagaaatctttagcataaagatattctaagaaagtggataacaatatccaaggataatttagagtgagaagaaaagttggccttagaataaaattcctgagaaatatcaatatttggaacatcaataagaaataaagagttgacaaatgaaataaaggtgaggcaagaagaaagtgattataaaaaacccatgagagagagtttagaataatagatcaaagaaagtaaaacactgactgaaaagtatccactggattgtataaaaagcaaatcattttttacatgcaagataatgataaagttgaacatgtttaaatgctgcagaaaaaaagccagagagagagagagacagagagaatcttctctggaagatacagggaataaaaataagagtccttaaagctagctctctgaggatgttcgataggaaaaggattctgcacaatggtagatggactaaccttaaaataagagaatttcttccattgtaataaaacaaaacaaaacaaaaagatgcagttgaggttgtgagtttagcatttataacagaaaaacaataaccttagatttctcagcccttctttccaccctacaagaagctaattacattttatactttcaacatctattcagtaaaactacagacacttttatgagagttcagtggccaaaatagagaatattcttattcatattctctcgctctccctctctcattatgtataggaagagagaacctctcccaggtgggtctgcactgttatatgtgagccttcaatgtgaaaacgaagaaggtcatgaaagctcttctcagacaatacaatactttttgaacggcaaggccctaaaatctagagatcaattcagggaagatgcaaattttggtctcatccctgaactggtcagatgagtgtccagcccaagagctcttatattacttggtgcaagtgcttatgccctcaatgttctgctttttctagtgggtaaaattaggcagttggtcatctccttgtttgccttttctgcagacaaagaaggctgtactggaatgtcagtttgtgaatccttcaacgttttaccactggaatttgtttgttcttgcttgtctaataaagtgctttctttacatatttactcaacccatgattcctgacctcatcatgtatatccagcatgtgacctttgaaacatttgagtggtacataattatagagtggtttgttatgatagtgatatatttttaaaatgtcaatatataacaaataatataaatagtaaggaataccctgaagtgagcattttatacaataatcttaacccaatattggcaggaacttgagttaattacaaacagcaacttgattagcttgtgaaatagaaagcagtcatatgaaaagagtgagcaagaaagttgtgcatttggaaatttcaggatgatagaaaacattaaaatggcattgaggagaaagctctagaaaggtaaacaagattgctgagcagcttcaaacaccagttgaggttggaaactatgaagatatagttaacttactgtgtgcaattataaaatataccgtgtgggtggtgcatttgtggggccattttgtggtttttgaatgccgttttctacttcatctgttcattcatgtagagaaacttaatcctttaagaatcaactcatgtgcctcattctctgtgatttcttctctaatcatcgagcagggcatgccatacagtaagcgtgccataaatgtttcttgaaatgattaaaattatgctttgtttgtgctgacccttttacagtgattttagtcaactacttatgttctttgttcttcagcttccttacttgtcaaacatgaataataacaatgcctatttcatagggttgttttgtggattaaatgagttcacacatataaagaacctgaagtagtacctggaacaatttaagtgctcaattaaaattaatcatgataattattattatcaagcaattgttattattatatttaattctatgtccatcacttatttacaggaattgatctcctactagcctgcaaattatttagcaaagtggtccttttgttttcaagaacttactatgagcttgacatagaaccagcacacataagtgcttatgaacaaatgaatgacaatgaataatagctgaatgttttttggaaaagctaatatttgtttgtttgttttgagacagagtctcgctctgttgccaaagctggagtgcaatgatgcgatctctgctcactgtaacctccacctcccgggctcaagcaattctcctgcctcagcctcccgagtagctgggattacaggcatgcaccatcacacccagctaatttttatatttttactagaaatggggtttcaccatgttggccaggctggtttcgaactcctgacctcaaatgatccacccaccttggcctcccaaaatgctgggattacaggtgtgagccactgtgcctggcctagaaaagctaatattcacagaagaagaatatcctgagatgtaatatgggattaagggaaaacatacacacaggctttggaatcagactaagtttctagctgggaaatcctaagcaagctatttaattttcttgagcctcaagttgttcatctgtaaaatcaatataactgtactcaactcatagagtaatgatgattgcatgtattttatactaaagatgtagatgtttggttattactctcatcaccaacttcatcagcggggtcattattgtcattcttatggtcatcagattgaccttttgattaccagacttaacataatgatacaaaacacctcagtaacagcttcctaaaatgtaactttcattttaattagattatcctttcagtaatgtaattgagtgttagaagctggaatgggggctgctgcttaggaatttcaggtggtactgtattagtaatattctgatatttgtctacttaatgagagcagcaattcagtacaaaaagaaaaggctctgttttgacgtaaaaatctgatatataaagagtcttattttgggaacaaaacaactaaatatatcagggttgtggttacgttaccagctgcaagcattagtcatgactgtgttataaaagagttaattaaattctttgggtgaaggaggtgcagaaggaagtcaacacagtcttctgatgagatgagtcactgtgatcatatcagaaaaaagcacaggagctgaagaaagtctgggtcccagactgatgccatattgcaggatcagcctgtgtgaaaagccactgaccaataggaagctcagacaaaatagtttagtgtcatctgaagtctcatcaatacataagcagtttgaatttgtgtatgcaattttatttagcatattttcaaggaccataggagaataaacgtccttggattcatgactattgctgttgaagagtgggtttgggtataatgagtaatttcttcccatactaaataatattgctatatcagagagtatattgatttattaattaatatgtatgcttgatcatgacaaaaaaaacaagatgaaaacatgtagatttatcaagacttctgttagcctcatgactttccattctgctgttatgtgttgcctacatctccctcactcatcagtcttgagttttatgattctaatctgtcaaatatcttaactttttttggtccagcctcatctctcaagtaaattttagaaaacggtgttttccatttcccttgtctttttcctaatttattttccacattatgtgaaaaatattctgaaacccaaatcagtcacataatttctattcaattgctcccttttgtcttataggttcacttagcacataataaagggccatttgtgatctgaccttgaccctccagttttaatgaagtgtggtttctccctgcaatattatgctccagctatagtggtagctgctaaatgtattattcagtttcttggtgatgttcctttgtaaatgttgtgagcttttcttggaatgcccttcctttggccttcattacttagcaaatgctggttttcccttaaaaaccctgcattacacactggggccttttgggggctggggggttgggggagggatagtgtaaggagaaatacctaatgtaaatgatgagttgatgcgtgcagcaaaccaacatggcacatgtatacttatgtaacaaacctgcacattacgcacatgtaccctgcaacttaaagtataataataaaaatatatatgtgtatatatatatatgtgtgtgtgtgtatatatatatatatcagaaataggaaaaaaaaaaccctgctcagacatttcctcttctgtaaaactttctctgactatacccacctagactcaattaccctttgcgcacggcccctgtgtcaccatgcacaatatttcattatggcagtcttcacacactcttataatcatttctttgtacaactgccttcttcaataaaccctgagctatttaagaacagggaacatttttctctcagtctccaaaaagcttgtcacaaggtagaagacaaataaaattttgttgaacttaatttctaagtgatataatatggataatgaaaaactttttcagtggagtagtgtaaatggcagcaaaaacatacatcctaattttttttccttgttctgccattaaaatttacaggatgtggaaaaggcaaatattttctttaggcttctggtttttgtttttttttttttcccaaatgtacagcgaaagatttgaataactaatacccaagtcccttttttacaaacatgtattatgactttgtctatactgagacactctcttaaaatagtagtatgaccttattttataatttaatttatatcatttcatgttgaaagtgaatttacatctttaggtaataggcaaccttttcaaaaatcaatgtcgttctgaggctgagattcataaagcaaatggaattgtttagcgtagctagattttatttcatattgacaaatgcttataatatttgtgcaataggtttttttttttcttgatacaacctgttcagtggcttagaggcaaatactgtgtgatctcatttatttgcaagctttcctttttggagaataaatgatatatcagctcaagatcacacagctattttattttgagttgaaataaatcctaagatactaaatatgataggattagttaatcttttgcaacattttcagaacgttgatttttttccccctcaagttttatgtcatagtgataggagcatttcaaagaagaccagaaatggtttcaaatttttgtggcttgtaggaaatgtatgccccgaaaactctttataatacattcttgtgttggggggacaggatgtggggtgggggagagaatgagttaagggggataaattcagactcaataaatatttaaatgtttctggaaaagattcaactagattttaaagtaaatgttacatgtcagaaactaataaatgagatataagattaatgagtctttaattttatatgagatagatagtacaggtttacttactttcttttcttcatttcagaatattttcaaaattacaaggttatctttatttcaataagggtgtttacatttaaaagtctgtcacattgagaaacatgaaaatatacatagagctggattttaagagcagtgtaaatacctgcatcattggtgaaggcacaggggcttcacaagttgatcagccttgaggatgaaagtcagtttgaaaataagagagacatcagggagtaggaggtaggcacatagggaaattgttaggtttgcagacataacctacctgggaatgcagaaacttttactttatttttaaaaattttaattataaatacacaaatatggttgcatatatttatggcatacaaggtgatgttataatttatgaatataatgtggaataattaaatgattctaattagcatattcattacctcaaatagttatcatgttttgtgataaaaacatttgaaatttattctcctggttatatttaaatatacaataaattatttatgactatggtcacttcttgtgcaatatatttaaaaggaaaaaaaaaaaccgtatccctcctgtctaattgaggctttgtatcctttgaccttcatctttccatcaccccccaccacttccactcctactccccagcctctggtaaccaccattctaacctctgctactttgagttctattgttttagaatccatgtgtaaatgagatcatgtggtatttgtctttctgtacctggcttatttcacttagcataatgttctccaattcacgttgtcacaaatgaaggaatttctttataaaggctgaattagtattcagtcatgtgtacatatttcatgttgtttagccattcatctgttgatgtacacttaggttgatttcatgacttggttattataaatagtgccaccacaaacataggggtgcagtcatcatttgaccaactggtttcaaatattttggataaatactgaaaagtgggagtgctggatcatagagtaattctatttttagtattttgtggaacctacacacagttttccataattaatgtactgacttaaattcccgccaacagtgtacaagcaaaaccctctatgctaataaaaaatatagttcgtttcccattgaatgtgaaacttaaaacatgaatttgtaaaaaaaaaattatgtaaatacattttcaacaaaggaaaagaatacctttcctgatgaatgacataattaaataaatatgaaaggaaatattgttctaaaaactaattagggttaaatttaagaatttaaagaagaaaatattgaaaatttattaataaataggtgaaaggtctttctgctttgtatcttcatttttttcagttatgttatttagaagattaattatctgattaaagaactatgatcatttattgcatcatttttcataacttttattattagtgtagcatcaacatttacaatacaagtttcattgttcctttttaaacacgaagaaaacataataatgtgttaaataattttttaggtctaattgatctcttcctacatattcatttgctgtagttgtatctattgtatttatttgttattgaatcccagctgaagaatttcaaagttgttttatgtttaattcacttaataagcatttattgagtactgcatatattaggtcctggagggtggagattataggttaataaagcaaagtcactgccatataattagaaagaagactttttttgaagttttacatttatttatttatttatttttattctactttaagttctgggatacatgtacagaatgtgcaggtttgttacataggtatacatgtgccgtggttgtttgctgcaaccatcaacccacaatttctcctaatgctatccctcccctagccccctaccccccgccaggccctggtgtgtgatgttcccctccctctgtccatgtgttctcattgtttaactcccacttatgagtgagaacatgcggtgtttggttttctgtatctgtgttagtttggtgagaatgatggcttccagcttcatccatgtccctgcaaaaggcatgaactcatccttttttatggttgcatagtatttcatggtgtatgtgtgccacattttctttatccagtctatcactgatgggcatttgggttggttccaagtctttgctattgtgaatagtgctgcaatatacatacatgtgcatatatctttatagtggaatgatttataatcctttgggtgtatacccagtaatgggattgctgggtcaaatggtatttctggttgtagatccttgaggaattgccagactgtcttccacaatgtttgaactgatttacactcccaccaaaagtgtaaaagcattcctgtttctccacatcctctccaacatctgttgtttcttgactttttaatgatcaccactgagatgttagtttattatactctaagatctattgaggaaactgcagtgtgaatttctacaactgcacattgcacattcacatatcaccatagacaattacattttgggggaagaaattacatgtgaatgagcattttggagaaatatgatggtgaaaggagtattttagaagacgagattttacctaaattttcaataagtgttctaaactagatatcacattttttattagacaatattttgaaaagacccacctgctgaaaagaaagaacaaacatggttactgttataattattgattcagaggggatgttatgtatgtaggaaaatcacaggcaattcattaaaaaactcttttggtagcttctatcaccagcaaagaaaatagtttaatttcattttactgtagttcaaaatcctccccagggtgtaattctgattttttgtcacaggagccaattgtgttattagaataagaaaatggtgtattttaaaaaaatcagctacgttggctttttattctgatgataggaaattatgtgtgtgtgtgtatgtttcacacatgatggaaaaaaatgagtaagacataaatcttcagaattaaagcccggaagcaaagtgtatgttccagtgaagactttaagtgacagcgtgacgaacttttgatcagtgtttcttatcatggagtaatttcttgatcaattaacaatcaattagaatttcagacatggcttagatggcatgatcctatttcaaaaatgtaatgagccaaaaaaaatgggttggcagattccaaaatctatgaatatactgatttaagaacaggaaaaacattcaaatgtcatatttttgttagtacattggacccgtagggtatgggaaaaataatatactgggatatttgcagtcattccaaatatatatattatattatatattcatatacattatattattatatatttatatattatatataatatattaatatattatattatatatttatattatatacaatacatattatatattgtagtatagtatatattatatgatatattaatatatagtatatattaatatgttatatatatataatccaagttaaagcaatagaacaaaacacagtatgtggtacctgcagtgctcactgcaattgaacattcagtattaactcttaattcccttgaaataaaaccaaaatgggtcatatatagagatatatagttcttaagctgcctgagacaaaattccgaattatccacttattagttatttgcaaattattgactttattcttggctaaactttatccatgaaaagagaaaagaatattaccttaatcatgaggatattgtaagaattgcaggtaatactatatgtaagacccttaacactgatgtgcacagacaaaatgcttaatattaatgaatattagcagttaataatgttattaatattagtattatggtaaataaaattatggtaatttatgtgaggggattccttcttcctgcttctcctaccccagcaactaaatttaaataaagcatttatgataagggtaaaacggaaattagttaatatgatttttatttaagtgtggtttttgaaaaagacaaatgattgtattttacaaaactatgtttcttttatcaactctatacagaaactgagaccttagtcttaatgtataacttagaaaagagtttttcatgacaaagtgctgaaacaatatggtgtggacacctgatttcctggtaatctaatttaatacagtggtaaaacttggatgttggacacattatgctgtcccttccaatcactaggagtctgaagtagctggtgttgggttggactcacttccaagctgaatttttttgaataaagggccaatattgtttgatgactatggtaaggtctgtatgcttaaattgtcagacaataaacagtcagagttggcattctgttgtgaagatgtggaaatcaaaattggttcttgctatgatgtttaatctactttttcacatcagtgagtctccaaaatgcctctgggtatagctgacattttcctgcagaatgaactttaaatctttttaattacttgccacattacacgaatgagacaattttaacctaaagaaaatgtaagggcagatgttatcagttaatcattctaaccaaaaagaaaaaaatattcctctgagtcctatgggcaatgctcacatttcagtagaaatgtattcaagttgacctgccagaatgagttggttccttgcaataccaatagaaaatcaaatatagtaatcatttagaatgtacagaccaccaacatgcttaagaatgtccactaaatagcataattgctgcttttagttgtgttttaccagtgtatatatcatcacactagaaaaagctgttgattgtggtatttgttgtaatcaaaccaaatcaatttaacacatgtaccaattatttaaatataaacttaaaatttgagggtgcacatttagattatagtattagttatatatgtatatatttatttttacctagccttattgacctataattgacaaatgaaaattgtatatgtttatagtgcacaatgtaatgcatggatatatatatatatatatattttgaaatgattactacgatcaagctaattattgtatccattgcctcacacagttatcagtttttgtgtgtgataagatcatttaagttctactctctttgtaaatttcaagtatacaatacattattaagtatagtcaccatgctatatattagatctccagaatttgttcatcctgcctaactggaactttctaccctttgaccaactcttcccacttcccctatgccccagcccctggcatctgccgttctaagcggcaaatgaacttttataagttcaacttgtttagataccacgcatgaataagattatgcagcattgtcttactatgcctggcttatttcacttagcataatgtcttacaggttcattcatgttgtctcaaatggctgaattttcttcttttgtaaggctgaataatactaaattctgtacacatgcacatacacacacatgcatatcatattttctttatccattaatctattgatgtgcacttacattgattccatatcttgtcttgtgtcaataatggtgcaataaacactggggtgcaggtatccccttgatatactgattttacttacttactttagatgtatcctcagaagtgggattgctggattgtttttaatttgtgagaaacctccatactcttttccataatgtgtatactaatttacatttctaccaacagtgtacgagagttcccttctctccacatccttgccaacacttactttttgtctttttgataaaaaacatcaaaacgagtgtgaggtgatatctcattgtggttttaatgcatatttctctaatgattagtaatgttaagcatcttttaacatatctattggccatctgtatgtattcttttgagaaacatttattcaggtcctttgctcagtttttagttgggttatttgttttcttgctattggattgtttgagttccgtatgtattttggttattaactccttatcagatatatggtttgcaaatatttttgctcattctgtaggatgtctctttactctattgatttgttacctttgcagtgtggaagctattcagtttgatataatcccattcacctagttttgcttttattgcctttgttttggggttatattcaaataatcagaccaatatcaagaagcatttcccctatgttgtcttctagaatatttaaagttttaagtcttcctgttaagtttttaatcctttttcagttgatttttgtatatgatgtgatacaaaggtacaatttaattcttctggaagtggatatccagttttcccagtaccatttattaatgaaactgtcctatctccaccatgtatttgtggcatttttactgatgaacaattgaccataaaagtgatgacttatttttaggctctttattctgttttattggccagtatggtgattttctattttttttattgccaatatcacgacattttgattacggtacctttgtagtgtattttaaaataaggtactatgatgcctatggctgtgttcttttttcttaagatttgtttggctgtttgctgccgtttgtggttttatactacttttaggaattttcttcttgtttctgtgaaaaatgccattacaattttaatagggattttattgtttctgtagattgctttgggtagtgtaaacattttttgtttgtttgggtagtataaactttgggtagtataaacaatattaattcttctaatcaattaacatgggttatctttccattattttgtgttctttaaatttcttttattattgtgttttagtttttagtgtacagatctttcacctccttgattaaatatatttctaagcattttgttttatgctattataaatgaaattgttttcataatttttttagataatttactattacatgctactaattcatatatgttgattttgtcttctgcaaattgaatttatttattctcacagttttttttggtggaaattttaaggtgttctgtataatcatctaaaaacagaaaaaatttatttttttctcttcaagtgtcttttttttttcttgtaggcactatctagaactttcagtatagcattgcaatagaaggaaagagcattcttatcctatgtcctccatcttttctgggtatagtttttttggttgccagtttttttattgtaacacactgaatttatcgtctcatactctcctggagtgcatggttactgttgagaaattcactgatggttctaacagagtttctttcatatgtgataagttgcttttctcatgctgctttcgaaattctctttatctttgacttttgagaattttgttaccgtatgtcttgatgatgatctgtttatgtttaatctattttgggttttttgatcatcatggatctggatattcattttcctctccagatctggagatttttctgttattatttattcaaatatacttttatactttttctctttctctgctcattctaggagttctatagtgcatgcattgatgcatttaatgatatctcataaatcccataggctttctttactcttttttatcctttatttctttttcatctcataaatctcttatttatttatatctcataaatcccattgactttctttactcttttttatcctttactctttttatcttttatttctttactcttttttatcctttatttctttttattcttttggataatttcaaatgacctgtctttgaactcactagttcttgcttctacttgattgaatcttgcttctacttgactgagctatctgttggatttttcagtttaattattgtgttattcagctccagaatttttgtttggttcttttctatggattctatccctttcttaaaactctgatttcattgatacattgttttcttatttttggttagtcgtatgtctatgttctcttatagctcactgggcttctttaagacaattttgaattatttgccagacagtttgtagatcttcatttctttagggccagttaatggtgatttcttttattcctattatggtattgtgtttctttgattatttgtaatcctgtggacttgcattggtgtctgtggttttaaagaagtggacacctcttctagtctttgtaaactggcttcaccagggaatgtccttcatcagtcagcctttccagttattacgtgcagtttatctgatggggtctgtgtgtgccagcctggtgttgggacagggcctagagcctgagactgtggaagctggcctggtgctaaagtggaactgttatctgggtctatggagatgtcctgagtttgtgggaaccatcttgtgctgaggtcaactggggtaggtctggttattgggaccataaaggtgggtctggagtctggatctgtggggccagtcttgtgaagatctcctggggtaggcctgaaccctgggtccatggagccttggtccttggtagctggcctggaaccttggtctatagggactggcctgaagcatgggtccatgaggactaacctcacactgtgtcaggctttaagcctgattcgaaggggcttggcctgactctgagatgtacctggaaactggatccaaggaaacagatctgttcctgagtctgtgggagtcagcctgaaactgcagtttactagagtgggcctggagtctgggtctgccctggtaggcctgctacctgtatctttgtgggcaggcctggtgccagggaaccacaagggcaattctagatcctgggcccacagtggccagcctgatgctgggacaggtcttaagcttgagtgtgtaggagttggcctggggcttcagtctgcaagtgccagcctggagcctgaggccatgagggctgacctggcactggagtgtccttggaacctgggctcatgtgattgagtctggagacttggtctttaaggactggcctggcaccaagctaagcctagattctgagaccacggggccttgcctaacactgggacactgggatttggtgggatggggctggtgtcgaagtttgtggtaacatcaggtattcacttccctttcctttcctcgagcaggacacaactcttttcacactgtgctgttcaggcttgtgggaagggtttcatgaataatgtgaactgtccttgctactttttacaatgtgtcttttctcatatctgtgccccaccacttgctataatttgtcagctaaatttcttagcttttgtgaaggtatttttatccatagatagttgttcaaattaatgtttctgtaagggaatcagcactgcaaagtcttattctaccatcttgcagacatcaccagtatcatcatatatgacttaaaataaggattcaaagtcatttttaaaataaactattcctaccagaggagtcaaagtgttataacagatcagtgaaggctgagaaatgtgttatactttttctagttcagctcaactataaatagtagcaagtattggtaaagaatagattctagctctggaaccagacagagaaggagatggacatgagtctcagctttaatatttacttgctgtgcacttcgaacaagttattcaatgtagataaacttcagtttcctctaataataatatgagggataataatgtaacagtgtttcaaaatgcaatcagaaatgttataatatttctgaaagttctgtttgaagtcttctcactttgggagatgaaagaaaccagtttgaggtgtttcatgagggtttttcatagagaatatgaaaagtggttaaagttgtcttacttgaataatatgtggaactcacacttagtattagttcagacactgaaaatgatttgccctaaaatatttaccaaatctgagattttttttcactactgatactgagtcaaatttaaaggcttgaatttctaatgatatgtaaactttgttttcctatatagttaagttataacctttctgaatagatcttagggtaaaaagctttcactgtaaaaataagccctaatttcagctatcataatttgggactaatgcagagctagccctgctctgaaggattggatacgaatgtgttttactccttgaattcttcatcttatccgagattctaccagtgaatcagtgacaactttgaaatctagagtttctgaatgagtttaatcctctcctgtttcttaggcaaaaatagttcaaaacatttttttcatagatctgagtatcctgtatttatattatggatgtgagataggagcaggtttttaaaatctggcctacaggtaatgaaataatgcatatgttatgtacgcaggccaatttaaataagctattcttttttaacatacaatctcatattcatttctatatgccatttcataaaatatgccttttttattgacttctttgggcaggaattgtatgtgtaaaacaaatatggaaatcaaggacagctgtacaataaatcaaagtcacaatgctgaaagcagaaacttgagacgctcctttaaaaaaatgacttgtaaatcaactcatggttgcctgacatttccactgattaatgccggtgtcctttgaggcatactaataggataaacaaggaaaaatggaatttcttgccataagatgagggtcagtttgaagatattcatgactcagtcgcatcacttaatcacaaatagttgtaacctgtagcagaaattaattcaatgtgaattttttacaattaaacacagtagtctttgtattgctgcacataattaaccttcattgtctcaaatttttcaaaataaaacatttctacttttaattacaaacatctaatttttgtgagttataacaaaatggaatattttctgagtaggctatagagtaaatttagttctgaaagttcctggaataatgtcattgagaaacataatatagcatcagccataaaatgtcatggttgatgctcactgaaagccattcaaaggaattctgtattaacttttgcaaatgcacactttgaattcataaatctttatgggaacacattttaacaaatgtactgtggtttatatttaaaagcactatgtggtttatagttaaaagcaattatgattcactctgtctgctgaactcactaaagggaaggtcttcactgaacacaagactcttaagaacagtaaagattgttgttaaaattcagagtatcagcctccttccaaactgggccagggacctcctttaataagaccagcttcagtgaatatatattaagagatatcaggagctaaagtaagttaatagaaaagaaaacatcaaaagagtacattctaaagaatttatggtatatatacacaatagaatactattcacccatagaaaatgaaatcctgctatttgtaacaacatggattatgttattatgacaagtgaaataagccagacacagaaagacagacactgcataatccccacatgtcctgggaggcattcagtggaaggtaactgaaccatagagatggttacccccatgctgttgttttcctggtagtgagttctcatgagatctgatggttttataaagggcttttccctctttgctcaacacttcttcctgccatcatgtgaagaaggatgtgtttgcttcccctttcgccatgattgtaagtttcctgaggccttcccagccctgtggaacagtgagtcaattaatcatctttcctttataaattacccagtcttggacatttctttatagcagcatgagaacggactaatacagtaaattggtatcacagaaagtggggtgctgctgcaaagatacccaaaaatgtagaagaactttggaactgggtaacaggcagaggttggaactgtttgtggtgggggcttacaagaagataagaaaatatgggaaagtttgggacttcctagagacttgccaaatcactttgaccaaaatgctgatagcgacatggacaatgaagtccaggttgaggtggtctcagatggagatgaggaactttttgggaactggagtaaaaatgactcttgctatgcaaagagactggtgacattttgccccttccctagagatctgaggaactttgaacttcagttagatgacttagggtatctggcagaagaaatttctatgtggcaaaatattcaagaagaagcagagaataaaagtttggaaaatttacagcctgacagtgcgatagaaaagaaaaccccattttctggagagaaattcaagcaggctgcagaaatttgcataagtaacaaggagccgaatgttaatcagcaagacaatggggaaaatatttccaggtcatgtcagagaccttcacagtagccccatccatcacaggccgggtagcctatgagggaaaaatggtttcctgtgctggacctaggggccccctgctctctgcagttgggacatggtgtcctgtgtcccagctgattcagctccagccagggctaaaaggaacaaaggtacatctcaggccattgcttcagagggtgcaagccccaagccttggcagcttccaggaggtgttgggcatctgtgggtgcacagaagacaagaattgatgtttgggaacctccacctagatttcagacgacgtatggaaatgcctggatgtccaggcagaagtctgctgcaggggcggaaccctcatagaaaacctttactagggcagtgtggaggggaaatgtggggttagatcccacacagggtccccactgggcactgcctagtagagctgttagaaaaggaccaccattctccagaccccagaatgttagatccactgacagcttgcaccatgtacctggaaaatccacagacactcaatgtcagtcatgaaggcagcctggagggggaccatgtcctgcaaagccacaggggtggagcttctcaaggtggtgggagcccaacacttgcatcagcatgacttggatgtgagacatggagtccaaggagatcattttggaacttttagttttaatgattgctctattggatttcagacttgcattgagcctgtagctcctttattttggccatttcgtctcatttggaactggtgtatttacccaatccctgtacccccaatgtatctaggaagtaactcctttgcttttgatttcataggctcttaggtggaagggacttgccttgtctcagatgagactttggacttggacttttgggttaatgctggaattagctaagacattgtgggaatgttggaaagggcacaattatcttttgaaatgtgaggagatgagatttcagagggactggaggtggaatgatatggtttcgctctgtgtccccacccaaatctcatcttgaattgtagttcccataatccccaggtttcatgggatggaccccatgggaggtaattgaatcatggagacgttacccccatgctattcccgtgataagtgagtgagttctcccgagatctgattttacaaggggctttttcctttttgcttggcacttctccttcctgccatcatgtgaagaagggtgttttttttcctcttttcaccatgattgtaagtttactgaggcctccccagccaagcagaagtgtgggtaagttaatcctctttcctttataaattacccagtctcaagcagttctttatagcagcatcagaatggactaatacacctctgaaaaaagttgtgtaaaatagaatgctgctgtatttattacaggagaaatagaatgtcaaagacatgggaccatttgtgtcttttgataagtttattctttctgtatttcaaaatgtcacaaataaatgaaattataaacaaaaaagtttgtaacttaaagtctgaacaaaagggttttgatggactaaataaaggcctctcttctctcattgtctgaaatgctgtctaggtagctggacattattatggttagttatctaaccaaatatacctccttaaaacattcaggcttgttaaaaacataaatgttattgttattgccagggatttagaagatatgtttctgatcttgaaaattttgattttgattttccttttttttccaattcaaaaaaaggaagcggaaagtttgagatagttactcatatagtttctggtcccctaaacattgttggagataccctattacttatcatttttttttagaatccctagagagtgattctgatgcaagtatacccataaatagaatataatcaattatatcactggtgcagtccagttattatgatcaattattatttatttcttgtaatcattccttatttattttaatagctttctataaccttaccttcataacttaaataacttaaattttgacgtttgcttgcaatcatctattttctggctattccttagggcagataattttcataaatagctgaatttatcctttgagggttttaaaattatgttaaatttccatgtttatctgcaagttatggattatgtcactttaccatatcactcctttctgctgacaagcattaacatctatgggtgattttgtaacaacagcaaacatcgtcattgtagtattctctgccttggactttgtaaagttaaggaagtgatgtagtaatatttactagttgtgtgattttgaatgttaattattattaacattggatattaatttatccaaactcaaatttctttcaccagattatagggaaacttacaattgcctagttgattttccatatgaattagggataatgtgtattaaattaccaaaaataatgattggcatttgttacatattatcaactgaagagtgaaatttggaaaggagcgctttattactcataaaatattgcagccttcagggttgccattctgactggctgggaagcatagcctccagccagaagtcagaaacagatacttcaagggtgggaagaataagatagtaatttatgctgaatgaggtagccaaatataaatgttcaataagctatgggaggagtcgtaaatgttcacaaatggagaaacatgcacatgtgcaattgagcttcatgcctctccacaggacccatgttcaaaaaatggtgacaacagcatgaactcagggcactctctgatgttaaaaagtgaagcagaaggcatgaacaccctcactgcactgtgcattctctctagactgtctagaaccactccgtgatcagtggtctcttaggcaaaaaaggaagggcagcatcaggcgattggttgatctcagtggctaaatccttttttttttttccccctttggatatagagccttttggtttgttttctttttcctttcttttctttttattaatttccataggttatttgggaacaggtggtgttttcttacatgagtaagttctttagtggtgattttggtgcacacatcacctgagaagcatacactgcacactattcgtagtcttttatcccttaccccttcccatcctttccccctgagttcccaaagtccattgtgtcattcttatgcctttgcatcctcatagcttagcccccgcttattagtgagaacatatgatgttcacaaacacacacacacacacacacacaatggaatactactcagctgtaaaaaggaatgaattaatggcatttgcagcaacctgaatgagataagagattattattctaagtgaagtaacgaaggaatgaagtcttttttaaaaggactggtttctgtttaaccttcagggaagaaagcctaatagctgttagccacctgggaggggatataatgaggggtctgtaacctcctatctagtcctgacaggcaactcagctttcatggtctctttgtagcccagttggccaagagatggtctgttcagttggttgggatgcttagaattttatttttatttatcaatattatgattgttgcaatgaatgataatatattatcattaaaaataataaaaagcccttaattcagttaccttaattaggtaatttaattagaaatactcctgctagtattttgaaagatggtcttgaaacacagaagaaattatgtaaagattatagagactgtttatataattttttgatttaaaaaactcatttcaattaattggttttagtacaggtctcgtcattccttaagtactgctcttaattatttccttacttggattggctagtggtttttctcttcttatgaattttatgaaataaaccaaggtcaagtttaaggtagaaaaagatgcttttagagaaggcaaagtagggtcttaaatatggaatttgtatgacaacttatcttgccctttgcttctgtttcaggggtatacttcttataaaatatttgctgacaaggaagaaacacaatttcaggttcttgtaaatagccaagagtatttgtagtcagttttcccaaacgcatttgctttgtattgtacaaagtcgctattgtctatcattaacatatcattaacaatcatattatgtgaacacttaataattatgtaccttcatgctgagactccttgacttaccatatgtacaatgaaaatgttgaatcagcttttttagtacaaggtcattgacaggccatgtgggagacactgactgataagaatggaatcttctcactcagcccaatgctccaccaaagggagattttcagtttgcttcttattagcacgattcacaactgagaagtgtgaatgatcttatggttcacttctctgatgtgttggagttggcctgcatgggtttgcaaaagctggctcttaaaattttagaaaacttgccagctggtttttgaatacttggtagcttgaaattggttataatgtgaatacttacaccacagaaactggaaaatgcctctgcccttctattccccaaagatcttattgttaaacatttattagcacatctggtttacttccacaactttagtactcagctattaccggaaaagtccctgatgaatgtatttgttctttactatgaagtttcaagtgacagaaattaaaaaaaaaaatactgcagaaactacactgctctgggtataacttcctttgaacagttaaaaatttcccacagtctggccaggcatggtggctcaggcctgtaatcccagcactttgggaggccaaggtgggcatataatgtaaagtcagaggttcaagacaagcctggccaacatggtgaaacttcatctctactaaaaatacaaaaattagccatgcatggtggcatgtgcctgtagtcccagctactcgggaggttgaggcaggagaatcacttgaacccacgaggtggaggttgcagtgagctgagatcatgccactgcactccagactggatggcagagtaaaactctgtctcaaaacaaaaacgaaaacaaaaaatttctcactagtctaagtagatggaaaaagaaatagtttttttccaattatgagtttaccacaatttggctcttctaggtccaaagtactaacgctttctatttaaaatcgtatttcggaagataaagttttaaaaaaattttaaaggcaatgacaaaaaaaaagattttagtattattaccaagtgacctagatataaaattttatccattaatgcagcatcatgaacttcctataatttcctttctggtctcagatgaagggattatgggttattgccacctaagaaagcatgggatcagagtcttaaaataaatcaatattcatgtggtctaaaatgattcctcctgtaataaagtcgtaccattttcaatcaaaaatataattcaaacggggaattggcaaaattccaatgcttgctgtatggttagtggttttacaattaattccttgtatcatagtgcgtgatccttggattaatgtccctgatggttagtcattttgttaattcacctgtccatcaggactcaattgtgataccttattcttccttcagatggtttaaattttacaagagaatacaattctcatcttctaaaggtgcattagatatcgtcatctaccagggtcttatttattgaaagaccttccaagaaaataggaaattttcttcctctttctgctttttcaaaacagttcattttcatatatcaaaaccggctcattataacaagtgaaatgatagagatgaacagagaaaaagctaataattcccacctaagtccctcttaatgattacctttctgtcataacaactttttatatacatatattatttcatatcattttccaagttatagccaaacaaatggatataactcattatcattttgttgaggttttattaaggtagaagcacaaaataaacctcgttttatgagtttgtttcttttttttaacataaaatgtattatggatatcactcctgggcaatagatactgatcctactcattcttaatggctacacaatgttccataatatagatgtatcaatgttttcaactattcatttatttataaaccttcagattactttttcattttatctcttctacaagaaatgctgtgttaaagatccttgcctgtgtgtaggtgtgtgtgcatgtatacagttatttcagtaaaaaaaaaattccagaagagttactactataaatttttaagtaggtattaccaaattgtttttcaaataattgtatcagttgatagtctcacaagtaaacttttaggaaccatttactttcaatggccaaaagaaattgatactattaccaagtgatttaaatgtagaatttcaaccattaatacggaattattaaaaggatatgagaatgaatttctccacatgttatcaagtgctggattttattgttcctgttcatttttactggattcaaaagcccaaagtttgctattttaccattcaagcttctgagtccagcaaataccaattttaatatatgccaatctgataagaaaaacatgatcttcatgtccactagtgagatttaacatcttttcatatactaagagtctattttgaattttattttgtcaattatgtttcagttaattccctttaatcttttaatttttgagttttatttcatcttataaatttatgagtttcctttgtttatcaaatatattaacaatttgcagtatagtgtcatggttacaagcacagactggtgtcagactacctgccttcaaatcctgtcttccacatctcttaccagtgtgtctttagggaagtgtcttgtcttccctgttgtccagtttcttcatttataaaatggaaagaataccaagacctccctcactgggctgttttgaggaagaagtgttagctattaatatatacacattttccccttgtgattttgtttgtctttgaactttgggatatctttcattttaccaacttaaaggtttttttgttgttaaatatgtctaatttgttttatggattatgcattttctttcatttaaagatctctcccactcctaactcttttattgttcaggtattaactttattttttattttttatttttttgagacaaggtctcagtccgtcaccaaggctggaatgcagtggtgtgattatgactcactgcagcctccagctcctgggctcaagtgatcctgccacatcagcctcctgagtagctgggactacaggtgtgtgccaccattcccagctaatattttttaattgtttaccatcagttttataatttttctgtgtatttcctaagtttctaaataactagtaaattacaggataaccaaagctatgctcagtgattgctggtgctagattgcatatatgaaatagctgtaaaacaagaagtaattaaaatagtaaataattttcattattatagattttgaaactaaggcaaaattgctacattgaacattacaatttaaaagtacacatcaaagaagcatttattattttatttatttgaggtcattttcaccaaactagcaacttcatgggtacaaaaacattgaatggcatatagtttctgattttgtgtccctggttaatgacaggaagcacagaactcaaacctcgtacacaaggaacccatcttactatggctttcctatccaagcattgcctcaacaaaacgtactcacatttagcccaattcattctttttcaggcatgtggaataatgatattcagattttctatgaaaactgatatttcccacactcacttctttgcactgcagtttaagagtgtatgaacactacttaccctttggtcatccatgtttgaaagacatatttgggctttcacatttttctgtcacctagttagtgtaaaacttgtctgtattcctccagcttaattaagatcaactgtgcttaacaaagtcattgatttcttctttaacattaaatcgtattccaaaagaatcgccaacttctcttgatacatacaatttaattcaggtataattataacagttttatggtatattgtttttataaaattaaatagaatgtttcttacagaattttgtaaaagacgttctggttgtgatttctatagtaaagctgtcagaaagctggtctgtcgaatgaataagtgacattactgtagtcaaaactacacttttattgcttttacctccttgttgtatttatagtacctagtcataatttctaatttgacagacacttgagtcttgttgctgtactcagtggtgtttcttgtcactctctctttacctcaggtgctttcatttctgcatttgactccagtatctagaaaatcatacataatggcaatttacactgaataataaagtagacttgtgtgaattttttcttgagctattcattttgaacttcaagtcaatattaataatatcaacattaaaagtaaactaatttgcaactgaactttgcagcagggatcaaggaagagttttgcataaatgttactatattatttttcagtatcataaatttttgattgtttttggctatagtcatagtttttcctgtttcagatgatcacttttgatttccttcctcttctcttttcttccttccttcattttttccttcaatcgcttttcttctttgcatttcttgctctctctttctctctctctctctggtttaatataattgattgtatactcttatgcactcagaaaaaagtcttaaaacctcttatctgaactgatactttgtattgaagagagtaatatgaaaattgtaggcagaaattgaagatcttacctaattggatgttgaatgttggtcctcccttgtctcagatggggagaatataggtaacaggttttgtctatgttgaagtgttatttgtcactcactattcaattacagtactcatatatggctttaacctcttttaacctgcacaattacattttcacaactatagctatggtgccacttaaaatgtggttatttgtcttaaaattgttcaccaaatttcatgtggaattctaagcctgatctccttggagatttgagtcatttgataggtagaagttcataagtagttagcctggttctctcctgctgtgttcttctcttctctggcatttgccctgtattttaggaaattaattgctgtcttatatgtgcctattatacaagaataaaataattctcatatattcatatatacttatatataatataaatatatattattactaatatatatttatatattatttgaaaccttatatattcttactatatatgaataaaacactttctggagagaaaaaaaacagacatcagagtcgtgcctgggatagcctatttgataaatatttgttgcattatttcctacatgaatgatggcacaatacattttcttttaaagattagcatttcagagagatgctcagaccataccacttctaaggaaatgattgtggcttagaaaggaaggaaagaggaacaagaagtagtaaaggatggttaagcactgagtaagcttttttttcatttttgttatctggcataaagcattaggaaaaaacaactctatttttccagatgtcccagtctttcaactgacatatttacagctagagcacgcttattcatttatttatttatttttggagtggaggaagaggaggtagtcaggtggtttacaaaaggtggatttctaagtctctgtcaacatagaccaaccctgctggacctcatactttttccccttcctccctgtcatcctcatttttttcctttctttaaaactacattttgaatgtctacttgaatacctgttcaaggcattgatacttatcagtaaatacaatggccaagaactttgctaccatgtagtcattaccttctacaacaggaagaaaactaaaataaagcaaacactcaaataccaaaatttaagatagtaataattactattataaacagagtaatgagttaaagagtgatggggtgaaagtgatgttaagtgttgacttagattgactggctatggaagaccttcttgaaaaggttaattttgagggatgacttgaccaagaaagttcggttatggggaaatctgtggcagagggaagaatccttctgaggaaaggctgagtacaaagaggaggcttatgtgactggaacttggaaagtgaagacaagaatggtggaaagtgaagacaagaatggtagaaagtgaaggtccaggttttctaaaccttgaagactcctgtaagttcaatgagaagccaaagggctgttataatagcaaaacgctaagatctgatttgtagtttggatgctatatggaaaaggggttaggtataggttaaaagaatgagcaccgggattggggtgattaggtccatcagtaatatttgtgggcctagcgcaagaggaaaaatggagggaaataaatgggatggaaggttaatcacatgtcacaacaaggttggatcttaccagttttgtctaattcctgatatcaacttcacctctaagcagttagaagtgggggaaagactgcccacccgcttcctttgtccagtgaaaagtctcacacatgcgagtgaacactgtagctatttaggcaggaaattccatggtcctttgcatttggaaaatatggcagccagggaaaccttccccttattgctctggaggtttgctgcaaaaaatcaatcagaaaaaggtgaggggtagagctgcacaggaacaagtgtataattatgcagattcatttcctcaagtaatttcttggcgctgctcttagaagaatagatgaaagctctgtctggatgtggtgataactccaagtctcttctcaggtggttgatttttcctggttatttgatgagatcacttagggtgaggatttaagacaattgtatttcttttggaaagaagctttcttggtcagatgaggaaattccaaagagactctctccctgtaattggaagtggagatgcaagacaaggttagaggagcattgattctgagtcatcttcaaaagcctctcagtatatcagagtgccagtctttgggatattgctttttgagtcccaacaaaagggatggataagtgggtttgtgaactttcaaggatgtaaacacttggtctcaaagattccttgtcctgtagcataggataaatgtagaggtgggcaaaattgggcccagtaaagcctgaagcccaggggcacataccctggttgctgagctctaagggaagtgtcattactgataacattaaacatagagaaaagtagagaggtgctatgtatgtttagaagtaaaatcaaccaagttgaaaacggggtttgaggaaaatagacagtatgtgtcttcttagagcttatgatgtagcaaggaaaggagacgtaaggtcaggggaagacctgttaaaattgaatacagcaaagaaaatccctcctgcctccagtcctagatgcctttttcttgcagtatttttgatatgacactgaaataggactaaacttctgtaggaaaagcataataccaaccaaatctcaaatagtcaacataatacttttccagaaaataaatgggatcgaaggttaataacctgtcacaacaaggttggatcttaccagttttgcctaattcctgaaatcaccacatacctctaagcagataggagtgggggaaacactataacaagaataggttcattgcctgatgcacacagcaagtcaatacactaagactctgggttgcaacagaggaagaggtttagtcatcgtgtcactgaatgaagagatgggaagaaacctcaaatctatcttccaggggaatttggggttagggttttaaaggttttggagtgggctaaagtgtgaagatcgttgattggtcaaagagtgcagggagaagtcatgggacagggagaggaagaagctgtattttcatgctggtcccatttctctgagggggtcctccaacttgttgctggaatttggagtccaaaaaacatcttaagcgatagattcttaaacaaaagctttatgattgtaaagtcagagatcctgtctataggaacaatggggatgaaagtcaattcttaaacagtcttatgaccccagtgtcaggaatcctgtctgtaggaacagtggggatacaaatggtcagtaaccaatgctaacatgactttcagcgccaagaaaataggtcaaaatgcagccggattgatgcttaactataactatatttctgtccagaaagtggcatgcaattcttatcaaccctggggagggggcagtttcaagactaaagagatagggaggccaaaaacagtttgctcagaccatccaatgactggagctcagagtgagggctacagttccttgaaggactaggaaagcaaggaaaaaccctcttcatttatttaaaaactcattaattaattaattaaaactataccattcgaagtcactgctgggcacagagaagtgttagtggaatttacattgtttctgactttatcgatgtccagtgtaataaaggcattcagtgggggtgtgagggatgaagagaggtgaggctgagtagaggcagaaaggagcccagtggcaaatggccaatgaaggaagcaggccactgtggagtggggttagagtagaagcaagtgatgtgatgtgttttattattctgtactattaaatttttggtctaaatctccttgatttcctccccagatcaagaagttgatttcctgtctttgaggagcttggtcaagggatcctaatttcaaacattatgaaatgcaggggtggacaaagaagtacatcattattacaaaaactaatctagaaaatgacacagattaagtgtgcaagtaaagagaacaactgaggcatttatcaatattctatcccagaaaaagagaaacgttccagagtctcttgggggaggtcaattctcaggccagtggtttaataatacaaaacaacattaacatagcagcccatttcattaactttgattacactcctctggatgcttacttgcccttagtgactgttagtaagatgttttccctatatttattaggaaagcaacctttatgttaaagatctgcaaataaaataatgtgttgaaatatggggatattttgaaactgcttaggtatggtgaaagttaatgatttcagttacatctttataattactgtcatcaggtttctacctttatggcttcttaattgtttaaagatcataaaacagaaaatttagcacaagcttgagaaagatattttatggtataacataattttatattgatattatcactataaaaagattaacaatggattttactttctacacctttgattattattttaactataatatactatgtagtctgtagcataacattcctactaaacaaacactctgtttttatttagaaacaagcattttttaaggttttaacttttaccaggcttaccctgttgatgcaaaataaggaatggggggtctggtagtacatgaagggaaaaagacagggtgacacttcccactggggaaagtcaaatttacccctcagaaatgtggcagtgaagggttttgtttgtttgtttgtttgtttttagatagggtttcactcttgtccatctggagtgcagtggtacaatttcagctcaccgcaaccttgacctcccaggctcaggtgatcctcccacctcagcctccagagtagctaggactacaggcctgtgccaccatatccagctaatctttgcattttttttggagacaggctttcgccatgttgcccaggctggtctctaactcctgcgttcaagtgatcttcgaagtttggcctcctaaagtgctaggatttacaggtgtgagccatcatgcccagctggaatggttcctttcaggctaaataattctcttttggtcaaattcatttgcttcattctagtgtattgagactgtactcatgaaaccagatggctatcataatcccaaaaaacaaaatcctaaatataaatatcgaaatcctgaaacccaaattctggggaaggtattattgcattttcagttgtatgcaggatggttgcttcatgttagtttcatcacattaagtgaaattattactttgtgcattagtctgttctttcattgcaataaagaaatacctgaggctgggtaatatataaagaaaagagatttaattggctcacattctgcaggctgtacaggaagtgtggcgtgggcctctacttctggtgaaggcctcaggaagcttacaataatggtgggaggcaaaaggatagtaggcgtgtcacatggcaagagtagaagccagagagagaaaaggaggagatcttagactcttaaacaaccagatcctaagtgaactgagcaagaactcactcatcaccaaggggactgcactaagccattcatgagggattcaccatgatccagtacctcccaccaggccccatctccaggaccaaagatcacatttcaacatgagatttagaaggggcacacatccagaccatatcactttgttattgtttttatttggaaataaaatatagtttaaagacatatgtatgcataccaagttgacaagggctattctgacttgtgggacttaattttggatgtcaacttgagtggattaaggaatacctaaaaacctggtaaagcattattttgggtgtgtctgtgagggtgtttctagaggatattagtgtgtgaggttgagcagactagatgggacatgctgtcagtgttggagagcaccatctaattggctgggcctggagagaatgaatacagaaggtgaattgtctttctttgagacattcttctgctgccttggaaattagagctctggactgactcactaggctttggactccaggacttacaccagtggtaacctgggtcctcaggctttcagagccctctgactgagagttacaccattggcttccctggttctgaggccttgggacttggactgagccatactatcggcatcccagggtctccagcttgcagatagcctgtcatgggacttctcagccaccataattgcataagtcaattctgctaataagtccactatatctatatacatgtcatattggttctgtctctctgaagagccctaattcagatttggtactgggaaagctgaatatcatttcttcttactgtattccttacaacataatggaagagagctgtgaaattgttctcttgcaaaaaggctgtgataagtgaaggagtctacttaatggtaaagataaaagcttaaaagtgaattattattggtgctatgaaagcagaaaatcacttaattgaaatggcagagcaataaccagactgtcaagtggacagcatctacttacaaaatttgtcgatcacaaccactctgctaatctatatgccgtggtttaaagatcacagaagaggagaaaatgcaggtgaaaaaatacaagaaatctcccctgccaagttatttaatcatatattaattctactcctccacacataatgccaatttgatgtgctatgtatttcatctttgcatcatttccagtactgagatatatattgtacgaagatttttagagttttaatttatcttatacatttttgcgaaattgactccacaaaagtgagttaacacaatgttgacttcgtgtgtaagcactgtgcatgtacataaaaaacactgaaacttaataaatgaaaagatgtcttttttgtacatcggcatttgtgaaatacatttcttgatatcctggctttattggcaactgcatatggagtggtgacacaataaagtttttggtcaatgtcatcaagattttggttgtctgtcctggtatttcagatgaacacagttataaagctgggtgcacacaattaccaaccgtagtaatatgtatttatacatttcactttttaacttttttatcactatggtttgtctgctcgtaactgttatacccttatgactgttgttagtatacctgaatgtttatgcttgcaaaatatgtatgttattattgcctattttatggttaatgtagcctataaagtgttctgttgtgtttgcatattattctcaaatatctccctttaaaaatgtaaatatgtgtctttcaaataattttttaaaaatgtccagaattatatttttgaaattttgatcttttgggacttcagcatttgggattatggtgtttggaattatatcttttgtgactctggcccaaaccccatgaaaatgtgtgtgtgtgtgtgtggtgtattcatatcagggaaacgacacactagaaagtgtgaatttaagcttatgttcaaaatttcaactaccacctacgcattttataactctgaaatgtttatattcaaaacagtccatgccctctcctgagacccacacatatttcctagaggcagcactattgtggataagagcagggattttgaagtaagatagttctaaccgtgtcatatcccagctgtgtaaccttgtgtgagttactcacctctttgtgcttcactcagtttcatttcataagttttataaaaattaagagagttaatatatataaaatgctcacatcagtgtctggtaatagtgctatataaatgatcacatttatcattattaatatcatatcttactgtctattgcacatctccatcatcaggatgtctcacaaacaacgaaacttagtgtgttctcaaattaactttatcttctcgtctctacctctctcccaatcacctcctcttctgtatactatatgtatactcttggccaagtcagttatcttggtttccttcaaacattcatcactcccaattcctagggggtcagttattcttcatatactcatcaaaagcacttgtcttcccagctgctagtgctcgaggcagactggataccgtatccaggaggcatcatcatgatatcttcctgatgaccactacttccagaaagaaggcccttctcatctaccctttactctgtcaataggaagtctttcttaaatagtaaacagaaatatacaatcctgccactcacatacttagaaatcattctgtggatctccattctttacagaacatttgaacttcgtgacatggaatacaaggcactcatagtcacccctgtaattacttcatcagcagcctcttgcttttgctcccatctccagctggaccttgttaactcccttcacaccccatttttaccactcccaaacccttgccctaagcaatattgacctgacttctacccagcctccacctcaaaaagagttagcactcctctctgcgttttcttggcagtctctccaaaatgacttttgtcatattattttgttatttttatttatatattgatatttttttctcattttgactattagctctttgaaggcaagactataccgtattatttttgtttcctgatacttaaagtagagcctgctatacagtaggtgttcagttaatatcttttcaattagtgaagaaagtagtctgaggtaagtcagggaattgactgctgacgactaacacatcatcacctgcccattatttcctattgagtggacccagtcaactcatgcttttattttccagattcattgaggcgagtataatcaattcaaagtgacaggtaattcctacatacttatttatatttgtatgcttttttcctaccttctgatattttaaggatccacttatgaaataataaatttacattatcagaagaaacttgctatgaatagaagcttaatagtggattaaaggcagagttgttctgaaattttactttgcccttattagcttttgaccttaggataggtgtaccttctaagatacatctgaaaatttgacataatagtaatactttatttcatgattgttgtaagaagtaggataatgtatttgcagtacttagtacaatgttagacatgaaagtaagtatattgtaagtattagcaatcgttattatttgttcaactatagtagaagtatcctccccaattagaaagaaatgatacaaaattgctggtcaaactaagctatatatttttttctttatcatcatgaaaatggttaaatttggggcattttgaggacctattgcatgtctgatgctgtgcaagacttggaaaacatatagctatttacttatgagaataaattctttagtcaattagctcatagtctatggtttcaaaaatgttcatctttagaatacatattagaagcaaaagaaaataggaacctagctcaaatgtaaatcaaactgatgtatcagtagaacaaatcaccaatcaacagatacctgttgggtatcatgctatgcagaactcacaggaagaagtttcatgccattcagttaattattagagagagaaactggtagtaatcaaggtgggaaactgggggaagcaaatatagaccaccttgtgctttatgatgtaaaggaaatgagaatgtagaatagcttcatgtgaagaaagaggaagaccatcacaatgtttaaaatattttctttgttttcaaattatttaactaaaattgtctgcatcagtggaggaagtccccaatatttaattcagtcacccattcatttgttcattcattcagtaaacacgtactaagtatctaggcaagtagaatacactgaatcacaattgggtgaatgaatgcgtcaatagctaggactgtcctcggtgttggttacagccagtggagaaatcagacaaagtgccctcagaaaaaaatatattttcaaattagtagtattgtgtgttactctcaataaactatcaactaagatttattgggtagtttagagttggtggttgtgtcagtgaagcaggttgggttctcgaggaagcagactctgagacagagtttagcgttcagaatatttattagagaaggagctgaagcaggattgggcagagggagaggtcaagatgcactgcagcattggcagaccctccgtggagctctggacgtttaatggttacccagagttgtcctaccttgggtccaaatgactgggcttttataagagtgcctgattcagccactggatattgtctgctccagaagaacataactttgagtgaagctgttctctctcctggaaacaatcccttaagggcaaatagctgactatccactgacagccctccctgaagctggggcagcaagtccttccttgacaaggaagctgctcggtataacccgtgtctaccatagtcgctttaggtttcaggagcaataacctaagaacaactcaaattggcttatataataattagctcacataactgaaaagttgagaactaagtaaactttaaatgtggtttagattagagctcacatcttgaggtttatttcttggttgatggattgattgttcctttatgaaagtctggtcatacaaccatggaacaaaaatcctgatcctttccccctttttaagatttctaacccctaaggttcccttctggtggggcatgtcatgtgcacagtaagatatttgacagaattcctgttctccacccagtaggtgcctatagcaaactggaggcttccttgtaattatctctcatcctccctgaatgttggtggtaaatattcttaacttcagtggaaggtggtcacatcataagtgccagaagcagaattcgattgtctggtggacacccatgctgattacctgttctctgcatcacactagcttcacttaagagtcatcgagaaaggcaagaatcaggctgggcacagattttcatgattgtctccagaacagaattaaggagaaggctagaagggaaattgccttggtgccagaccacaaaagccactaaaatatcactggaaacagtttggaggaaaaaaatcactagaattcctctcagggaagggtactgcttgtggtcagaagaaatacttccatgagccacctgtcaagagaaagaaccctccgataggagcttgccagagcagcccctctaggtcatgtgagcaagtaaactacagagcatgagtttggatgaatgaggcctccactgtgagctagaactaaatcattcagtggtattaccactggctgcctttcttctcagccctgaaggcagcctgttggtgccagcattgagctttcttcttaaacatatgtcaaacaggtgtgttgattggagtcccatgttaccagctgggccaaagtaattctcaccctatctctcagcccatagggcttctgcatggatgcatcgtatgtatttttttttctttttgtattctgatgatgcaataaagcttaggcttcagaacccctcaccagtatgggacccctttaaaaccttgaaaggggcccagcaatttatacacatgtgtattaattagtcttttcttattgctgtaacaaattcccacaacacacagtgggttaaaacaccaatttattctcttatagatctggaggtcagaagtctaaaaccaaagtgttggcaggcctgtgtttcttctaaaggcttctggtggggttggggaggggtttttgtttccttgctttttccagcttctagaggctggctgcctgcattcccagggttgtaactccttcttcacatcatctcaaccttttacttccatcttcggatcctcttttgtccctccgatctcctgcctccctttataaagactcttacaacttccttatgcccatctcctgataacccaggataatcttcccatttctaagtgcttaatttaatcacatctgcagtcttctgttgtagatagtgacttgtaaattttgaggattagaaagtagacatcttggggaaccattattctgcccaccacaacacaatcatatgtttaagtacaatttgtagaagacattgcatacacactcagttaaaatggccatccctaataacttctgatgtcacactttacctaaggtttggtagtgttggatagtttcaagcattcagggttctaaggagaatttggtttgagaacacatttggtttgttttcatgggacatattgatcacagtcacagcgtgtatttttaaggtgttgctggctagctggtgtagtaatggcttcccaggagtagtcctactgcctgttatgctaactcactcaacattgtgccctgaagctacagggcacaatgaagccttgatcctggaccaaggatcaaattgcaataaaatcatgtcctatggtgcctggaactcttaagtatatagggagtggaggggaatcagtgttcaaaatacctggagcctgaaaacaagtctgtagaaaatgatgggaaccattagcaggttaaaaatgtaagtgatgaatttgtttttcattgacgcctggccaaaattatccttaattaaaaaccagttttaatcaaacatgctagaagacagactggactttttttaaaaaaattgtctttatataaaatgatattaccaaatatttgtcatctggcgtaacaattaatgagtatgcagccaaaaattgtatagaaaaattatttttaagctatgccaggcagttcataataaaaatattacattcttttgcttgtttatttgttttgttttgttttgattttttgagacggagttttgctcttgttgcccaggctggagtgcaatgacatgatctcagctcaccgcaacctccgcctcctgggttcaagcagttctcctgcctcagcctcctgagtgttcttattctggtttatgtgatgtttgtggtatttgtcaatttctaatatatatataagtatatatatatcttgtggttattttatcatcctacatatttaatacctaaatatctaactcttttttctacaccaaattgtataagcttcacatctcataaaattgggatccaacactggttacacttgtatcagtcagggttcagtcagagaagctgataagctaccgatcaatctatctgtctaccaacctacctacctataaagaaacatgtattataaggaattggcttgtgtaattgtctgtagctgctgactaagcaagtctgaaatcaacagggcaggtggttaggaagggaagatccaggaagggggaagcaattgtagaccgagttgttgattggaatctctatcactgggaggagcccaggccttcgtagggcttacttgattgagttaggcccatccaggataatctccttcatttagtggcagatactccagatactcagagactttcattatatatgtacaaactccttaacagcagcacctcagtttgtgtctgattgagtcactggcagaggtgtatgcatgctaccaaatgattgctcttccctttcataagcctagtctagcccagcggacacagcaaacacccatgccaacactcagtgttattggccaaagttgtctcttcctggaacagtgagagttggaagacttctgttgtcttggaattcatactcattaccttattagctgcatgtgtattttagctagtaaaattttacaaagggaagcaggtcaataccagtagttagccacaggggctgtgaagtcaaacagcctgagttcaaagccaggtttcatcatattctatctgtgtgactttaggcacatttccaaactatgctaatttttttcttttcttttctttttttttttttgagacagagtcttactctgtcacccaggttaatctcggctcactgcaagctccacctcccaggttcacaccattctcctgcctcagcctcacgagtagctgggactacaggtgcctgccaccacgcccaaactatgctatctttttttgagagtgtttatgttaaaatattttttaaaagtttaaacaagataatccatgcaaaatgcttaaaccagtatggatgacagtgcactcaaatgttagtagttaagagttaaatatcaactattttcaaccagagagcatactagatgcttttatttatactagttaatttggtctttataattagtgttgtgaagttattaaggcagaattgggtaaataagaaaaatactgtgagcattttcttcttaaagttgtagcaatatattcccgttttgttactttccataataagagtacatgtctagaatattttatatattactgaagcctgatatcatttttagtatattcttaattaagatgttttattatatgaatgttttatgaaatagaaacaatgtctcataaaaccaaatatctgcataaagttattacctatttataaatatttttattcactgatttttctgtaaggagagtaaatatgatcacaatgtttaatgtattactaaaaagaaacacatgatgtttaaaaaagttaccctgacatttttcaaactgctcttttatgcaaggcattggctgcattctatgttgggaatagagagcaaactactggaagagcaagaaacaacattataaacgggagatgctatagtactggcgcataataggtctacctggaatgttttaacatttttaatttggcctttataaatctacattgtgaacgagactctgttaagcagtatatgaatagattaatttgaaagttatcagaatgtgtaattgagaaaagcaccagtgttttgttagactagtctaggaaatttggactgtgagggacaagacactagaggcacttagaagactacagatgggtctccctaagcctgttttagaaacagtcttcaaggctagaactgagatgagtttgtgccctaggggaaggggccagtgcctctgaaatatctgacttcagttccttgctcaagaatggtgactgggaatcattcagcatggcttgtgattggacaacaaaaagcatgagcaggtactcttttatgtcaataaaatcagttgtgaccttaccagtaccctgtaggcaaaagacacaagagggtgattctccaggactggcttacttattcttaatgtgactgtgctttatgaaagaagaaaacttgtaaggcctacctgtcataattactgtggccaagatggcaagagaaatctcttatgtctctttacctagagagcttcagttaaatggagtttgatggggcacaaagtgttaaagggcaaggccgtccccacagaaggaaaactcatgtaccattaaagtctaaatgtctcaaatgagactatgtatgtgaaattaaaatcacaccattatagaactaatatgagcttattaagtataattagggaatttttgaaaccagaaaaaagaaatatcatgcatacttcagtcattcaaatacaatcactatttgattcattcctttaattttttttaatgtttatttcaattttgtaattatatcacataaaaattttgtacttttcaaagtatgatatacgataagcattttgagtgttatgctatgatatcttatgaacattatcttaatggctgcacaatattccattttatgattgcattatgtttggaactgtatacagtatggtctatatttacacttttggaaatagtctgctatatatctttttagtcgaattttcccccagtatttagcactgtacttaaaagcctagatgctagaattgaataaactcaattttaagccacttaatatttgaatgaccttggaagattatttctttttaaaatatttcagtattatcatctgaaaattaagataataatacctgctggcaggattggagtgaggttaaatgagatatgcatgaaagcaagatgcctgctacaaacttagtgcttgataaatggtaccttattattaagtgtatttcccttgggaaaagcaaaattattgtgtctaaagggtgtaaaggttttatttaatgtgtttcttgttacctactgccaaagtgtgttttcaaacacccagacaattaacagcaaacaaatcagtagacaagattttttagactctgttctgtgttatgaagtaaagtggcaaggcacattagaaggtaaccttacttgcaggagtagatggcagatataaattatttcaagtactatggtcccaaatatcaagattattatgttttgtttttgagagaacagcaaatgcaaaaggcgctggcttgagaataagcttagcaagtctgagaaacagaaaattgatctaggtggcagggacacactcagaatgagctggggtgtgacacggggatccaggctagacctggaggtgcccccaggtcatgataacagctcagatctggctcccagaatgatgtaataacactggagggtttatgcagagatgaggtgagtgttagaatcaggctgctgtctgctaataccatctcaattacttcttagctgtgtgagctgagagcaagttaactaagttctctgagggatggtttcttcatctgtaaattgatggtaataataggatctatgtccttgttttgttgtgaagacagaatgagatgcagcatgtagcaattctaaccactgtgcctggcctacagtaagaatttagtaagatttaacctcaggctcaatggcaaattttataaggtcaaattgattttgaccttataaattgattttataaggaccattgattttttttctcgaactcaaggagctcgctgccccttaatgggcattcaagtcttcatttgtagagaaagagaaaaactgtatactctcttataatggcatttctccattcctagttatcaagatttcaaaatatagtcatcccccagtatcaatggaggagtgggggattgattccaggacccctgtggataccaaaattcatagatgctcaagtctcccatataaaatggtgtaatatttgcatataacctatgcacatcctcttgtataatttaaatcatccctaaattacttatcatactaatactatgtacataatattatgtacatatttgttatactgtgttgtttcaggagtattgacaagaaaaaactatgtacatgttcaatacagacacaattgccctttttctgagtgtttttgatctgaggttggttcaccccatgcatgtggaacccactcaattcaagggttgtctgtattaaattgtaaagaccgactcaatcaggaaatttcagtacctaaataatgctttgacaaaaatgttaattttaaaatgtatgcatctgacttaaatgtgtttttatttatttttatttttaaaaatttcactcaagaagtatagaaagtgtgtttttaattaattaagaaagtctttacagggtcatttcacgtgattgagaggtaaggacactcacccaaaggcatagttataaaaaatataaatgaaactatgatatcaggaagcagtagtgcccacagaacaaacaatcacggggataatcagtaaatgtccaattccatcactaacttatagcctattttctgactcattcaattacaatgttcttgttctcaaattcaggtcaattttgctatcattccaatttaaaatgctaattttaacaaaaggaaatatgcttctctatgagcagaaatatttgaaattttttaagtagagatttttcaagtagtagatatttatgcacacacaaatgtacacacacacacacacacacacatttaatttgtcttccaaaaacataacatggcatcctactaagaaatacttacttttcctacctaattgtgagatccttattgttacttctataagttttcttacaaatcctacttgttctggccaatttttcagggtgatgacctatctcaagctgggtcaaagaccataatccttgctgcaggtgataaaaatgggaaagagaagctaacctaagctagtctgatagaggccattcttcagagttttgacctcgaaagagagggtctgacttttagctcttctctgtaggtacagatgtgaggctttagagaaatggtttccatgatcttgcttttggaagaattcaatctccaatagggagaatgagatcacttggcaaaggagaaaagcccacacaaatgatagaaagagaacacatgtctttcacagtctcaattccagttttctctgaggcctaggtaacatttctttctcatggttagaatggtttggctcactgccacttgaaactgtaggaatcaagactagttgaaattactatgccttattttcctcttttggtttctacttgccagaagattgcataactactcaacaactgccttttaaattaaagaatgagctctgtactacatttcaactattctttgaataactcttaaacatttggatatctgatatagtatgaacttgcactatctcatccaatctgagctttacctgaaagttggggctactgcctcagagggaccagatcatgtactctcttttggagtatatgaataagttgtataaaaataacagtatgaataaatattctatgcaaaatgaataaagggcctccaaataaaggaagaaattcaggagagtgacatgagactatgtaaatataaccaggaagacaacagagaataatatgttgtttgagaagaattataaaggttatttttgcctttttcttatttcaactctatttagggaataaaaaaatgcaatgaagaaataaggctactgcttgggaattgcaaatgtgagctcattttattttatcttctcttaaactatatatcataaagatatatgagagctcagaaatgcacctgggcaataaactattaggtttctgaaatgagttcaagccagggtatcaaagagcttattcaattaggacatagttactagccctcaatcagagattatggataatcaagtttgaaataaagactgttgacccattattaacaactgataaaataataaatttcagaaatatttctagtaatttctgtcaaaacatgtcatgagaatttttaaaagactagttatcactacctgaaataaattagtgagcactggaagtcagcataggcaccccaagaacccattcaattgagtttctaatcagttggtagaaactgtttcttatattctccacaatagccttttattaatacagattggaaaataaattttcaccttgtattttggggaggtaggaatttagaaagtgagtcctgtcctaccatggggaagggttttcaagtgcactgagtgaacaaaaatatgctcactctgatagattttcagtagaaagaaattattctatttttattccacataaagtttttattagaaaaggctgcttatttttatctaataggttttctgaatatattaccataattatctgatcatcccatttattttgctagatttcctgtatcagatcattcttgaaattttgcatttgatatgttgatagattcttattttttaagaactttttctatattcataagtaaaattagtctattattttgttttataccaccttcaattttgtggtattggtgtcactagattcgtaatcaaatgtgatatttgtagcatcagaattatttttcttatgagttatgtggaactcatctgtgaaataatctgtgtacatcttaaaatacttttgatctgtgtttaacttctggtcatttaattgtaattaaaaaatccgctttttattctaaatttttaactttgttaatagggattcaggtaatattcaaaatgatgtcaatctcagaagttcctctgattttgagatgatcacataatacaagtcagggatttagcaacagcccagagcttgtcatagtactaaaaggatttttcaatttgtaggactgccaaagcctaccacaagggaagtaccagtttatagaggatggggtgggaggaatattgagggaagtaaagatgagaaatggggaaggtaaagtactgatgatatttgttaagtgtctggatacagccattcctgaagcaaaaactacctcctggagtgttcatttacgtgagccaatacattctaattgttttatgccaacttgagttgaatttcttgtaaagtcaaaggatttggattaaaatattcttccctctctttctaggagaaaataaatacatattccaggcaaatgaaaaaatcaataatatagtttggctgtgcctccacccaaatctaatcttgaattataagtcccacaattcccatgtgtcatgagaggaacccagtgggaggtgactgaattaagcggcaggtctttcctgtgctgttcttgtgatagtgaatgagtcttatgagatctgatggtcttaaaaaggggagtttccttgcacaagctctctctttgcctgccctcatccatgtaatatgtgaattgctcctccttgtcttccaccacaattgtgaggcctcccatgccatgtggaactataagtccattaaacctctttttattcccagtctctggtatgtctttatcagcagcatgaaaatgaactaatacagtaaattggtaccagtagagtggggtgctgctcaaaagatacctgaaaatatggaagtgactttggaactgggtaacaggcagaggttggaacagtttggagggcacagaagaagacaggaaaatatggaaaagtttggaatttcctagagacttgttgaatggctttgacaaaaataatgatagtgatatgaacaataacttccaggctgaggtggtctcagatggagatgaggaacttgttgggaactggagcaaaggtaactcttcttatgtttttgcaaagagactggcagcattttgcccatgccctagagattcgtgaactttgaacttgagaaagatgatttagggtatctggcagaaaaaatttctaagcagcaaagcattcaataggtgacttgggtactgttaaaggcattcagttttataaaggaagcagagcctaaaagttcagaaaatttgcagcctgacaatgcaatagagaagaaaatcccattttctaaggacaaattcaagctggcttcagaaatttgcataagtaatgaggagccaaatgttaatccccaagacagtgaagaaaatgtctctagggcatgtcagacgtctctacggcagcccctcccatcacagaccagaggcctaggaggaaaaaatggtttcataggccaggccctgggtccctgtgctgcgtgccatctagggacttggtgccctgcatcccagccactccagccatgactaaaaggggcccaggtacagctccagctgtggcttcagagggtgcaagcctcaagccttggcagcttccatgtggtgttgagcctgcaggtgcacagaagtgaagaactgagcttcaggaacctccacctggatttcagaggatgtgtggaaatgcctggatgtccagacagaagtttgctgcaggggtggagctctcatagagaacatctgctagcccagtgtagaacggaaatgtggaatcaaagccctcacacagagtccctactggcgcaccgcctagtagagtatgagaagaaggccacaatcctccagaccccagaatggtagataacactgacagtttgtaccatgtgcctggaaaagccatagatactcaacaccagcccataaaggcagccaggagggaggctgtacccttaacagccatggggcaaaggtgcccgagaccatgggaacccatctcttggatcagcatgacctgatgtcaaaggagatcattttgaagctttaagatttgattgccctgctagagttaagatttgcatggggcctgtagcccctttgttttggccaatttcatccatttggaacagctgtatttacccagtgcctgtatcaccattgtatctaggaagaaactaacttgcttttgattttacaggctcctaggtggaagggccttgccttgtctttgatatgatgttggactgtggacttttgagttaatgctgaaatgagttaagactttgagaaaccgttgggaaggcatgattggttttgaaatgtgaagacatgggatttggaaggggctggggtggaattatatggtttggctgcatccccacccaaatctcatcttgaattgtaaattccacaatccccctgtgtcatgggaggaacccagtgggcgggtctttcctgtgctgttctcgtgagagtgaatgagtctcataagatctgatgtttttaaaaagggtagtttccctacacaagctctctctttgcctaactccatccatgtaagacgtgacttgcttctccttgccttctgccatgattctgagtcctccccagccatgtggaattgtaaatccattaaacctctttttcttcccagtctcaggtatgtcttcatcagcagcatgaaaatggactaatacaatcagttataaagaacctctcttatgtacataagaaaaatattgtcaaataatacaaccagttagatccaaatgatttctgataatatgactgtgacatttacagaaatttttattcaaagattcttaagagaaatttttgtataaattaaaatattgtagctagtagagtgatgttataccagaactattgttaaaaaataatagaggcttaattaagcatacatgcaaactgaaagggtggataaaattcagtattagtgggtggacatacaggagagagaaggatgctgagagagtccctgggaataggagggatttacaattaaagcactgctgggggaatgaacctcagggcaatggggagaagaacacaggggtggcccacataggcaagtatatagtgtcatatgccagtgagaatggcgctgtctaatggcttcaatattcggtgacataatctgcagggtcagagcatatatgtggagactgaagttgagggagaatggaggatatctgaaacagtgatgatgatgttcccttgatgttgctttccctgtcataatggtcagtaatcaatcctattgtgtaatgctcttcaataaacttaactgctgtagggcaggtacaggaaaagcaggttcttgggatcatccagacctggagaaattcagaagtggagggaaagtataaaagcctagaggtaaggaattctagatttttggcagaagggtaattcgttgaataatgggtcatggtatgtcagtaaatgaggaaagtgaagaaagaaggttgacatttttttttcaaatgtagatgtttctgatagctgtaagatataaaatcacttacaaaaattacacattttttaacagccttaattacaatcttatttagagcaacctgtgttttgattaggtattgtttagagaaagataatttaacgagatcgtttattcttgagtaagatttctgaaataattgaaaggaagaggaagataaaaccttgtggtgcctggtgatatagcactttatgttctgctcaagttcaaaagataacttttttaaagttctgaatttgaaaatatgatttcaaaatacttaaaaaatttctgtctttgcaattacatttaaaatgttgcttcttcctaactgtatatttttgaataaaagatgttatattagcttccccaaggttctctctttcttaagctaatcagtgggattcaagtgaaattaggtgaataaacaattaaaactacttaactgtatcaatataaataaaaatacctaaagtgctattcaccttaaaagtatttccagaaaaaccgcaagggtttttatcatatgacctctaattgaattattgtgctcactcttattcaggttaaccagttgaaaattttcttagaaccactttgtattaaaatatttctgtaatacataaataaggctaataagagcaatactgtaaaggcattactctaattaaaaaattctatggctactgagagttaagaagacataattttatcaattaacgttaaatgtttacgaacttagtaatgggatagtgagctccatttggaattccttcctgtctaaatatttaccattattaaggtgaatctcagtgtgatgactaactttttcagacttgctcagtaatttacaatatattattgcatcaatgacttgagcactgcgggaaatcaagtttaatcagtatattttgtgctaggaaaaacaaatgctaagctttatctccctttagcatagcatgtgcttactagaaatgctcaattaagaactttgaaaattgttggtcatgcttctaatttgatgcagcctctaaagaccagtatgcaagagtctttgaaattaatatattgctgagaaaataaaattcttcttcatttgggctaggaaaatgtgttttatttgttttcctaccattctttaccagaggaaggttttcctttcccttcaatattacctaaatattttgcaatcagataaataaaatgataaaatgagatgttagggcaatataaaaaaaacacaatattgcaatttgtctaacacgatttttttttttttttgcagtttgttacctctcttacatattttctaactaagatttttctattgcctctaaaagtatgtccagtattattttctcctctgtaagggattaaaataacaatttaagaagaaggaattagggagtctgagaaatacaattggtctttctaacctcccttcttctttcttccaccatttactcaaaatatttcaaactttcaaaccatgatattataagatatataaaggcctactttattcattcaggtagattaaaggagatggagtatggggccaattgtttattacggaaattctgacgtagtagttgtagttcttgttactctttttccatgcttttatacttctaatttttaaaatccataactctttcagctttgaatggctcaaaatgtacctgccacttttgcttttaagtatatcaaattcccagtgatttgtcaagatatgtgtatccatttagcaacaaataaatttcatagaggccacaaaatatagaggcaccatttgtgaatgagggataagataacatgaggttcttgcagttgttctagaacatggctattagatgttctaaccacagctgaagcattaaatattacatggtcatttttttttctacccaggggcagcctctaggctaaatgttttttattttgacatttcctttgcagttctatgtttagcaagtaaaaagtaaaacataagatagtttggcaagtgtcacaaattaataagtaaaataccattaaataaagacctgatttgaatacagagtccttcactcttaggcaggtaaccctttggtaaatttttcaatatctggaaacttgacttatttactcaacacctgttaaacacttactctctgcaaaattctcttatgggtgatatagatactgcagtgaatctgcctttatgaagctcacattccagttggggcagacaggcattaaaaagggtgaaaaatacatgaaatttagataataagtgtaagtcaaaaaacaaaaacaaaaacaacataggagacaagaactaatataggaggactaatattttagatagtgtgtgccagaaaggcccttctcagaggtgacttttgcgtaaacatgacttgccgatatccaggggaaaagctttccaaataaaggaaatagatgtccaacaactctgagatgagatcaatactggtatattcagggagcagcaagaggcccatgtggccagtacactatgaagagtattaggagataaaaagaggaaaatagagaatcatcagggaactggattatggagcaccttggaggttatgagaaaccatgaaggctttgagctttggcatgacaggataacttacatttttattttttttttagaatgacacaacctactagaatgaaaatagagtgaaggtaggctagtcctgaaataaggaaactgattagaaggcattgcaataatcaaggataaagatggtgccttggaccagggcagtggtggtggtgacaggtaatcaaagattgggtctaatttgaagaaacctcaatcaaatcctactgaagttaattagatttgcaagactattgtgtttttgagagaatgagaaaaatcacatagcttcagtctcttcaccttaaaaaaaaaaaagtatatcatttgctcatttgccttgtgggttgttgtagaaacatattataaaaattaaataaatggtagttattatttgagctatttgcactagttatatttagactatgccaaagactgaacatgccattttataacatagcttttaggaagtaatacttccgttctgagagcaggaaaacctctaattagctctttatgctcaagaaacatttcttcttctatatttatatgattttgattagtaaaggttatgatctgtagagatccaagtgactcttcataattgagccttttatccatggaaggcgtctcatccagtcactttccatttggttgaacatcttgaggaagagtccctttcactggtgaacatagtgaactattcagttctgcctcagcatgctcaatctagaaatcccaaggaataggaggtgacatcgaccatgaagagctgccttattcttataaattttaagtgcattttgtagcaagttaaagcagggtgttttgatgctttttgtcataataaggaattccccacacatcccctacatttttaggaaaaagtgtctaagtcctaaatatgtgctaaaatccatctacagaaatctatcaacaactaaatgaatagataattttctccacactgaaatgtgaaaagcttgatgcattccaaatatttttgcttgatatatacaatttgataaggagaatctacagttgctattacaaagctaggctttcagagataaagaagagttaaccgagggatgttggagcaatagagatgaattgggctttgctatcctgtatctaatagagccaagattgctccttagattgagaaaaaaagtcagccttcttcagggacactagacagctcagggctagaaatttgaaacttattcagtgccaggaatatagaaaataataattagaattgaaggcagaactgagtttaattagatattaggcagggtaagtactgaacagggtcaggtgttcttcagaaataactctggatctctccaattagatatactaccctgccccccaaccaggtgctctcataacttgatgtacttgtcctttttagagtaacaaatttacatttattttgttatttgatcaatattgcttacttccaatccattctaggtctataatttcccctaaggctggtttagatccccattatgaactaagaataagcacaatacatggcacatataactcaatcacttatggaagaaagtgaggaagagataaaaaagaaaaacaggtcatcaacatttaagcaaattaaatgaagaccatcctgagatatagctggggattcacataatctctaacatagacatctttggaaaatggacttttcttacaccccttcactattttaaaatctaactgctctcattctttactccttcccatgtctattgaccaaattgttcatcttgttgtatttgggtgttatagatcatgttgtcaatgacctatgaaaagcaaatgaccttattttcaactttctatactttagtttcttctctgaaatatcccttttgtctgaaactcttcctttcttcaaatccaagggaacatcttcacttcctttcaatttcataaatttacctaaattatttccaggtttcctggaaactctaatattcacccattctcataattatttttgataggatatgaagtaaatgtcagtttatttttctgcttataattttgcaacttaagttatatcaatagtttaagaattatacaacacttatctaccaaaatattacccaactttgtgtgaagaacattggtaaaagcttcctacagattattaataaatgccaactaataatattacgctgatgaaagggaacaaatgccaaatgacaactcaacagccatcctaaattatattaaaatttgaatataaatagatgttcaaatgcaaaatagataatttttatccgcatatatttactggttaggcttttttgaaattacaattataaagtaggcaaacttggttataagcatttcttatctgatatattagtgtttttttattatttttcttacaagcacctattatagtaatgttctctattttccatttaaatttaaattggatttaaattttccatttaaatccaaaattcaaagcaaaacaaaatacttttaatataaattacactaaggagtagaaaattatattacacagtttgttgcatcacccacatatagtaaaaataataaaactagtaactcttcttctttgaaatgccatctatcactaggttgcagatgaggtagaggtggacttattcctgatttcaaaatcttaccattattctccttcttattaaactaacttttatgactgatataagtggttaaacacaaaataaatcaccagctcatttgtagctatcatttgcatggtacccagggaatcccacactattcaatggaagacatgtgtagcgatctaaataagtgtaaaaatggtaattcttctggggtgcaaaggaaatgagtgacctaaagagaatttttgtttttctactatattacttgtagttgacaattcttttaatatttgatatgtagataattacatattattggcactttgaagattgatttttactattaacagaaaaattattttaataataatctgtgttttgttcatgtaatattattttgagtaaaggatttccaagggcattttatttttgtaaatgtcctttgaagttttgtaaatgccttttgtaaatgcctcttgaaataaagatcccctttacagcaaagaagactttaaagaagaaactatgttttgactgccacaaaatttgaaattctgctaattaacctagaaacagaaaatatagcttactgttatggaatctatttttacacacacatacctacacagtataatattacaagatttttggaatgactatgtgcaattatttggactttctgaaatatcatgagctctacaagaaacaatacatgtttataatcatatctgttaataatttctgttcctttctccaaatgcactctcttggttctgggtttctgatcatttgggggaatgtctataatgttagtggctcagcaggatcataaataaataaaagactaaggcaagaataaatggcattgattattattgtacattcctaataattttataatatatattcagaaacacatgtgtttgaggatgtacctaactttatatgtctgaataatacttactcatactcaagcaatattccaagtgtagcaaaaccgttacactttggaaagaactgaaaccaatataaaaacaaaatttcatataacttaagtacaataataaaagtgaaacatattgagaccgttaaactttgaagatttttttttcagaaattaaaagctataacctatggattaagtttatacctgaaaaagagtgtatttcttctatttgtctttgtgttgcatcctaaaggattggacgatataaccaaatggctccaaatatacttcagatatgagtaggacccatttaatgatgcctgaggcctggagtcaatataacactgtgattttagccacatgattgtttcttcattgggttaatttacaaagcctcatcagaacagtcaaagaaatggcagaagctggggatagatggaataggacaaagatatctagacaggatgtaggtctggcaagtcttgatgagctgtcaagctatctaaatcactctgatcaaaatctgggtggacacacaaagaagcttgatctataggcagagcacagcagatggattttctcaactgtagcaatgccctgagttatgtgaggagtatgattctaggagatttgcacagccagtgagaatctgttgccagtctcagggagtgggagtgggaagcagaatcttagaatccttagaatcttagaatcagcaagctgattgaatttcaagagaaagctcaaatcctaggaggaccaaccatagtgaagtcaagatactgaaagagaggttaaatggtacagtgtaaaccatactataggtttaagcagaagtctacagaaaataactctcaccccaggcacattggataccagattatatcagatttttcaggtattggctgctaataatatttcccactgtggcaagtgtttacagtggtaagcatggaaaattggtttcagtgacaccagcaaatcagcttattccattagtattagaactctaaacaattatatttatacttccagatctgacttagatttttgtatcaacaaggtcaggtatgaaggatacattgctgacactgatttcttaatgtctataaatgtcttcaaatgtttagataacaatagtaatacacacacacacatatttaactacctacatagatataaaacaaaccatcttctttaaaacaaatgagttctctaaaataattactatttatatgatttctatttttcacatttttgttctattcggactggatttttacttcttcaataaaatgttatttattactggtttctaataagtaaaaatactatggtgaaaaactgcagcatgacaatttctataaataatcatttataaaataatattactgaaagaaaaagacaaatatggactttgaaaaattgccctgtagctctttttatttcaaggggacagactgtttctgtacatggtttcattttccttgaactttctttaggttaatctttccaaatcaagtaaccctgttcagcattcattctgtaagtttagaatatgctcgccaaatcaaagctcttttgaaaaatcgaagctgcctttgttggggaacattcataaattgacatgttttctatgtttgagattttctactttcttccctttcacctgcacacttcaagatttattacagattgtcagaagaaatgattgccttcctagttttatagaactccaaataagaaatctaatttgttgtttctcttggatccctggttaaagtttctgaatagtttggggcagaactctttttcctccataagtaagcctgttttagtagttgaaaaatgttcttggagttgatgaattgaagtacaattttttttctgcttttaattgctccccaagtctgctatgttcactctgcaagagtgagtattaatccatggaaccgtggttaattgtgaggtgggtaaattcaatgatgtttggatatttcacttggatgcatgaacactctatatgccactcaaatgacctcattccatatgccttacaagtgtctctgtgacactctgcaggattttttgtctatgtgcaaaggaggcacacagctgttaattgacaaggtaagtaattgtcttctgattacagtagttaaaggctgttctctaatggattttacttgtcacttttaattctttttaatctttgtctgcatttcattagaatggctttatcatttggattgccctcctgttggttattctgataagatttaatgggttatcttccaactatgacaatccctcaaaaatataatagagtgatatttagattcttccgggatttttaaaacacgattgcttttccaacccattttttctcttttacacttcacatttttgcaaatcaagtattttgcattttctacatgccctgagcaagtttctgctttaatcttccatgacttaatctattgactaaataggagatagttggtgaggcagttaggaaagagcctgttatcattttctattctgcttacctgctgtgattttatttatttatttatttaatttacaagcaataggctttaactgcagttttctaagagatgattcaggtactgacaaaaatatttgtaaaccttttaggatctggggataacagaaaagtaaacttgtaaaaatggttcattatgcatttcgtgatgcagaaatgtaatgttaagtcatcatttattctataatagagcatttttaggttttgcatatgttcccctacctatgaaaatgacaatttacatacaaatgcatatctttaatcatatctcactcctctatagctagtgcatttaccaaacagctctttataaggtgtactgtaattactgaattatgcagtcaaggtgtctggttagtggaaataatttattgatgtaataacaactattaaaaataaaaactgcaaacatttgtgggaaagagacaagatagaatatctggcctttttaatgtttaataaattgggataaattgtcctaccttggtttcaaatacaattgagtcatttaacaatcatatttggcaaaggttgtatgatgctgaaccatgcagcagatggtggaattacagaatgcaaaattttatgggatgccttttcagagtttgctaaagtgagatctagtgcatggtttttataataaattaattcttcctagaagcttgtgtgtaagtaatttgacaaaacagttataataaaaatttgtctttgtataaaattgaatctatacctaatgctaaatgatgagttaatgggtgcagcacaccaacatggcacatgtatacatatgtaacaaacctgcacgttgtgcacatgtaccctaaaacttaaagtataatgataataaaaaaaaattgtagtgccaaaaggcaaaaaataaataaataaaatacataataactttttttaaattcaaaaaaaaaaaaaaagaaaggaagcacaattttcgaaggactcagtgcactcattggtttttaagatgtaccagtgaagtggtaagtcaaaattggtgtatatttggaagcttaaatgaatttcatttttggtaacgtaactaagagttttaaagcataagtatgaaaataagtaagacaaacagtgatcattttcaattcttgatttgcccttgtttaaattgtagctgcccaaaatggttgtgtgactctaacctcaactatcatatattttctgattataaaaaaaaagggtccaaatgttaagtactaaatgtgcttatgagatattataatgcttcaaagtcccagaagtgacctcaaatcatttgagtaattatgtagaaaaggaatacataaatattaacattaataacacataaatacaacatcaaaatacactaagtaaatattacagttatttaaatatgcaagtgctttgcaaatttaactagttttgatatctctttaaatgatttttattcatagattcaccagaaaatcatatatttgattctatatgttagtgtctgttgaactttacatattaaactaaaattttgttaaaatgtggaacccattggtagaagacattgactctcaagtatttcatttatgtttatcttctgtgtgacacataaaactagtaattctactttctactttctttcttttcccaaatctttcattgctttcttctactttcctaccgtaagaaatatatgtactatgtactgggcagagtcctctcttcttggccaaagctaaattacaagaggttatacaggaaatgtccatgttcaattagaaaatctctggaaataaagatctctcaacaaaatcatggtagtgttatgtgcttatatatataagcttacacatatatgtatataaatatatatatatattaatttatttcgtttccaccataactcttcaagagagtatatttgattttacagacaagaaaattaatttgcccaggatcacacagtttctaacagaaagaaccacaaacccaacccagtctggctgaatcaagaattgttcctctcagtgttctgttctgattctctattaagtttatagtttcatgattattactgttaaaccttgagaaataaggccaaactgaaaggtggaaatatctagaagcaagaactgaccctcagataaacactaaaagggaaatgacatgtaaataaattcccatttatgaaaacctagaaaacaaaggcaaggtggatataggagctgagaatgagatctggaacccttaaaaagtctagaatatggtagccacttgaaatctataacaagttattgcttatttgtgacatgctttttctcacttttgaaaatgctttgtaattaattttcaaaaagagcaaagcaatgtattgtgagtcagatctatgagtaaaggccccatgtaataaggactggattcagtttattcatcgccctaggtccttgcacttgccttgccttgctctctagccagaatatccctggtactaacttctatcactcctgcatcctagataagagtcacagctgctgtctctgatgttgctcttgtttgggagcaaaccccctgtcatgctccatgtcctctacctctgggcttccttgttgcctcagaccacctctgcacagtatggacatgctgagagttaacaccttgtggaggcaaacattgaacaatgtgaaatgggaggcagttgatgttttcttccttcttcttcccctagctagattttcaaaggtgtagcagctacataaagcctctctaaagactgaacagtcgtcctgctacagaaccatggccagcccagcaaggctctccttctttatatttgctattccacctcccttgccacattcccctttgctctcatttctctccatgtgctcctgggtaaggtgttatcacataagcctttttttcctttttttttcttttttttttttttcctagggagtctaaggagagctaaagtatagcatactagcttaaatgtagtttaatttctatgaagattacatgcagttcccttcaaaagttttccttaataactactttttattgatttttatatgattaactctatttctcagctcattgctaattcttgaacaaggaattcttcagtgttaaaattaccattctcttgatgtaacaagacataatacttcattatgttgtatttgttacctaaaaatgtgctgtgctcagatacagatggctatgttttcggaaaaattttttttcccatttctctgaataggtatatatagaatcacatgtgtaagtatataatgtttatatgtatatattaacctttggcagcaaatgttgtcttaacaatttcttaatagcctcctctgtaaaatggaaatgagtggtaatttaactcaaccactttaaaatgcttcataagaggtagagaaaaaaaatttttttttgcacccacacataccaatacaaatgcacacacatacccaaacacaccaatcacaaaagcagaaacaacatcaaacaaaacatctaaatatattaaaatttaaatattgaaatataattaaaatgaaattaaatttatttttaagtcaaagttattttagtttgatacttgcctgaaatgtgcaggtggcaagtacatatttaaaatgcaggtgttgtattttctgctaactttacttttgaaagactttcaacatatcatttcttatggaaaattatactcaataattctcagctacacagcattgacttagaatggattgtaggctgtgctaactgatatataaggtgaagaacccaaagatctatgtgtttgaattgtttaaagagaaaaaaatagcctaagattttttctcaaattttaaaagtagttgttacatttacggacagtaaaataaatagatctggccattacaactgtgaaacacaataggaaaataagcacaaaggatattcttagtttccaacatctaattgcaattgggctttctcttcccatcatcattaattaataatagataacatttatgttgcatgtactgaacatttctcatcacatcctcaatatttaaatacaaagaataaaaacttcactgggataccatttttgtctgttttgtttattgctacgtctttacctcatagaaggttcctggaatgcagtagatgttcagcgaatttttgtggcctaagtaaatatgaaaattttttaaaatgctagaaaaaaatgtaagaagaaatgaaaagtttcaggatagaataagagagacttgggatgtattttcaggatgtgattagttagttcctctttatctcctaaataaatagtacaatgtttggcacaaaggaaaataatcaacatgtatttgataaaataaatgtaacccaaaatattgtatataggtatagttttagtttgttgactacttataggtatttagtagcctcatgatgattattggattataaagatgaaaaaataggaaattcagcattactaattgtctactttattgaaaaaacaattacctagctagtaatttgaggactttggactgcctagccaccagtaatacaaatacacagtttttcaatggctttcttccttttccccttcaaaaaatacaaaaatactattctggtctttaaagatttttaatttgttttggcaggctgcatacaggcacatgtatgcaagtaaaaatatacatatacccacagagagtataaaggaactgaaaatatttaaaaagctattaataaagactgatacagactataccaaatgcaaaaatgctgagaactgcacacgtaattaaaaataaaggggtgatcagaatcaggcaataagtaacacattttgaggaaagtttggacgtaagtattgagtatgtggatgagctttccatacataatgcttcgtctaaatttatctttcctgttttcttcttccaaaatttacttcattttttatcagtaaatttaatgatagcttttgtcattgaataatatgaaagattggctttagcaaaccacagcatatctaaaaattcatgagtttagggatgctaattatctcaggataataatgccagctaggaaaaaaaaaaaagtaaagtctttcaaattaagtgacttagatgtaaattagatgtaaatcacacatcattttaaagagagaaaaacaatttcctttcaaacatggtgagacctagccaagtcagcaacagaaacaaatatgtagtaacaggtggcaaaaagtttattattttacaatatttctctattagatttgcctcaatttcttgggttgagtattttcagagctttgaatgaatactggaatttaaacaagttttctcggtaaaagtcgaaagtagataactagcctcaggaaagctaaaagtgtgtgcaaaagggaatgaaagcatgatatggtggtcttggtcataatcaaaagcaaataaacaagcatttgattcctgaggattttaaatttttcaaggatagacaatacatcccacaaagagcacaaataaaacatacttttatctttccactttcccttgtgtggctcattctccctctcactgtaaccacctacaaggattcagtgcctttctatggcacttcatactgagggcttccctcctggggttttggtgaatgagtgatactatgagtttcagaggttttcttctctccttgtctccatcaacatgtgcctattcagagtcttgttttacctccttgagaaggcagtagccgtgtaagttaaggggaattcttatgcacagtttttttttattctttatatttacttatatattcaagcatttatttacatctgttaataaatgtatctcatgtgtcttagtttgtgtaggctattataacaaaacactgtagattaagtgccatataaacaacaaacatttatttcccattgttctggaggctgagaaatccaaaatcaaggggccaaaacatgtggtgtctggtgagggcccttttcctggttattagatggtgccttttagctgtatcctcacatggtgaaataaacaaaggatttctcgggggtctctctacgggcagtaatcccatatgtgggctctaccttcattactaatcacctcccaaagtccctaccttctaaaagcattgctttaggcttaacatttcaacatatgaattttgggggaacacacattcagacgatagcatcgtggacacttacgttatactttggattttactctaacattgatttcttttcttttctgttttttttttttttttttttttgagatggagtctcactctcttgcccaggctggagtacagtagtgccatcttggctcactgcaagctccgcctcccgagttcaagtgattctcctgcctcagcctcccgagcaactgggactacaggcacgtgccaccatgcccagctaatttgtgcatttttagcagagacagtgtttcaccatattggccaggatgatctcgaaatcctgaccttgtgatccacccgccttggcctcccaaagtgcgttgatttattttcttcctcaaactgtaccagctttggctattggaaacttttgcaattgtctcctcagctcctttgacatattcccattattgtgattatgattatttttgaacacttctttacttgctcacaccaaaagatggtacagttcatcttatacatttttaaagagtcctggttccttttattggagggtagtattagaaaccaagatctgggtgctagatgtattcattgttactgaggtattgttgcttctaggccctttttcctgaaagagcaagggaatatttatgtatatactaaatcatacatatacatatattcataaatctgtatatatgtaaccatttgtatttgtatgaaaataaaaatgagttcatattgctatttccattgctaatccattactgcatggattgttccagctatctcccttaacttatttgtagcctcccactctaactctgagaaaactggctctaaccatcttccacttatttatctaactgttaaattctagtatacataaatgatgcttttaaaactgctacctgtacctctgtgggaaacaccttatcaattagagtatagtgctgtgtatactaccttgtgccttttgtcttgatgaaacttccatttccaaagttatttaggtaacttttcccttttcctctacccttttcagtgaggttgtttcataattcctcatacagtgagattcttttgtcaaattcagcattccatgctgggatccccccaaaacttctaaaggagttttaaaaaatttgtatacatcaaggttcactctttgtgttttaaagttctaggtatatcaacaaatgtaaagtttcatgaattgaccactatggtgtcagacagaatagttctgttaccctaaaaatgttctatgtgtatgtgtgcacacacacattgccctgtttgtacgattatcttaaagactaacattggtaaactcgactctgtctttggccaagaaaacgttcaatctgcagacttctatgcattgaagtccatgtgtctgaaggaactgccaaattattttgcaggtttccttggggaggacccccttcaacaggtatagaaaggtccaattatccaaggttggtcatttactagttcagatactgaaacatattttagctcaggcattcaagcaaatgaccacaatttacctggaagtgagttagaactttgagaaaccactcaaattgttgtgggatagctcccttcactactgattggcagcttaccctgagttcacagggctcagaagcccaccaggataggtgacctactgttagctagttaaatgtctttaggcaataattccatatacaaatagaaagattttagtcaaagaccttacaaacactttatactattgtcaaacatttgggaggacagaaaaatgaagatgcggctaatatttattgcaagctattgaattgtagatatcattctaggccatttaggtcacatgttcattctaaaagttctaaaaatctcaagtaacaaagattttactttgttgaaccaatgtcacgatgcctgtataaatcattatctcccttcttctgaatcagtactgtgactttgttttcaaatgtttatttaacctctgtatgtgtgtgtgtatatatacatttactttctttaaaatatgccatatcaggaactctttccagttgtctttttgaggtttcctaaatgctgagaaagtctacctttcttacgcctactaaacattgaattgtctgctctttcctgtttgagtcatatgaaattgcctccactgctgtccataaaacaaatattggagaagatatgggtacactcacttttttaaaaaaaaatcctggaattttaatacgttagtcgctgagatgcagtagttttcctaccctgattgatggaaactcttctcctttgctacagtgtgtttctgatgaaaaccaaagagttgtttatacatttttttttcagtttgtagactttttcaaaacaaaaatgatgattaattttcagttaaattctttattttgcttatgcaagtattgataaacctattcacattaaaaagtcattacatatggaaatagacctaaaaagaatagttgccttaccgtgtcaggatttgattcaattaaaactgattgagtaactttggaggggaacagcagaaaatcatatttgttttaaagttgagtccctagcaatatctatcatggtcttcatttattttcaataaatacgaaagttaaaatgtaagtattacccccaagaatatgaacatgaaaactcttataatgtgctcttcttgtgatacaatgtttttgctatggtttgaatgtttttgttgcctccaaaattcatgttgaaacttcatccccaatgaaatagtagtaggaagtgtggcttttgggaggtgatagaagcatgagccctccaccttcattaatgagactaaatgcccttataaagggatttgatggagaggctttgtcttttttgcccattccaccgtgtgaggacacagcatttcttccctctggaggatgcggtcacaaaatgccatcttggaagcagagagcagcccttgccagacacacaacctgccagtgacttgaccttagacttcccagcctctagaactgtgagaaataaacatttatttttttgtaaattacccagtctgtggtaatcagttgtagtacacaaactaagacagtgttgtattttatgtaactgtgcaagagacaattataacaaaatgagagcatacattgataagatacatctgaaccttgtctggcatttggattagtgattatgtagtcatgcacaagtctaaaacataacacaggtcagtgtaaatcatcagtatgtttaataataaatttgtgaaggtatacatatatgcaatgggaacacaggaaaaactctgttactagtttagcgtaaaactaaattatcagataattgcaaaaattaacaaatgagaatcccaacaagtcaaaatttggtataaaatatttgcatttacatttgtttcctgttaagtttttaaactctttaaaaatagatacaaaaatatttttagttaaacctttgccactcccctagaacttctctatagaactcatcaacagtgcatctctatagaactgagtttgaaaatcaactcacgcctgtaatcccagccctttggcaggccaaggcaggcggatcacgaggtcaggagatcgagaccatcttggctaacatggtgaaaccccgtctctactaaaaatataaaaaaaaaattagccgggcatggtggcgggtgcctgtagtcccagctactcgggaggctgaggcaggagaatggcgtgaacccaggaggcggagcttgcagtgagtggagatcacgccactgcactccagcctgggtgacagagccagactccatttaaaaaaaaaaaaaaaaaagaaaatcagtacctcagcagatgagaaatggatcaatctatggtgtgactagacaagttaatgttaaaactgaacactgtgatgatgcatggcagctctgacaatacaagtaggatcagaatgtaagtgtggaaattcagtgtcactagggaagaatgggctgagagaaagtttaataggtagagaataatcataaaggaaagagttgccccaggactggaggggaaccaggtggaagagttgatcccgagactgatgtgactgatgattcttatcaaatgctcctctttgctggccttgcttagagccttctttggttgtttttagtggttgctttcgactcaaaagtgatctgtttattgtagtgtgagagatcatatatttgcagtcattgctgtccacgttattacttggatagatgtttttcccagttcctgattttacgataatccagttcaaagtgatatgcatgatatttcaaaaacagatgtcataatcttttctttgttttttaaatcattagattgtctaactcattgatatttttgaacatgggctttctgttgcactcctcatcgaagtaattttcattatgtgttgttttttctaagtttatttatttttattgcaagtggccaaatgataggccctttctagggaactatgtctacacaaaataaaataaggttaaaattatgcaatgaaactggcacttcggtgagctgtaaaccttctctgtagacattgtccttagatcatcctcacacctgtaatgttgaattattccctccctaggtttcattcctagcatttctgatccttaatctctgcttatccagaaagtcattttcagttccagggctaacttcctgaaatcctcacagattgattcaggctaaatcctgtattcaggttcatgttgaatccccaacgaaaattaatgggatacgtgcagctgcatctctggacagaccacacctcatcttgctttctgcaatccccgtccctcacttgcctaaagtgctttgagaactgttgtgactacttcagaatgaactatgtttctgtgactctttcttgctggctcatttcacaggaagcccgaatttacttgtacatggctcacagatcaatttctgcagtgtggatgtttgtaatatacataaatgtgttggatgaaggcattgaaataaaatttttgagtctgcaaattaagctggaattgaaatcagagaaaataatgaaaggcaatgaaaactgattcaaggagaagttttgagtaagagtgccaacaggcaccaaatcattttaaatgaaggcaaatattaaataatttaagagcgaagaaccaagctggagactatttcttaaatagaataatgaatcagcagttcaatcattatatggtttgaaagttattatggaaaaatcactaaagctatcaactcaaataaaacctaacaagaaattaatagaaatataataatagtgtgtattttgaaagtgatgaaatacctatcaaaacattaaaaaattataatacaggactctgattatgttactgtagaaatattctcatttgcttaaatttgtgagagggtttcttgagttggaaagcccacaaagatgcaaactctgatttattttataatgaatcttctttctgcaaattcatttcattttcctacaaatgcatcacctgcttttttctataagctgcttgtcttagtacaattatctactttgataaggttgtgcttattatgtcatattgcttagctgtcatttacctagcaggtaaaatacatattcagaagctatataataacataataatgtttagcacattcttatcgtgcactagcttggatacagacctaagcactttacatataatttataaaatttctttaaggtaggaacaattaacattttcttttattgatggggagactaggaagttaagtaagctgtgtaaggctctacacaattagaaaaagagcctggattcaaaccctggcagtttttgcttcagaatccatgttcttaatcaccatgttatccttacaaattcagtgcaaggcaaaaagcatcatcataatttttttttttttttttgagatagagtcttgctcttttgcccaggctggagtgcagtggtatgatcttgactcactgcaacctctgcctcccggggttcaagcaattctcctacctcagtctcctgagtatcttggattgcaggtgcgtgccaccacacccagctaatttttgtatttttagtagagatggggtttcaccaacgttggtcaggctggtctgaaactcctgacctcgtgatcctcccacttcagcctcccaaagtgctgggattgcaggcgtgagccattgcgtccggcccataacaactttttttaatgaagaaactgagatgaggagtagctaaaaacaaagaaacaaacaaaaaacaatgctaaggttatagagttcttaaataactttggattcaaatttcattctaactttaaactctgtgctgctcctacatgacatttgcctcatcttatctaaaacttgtcattccttatttctttttaaatggggatgaaggagatgaattaatgactctgaactgtaaactgccaaaataaataagttaatatgcatttatttgtttataagctcaagtacctgcctaaacttcactaaattttgtatttttatacctggtcataagatgaaaatttcttactgaaaagtaggttgtgttgttttaacaagcaaactgaaatgaaatcttgaatgaaaactataattcaacagtgcagtacaattatatacgtttgaatatttatattatatatattatatattatatatatattatatatgtacctatttgaataacatatattcacacacacacacacacatacacacacaccttaaaggtggcatgggaatggaatgtttaagaaaaataaaaaggctaattttggctgtgatgatttcatccttgaggacacctccagaaggtgagattacagagctaaaacctgtggaacttccaactcactactatatcataacttgaaatctagagctctttctttgaaaggatgatctaaggacagctatatacaaatatataataaaaggggaagaaaaaataatgtaaagcaaaaattattttcccaaaaatgttacaatagaagtccacatgtttcacagtttgggtacatggtttaaaatccacctgctcactgggaagcagcagccactaagaaatagatgcacctctaggggctgggaaaaggtccagttcagtgaaaggaatatgatgttctaatgtgacaaacaagaggagttcgcagttcaggtagacggtgggcttcatggatatcaaaccaccataatggaaatgttgcaattgataggcatggtgatcaagagttcaaaagtcatgtccacaatttgggggtttttagagctctacatagggaaatttctcagtaacggttgtgttggggttttgaggtaagccatcatcccatctaggtgaacttgtaagaataaggcaaactttagttctagaagtattaggtaactcataaagacaaaggtcaggcttagagatgagatgtaatacagaagcagctcaggacaatactgggtgacagtgaggactggactgaactaacaacaagagtgacttcatgttgatacccagactggtaccatccttgatcttggagaggcttcaatcttttaggtattgggtcatatggctcatctgaaagaagaggtaaatctctaaggctagaacctaggtagaggttaacaaggtgtatttcagaaacctcagattaattaaatgagtgtttcaaacacatgtattttattgacagtttttcccttgggaaaaatgacaagaaaccatattttttagactaatggaacagaatagagaacccagaagtaaatccatacatctacagtgaactcattttctaccaaagtgccaagaacagacattggggaaaaggcagtctcttcaataaatagtgctgggaaaactggatatccatatgcagaagaatgaaactagacccatatcacttaccatttataaaaatcaaatcaaaatgtattgaagacttaaatcgaagccatccaactatgaaactactacaataaatcattggagaacttctccaggacattgatctgggcaaagatttcttgagtactaccccaaaaacacaggcagccaaagcaaaaatgaacaaattggattacatcaagttaaaagccttctgtgcagcaaaggaaacaatcaacaaagtgaagagacaacctatagaatgggagaaaatatttgcaaactatctctctgacaaaagattgattacaataatatataaggtgttcaaactactcaataggaaaaaatctaataatctgattaaatatgggtaaaagacctaaatagacattttttaaaagaagacacacaaatggcaaacacattcacaatataaatgtggttcatattgtcacccataaagagatatgaatatgttctattttaatcatttttcttcaaacttaaattcattaatggaatattccattgtatgcctgtaacaaattatctcacatactacataaatacatatacccactatgtactcaaaaatattaaataattaaaagaaaccataatataaaaatgaagtttcaaggttatatgtgtgtgtgtgtctgtgtgtatgtgtatatacacaggtatgtatatatttaacctctgttccattggaaaaccaaatgtaattcataccaaaccacccacaaaaagaaatgatacattctattgtcatcatttttcttcaaactgaaattcattaatgtaattcaaaaagcaatgcaatttcaaaagaaatcatttaatgtagcagttttagtgcacacagtctgattcaagagcatttcatttactcatgggcactatggcaaaactccataatctgtattcattatataaaacagttcctccggcaggcatgtttagctttgagctattttcatggtgtgcatatcaccaatttggcgaggttggcattcaaacagaagtatcagaagtgaatattttgtatacttatcagatatattcatttatgacaatatttctatttttataaaactctcaaagtgatattctctatttgatatacagtgtagttttaatgatgaacataaacggctactcctgtttaaaatataaaattggatctacttatggtaataaaatatattaattatttctcacttttaagactataaagaagtctaactcacatttataaaaggtgtgaaaaattcaatttctcacaacctaaaaagcatacaaaattttactagttttattacgtaaaatcaggaataattgattataagtaactgatgtaaaggtaatgtaaaaactacctttcttttcacacttaatttatatatgatattacaaatttatttatgtattcatttatttgttttagattcggggatacaagtgcttgtttatacatggatattacatgcttaatggtagggattgggcttttagtgtacacattatttaagtgttggatattatacccaataggtaattttttaatcctcatcccccttcctttttccctccttttagagtctccagagtctattccttccatctttatctacatgtgtgccctttgtttagctcccacttataagtgagaacatgcaatatttgattttctgcttctgtgttagttcacttaggataatggcctccagctccattcatttatagctgtgtagtattccatggtatatatacaccacatttttttaatccaatcaaccattggggacacaggttgattccatgactttgctattgtaaatggtgctgtgataaacatgtgaatgcaggtgtcggttttacatgatttcctttcctttgggtagatattcagtagaaggatggctggatagaatagtagttctattgctagttctttgagatatttccaaactgttttttccatagaggttgaattaatttgcattcccaccaacagtatgtgagcattcctttttcttcatatctgtgccaatgtttgtttttctgttttgttttgttttgtttactttttaataaaaaccattatgagtggtataaaatgatatctcagtatagatgttgcatttctctggttagtaatgttgagcgttttttcatgtgtttgttggtcgcttgtgtttcttcttttgagaaatacccgttcatgtcctttgctcagttttgaatggggttgtttgttgcatcttgagttgttttgggttctttgtagattgtgcatattagtcctttgtcagaggtataatttgtaaacaggttctcccattctgtaggttgtctgtttattctgctggttacttcatttgctatgcagaagctttttagtttaaattttatttgtctatttttggtttagttagatttgcttttggagtctttgtcataaattatttgcttaggccaatgtctagacaatattttcctaggttttcttctaatatttttatagtttcaggtcctacatttaggtgtttaatccatcttgaattaatttttgtatatggtgggtgagagataggtgtccagcttcattcttctgcatatggctagccagttttcacagaaccatttattgaataggatgtcctttcccaattgtttatttttgttgacattatcaaagatcagttggttatagacagtggttttatttctgggttctctattctattccattgacctatgtgtctgtttttttttttttttttttttttttttttttttttaccaatactgtggtgtttggttataataaacttgtagtataatttgaaatcaggcaatgcaatgtctccagaattgttcttttaacttaggaatgctttggttattcaggctttttttttttcctggttcttttttttctgctatgaacttgaaaattgttttttcaaattctgagaaaaatgatgttggtaatttgtcagaaattatattgaatctagaggttgctttgggtaatgtggttattttaatgatattgattcttccaatcaatgaacattgggtatttttccatttatttgtgtcattcataatttatttcatcagtgatttgtagttcttcttgtagagatattccatttccttggttaaatgtatttctaggtattttgtgtgtgtgcatgtgtgtgtgtgtctactgtaaaagggatcaagttcttgatttggttttcaccttgaatgctattggtgtacagaagtgctactgatttttgtttgctgattttgtatcttgagactttctgtatcttgaggtctgtgagtcttctaaagaggtctttagggttttctaggtatataattatgttattagtgaatagagaactttgacttcctctttacaatttggattccttttatttctttctcctgcctgattgctctggctaggacttccattattatgttaaataggagtggtgagagcaaacataattgtcttgttctaattcttagaggaaatgctttcaactgttcctcattcagtatgacattggttatgggtttgaaatatatggctgttactattttgaggtgttttatgtacagctagtttgttgagggtttttaatcatgaaggcatgtttaatcttattaaatgctttttctgcatctaattgagataaccatatggtttttgttctcagcattgtttatatagtggacaatgttaattgatttgcatttgctgaaccatccttgcatccctggaataaagacctctttatcatgctgaattgtctttttgatgtactgttggattcagtttgctagtattttgtggaagatttttgcatctatgttcatcagggttattggcctgtagttgtctttttttgttgttgtgtccttgcctgattttactattagggttatactggattcatagaatgagttaggaaaggatctctcctcttcaatttcttagaaatagtttgagtaagattggcaccagctcttcttcatacacctggtaaaattcagctgtgaatctatctggtcctgggcattttttgttgggagatttttctactactgattcaatgttcttcttcattattggtttgttcagggtttctattaatatttccacctggttcaattttgggagtttgtgtgtttccagaaatttatccattttccctaagttttctagtttgtgtgaatagagatgttcatagtagtctctgatgatgtttcatatttctttggtatcagttgtcatgtcaccttatttttctgttgggacaagtcccatgactctctcctttttttccctcttattttcacctctatcaatgttttctttatttaccttatttttaaataacctttaaattttttccaccttcttgggatgagtcctttgattctctgctctatccttcactcttctcttgttaattagcctaatgtttttattaatatttgtaagatctgtgaggtgactctgaggccataaatttgacaatgcttctggaactgctacttgattctgcaggaatcaaatacttatctgtgattgttcagtagtgagctgtttgtcctgagtcaacgcaaacatgttcttctactgtgcagcataaaaaactaaagacactgctgccaaattagttactcacaacccattttagtaaaggtttctcaggaagctgatgataccaatctaaagaatggaacaattcgcttaaactataccttctgatttcaatggttacttggttttgcccttctcctacatttactaccttcttagtaaccacaggtctcagaggtagtttctgttgtctctgtataattctgcccttcaggggttgtctctgagtctagctcagaaagactcatatctgagcatggtccagtcttaaggcttgacccagcactctcttttaatttcattgtaactgttatagataacaataaccaaggaattaaacatttcacttttttattagtttgcatttcctcatgcatccaatgaacggactccttgggagtcagatttatctctaaattccatggatagcttttaactttagtaactgaactaaagcacagttgttgtttcataccatgggtgaccacatggccacccaggaatttgaggttttttattccctacccttatatgcattctttccccagcccatatgtttccttgaccgtgggccagtccagcaaatccaacttcactgacaccaactgggtaggggaaaactatctcaacccatgtttgcctccactctcacacaactataaccatcatcaacacagaagacttatgtaaccaaaggtacggggctttcgtctcacacagcaagcaacacacacgtgttgggtgttccccaattcagttttgtcagtatttacctggaaatagtttctgatctcacaggtccccaaggatacctctgacattcccagataccagtagcaagcccagccagacctctgaaacttctaaccaaccagcttcatgttggggttcccatgacccctttgttaggttcaattaatttgatgtagtggttcacagaactcagggaaacacttatatttgctgtttcattacaaaggatattacaaaacatacagatgaagagatgcatagggtgtggtctgcaagaagagtcatggagcttccatgcttcctcaggtacaacaccctctagggacacccatgtgttcagctctctggaagatccatacatttatttaaaagcacttacaaataaaatataagttccaaatggcagagatggtgtcagtactattccctgttttacacctagtgtgtggcatggagcccagcatctatgggtactcaagaaaaacttgtaagatgtatgaattcaaagaaaatttcaaagatttgtgatatatcacttactgttacatgtttttgttttctcagtcaacatgtgctaaaagcatagccattatcctgagctggtctgtgaaactttacatatttaaaggagttttttatactttaaaagattgggcaccagtgtttatactacagaattagtaatgacttctagtattatgtgctagatcctctgtgttttaaactgggtgatatagtaatgaatgcttttggaaactagcccgagattgatggcttgtgtagagagaaattggagagttagatgagaaaaatggatccatattgatctattacacttctgaatgaagaattgataatactattacaatctaatgaaaagaaatacaattagaagaagccattctttaagaaagtcccttacttccaccaaaaggaactagaaggtaggaagacaacatagaaaaatcctgtagcaatgtaggcctaaggtttaaaacagactggattgggaggatggctagagaaatctgtgaataaagagataggtaagtgatatgttttagaatacaaaaacaagaccaagctaatatggaggaagaactggagtggcagaacagagaatatcccatgttttcaagtaggagatacattatatctttgaataaactgaggacagcatgttgttggagggagtaagatgatgaatttggttttggagctgtaaggatttgacagctatgtgactcacagaaatatttaacaggagttgtaaatacagtactgaaactcagataaagaacatctatggagatgttattacagttgttaaaggcacagttattaaagggaaaatgaagtgaagaaaatgaatgaattcttcaagaacatattccaattggaaattgccctggtagttttacatattagttaataagtaaaccactttttatttataatgtattcataaagttttagattataatagtggagtagtttattattcttttgatatttagaataactttttgatatcatgcatgatgatagttattttaatgtgtgtgatttgagaatatagtgatgaattataaatttaatgatccttttacatgaatttatgtaatcactgctgctagatacattagtaatagtttccatatgtttgagatatctataatggagtggattgtaaaatataaattgatgagtattttccagctttcctatttcagccaccaacactcctttcttagcaaatctatggggatactcttagtgccttaggaattatccgtagctgagaataataacttcacatctttttaggattctaagtctaaaagacagaaattataaactcattagcggatacatgtgaacaggaaaaaccagcatttctcttcctgtcaaacaagatatttgacccttcaactggagagaatcagtgtatgtgcattcttttcctttacccgatgaatctgggtggcttgaaaagaatgataatttccttgaaagtgtttatagaacaatggagttgtatcctatgtctcagacataatccatacaaaaagaacaagcttagagagccacagacaatttccaaaacttcaccgctattactaagcggcatggggggtattctctgaatttcctttgggttctatgcaggctggggaattgagagaaacagtgggtccttcccggaaggtcgcctgactacaaagaagagatgagcattaaaaagttgtactgtgggccataagcctgaagctaaagaaggaaatgtctcaatctcctaagactgtcacagccaggaagtcaaagggggctgaaccacagagggaagagaaagcaatcatgaaacatctgaaccgattggtaatagaatgcagttttactgtatgaaaaacaggacatgtaggcaaaaacaacttaagattagaacagtttgatgattttcctccttttaacctctttgtgggcattagttatgaagttatataattagctgcttttttttttttcttttcttccacctgctagggagtgatgataggtggcttttatctcgacagaaagtacacggagggaagaacataggcttggaggctgattcttctgggtattctctgctacagagagaggaagaagttgtggagtcactggcttctaatgaaagacagatcatgactggccatctacatacatgaggagggaaggaaaagtatcttactttttatattatagaatagttttcagaccttagctcaaaagagcctcacttttagaaactttttattattctagaatgatttcactctctttgaacaatctcacaggtcatctctggaaaagtgatcttatttggaaatacagtagcaatgcaacacgtttaatggtctctctgacatgacaaaaggcaaaggaaactgatcctattggatgtggcaagatctaggtcaatggtgaccttttagagaaacatttctgtagaaggcctggcaggagacaaattgcaagggaacaaagaagaaataagtgtgaaaagtagagaagaaatgactgaagatcaagaagagtgctcacaaaaaaataagtggtaagcaaaagggcaagagttagaaaggttaacctatataaaattcaggctaaaaaggagaaatacattgcttgaaaacaccagaggaagaaaagaaaattagttcctgaatttctgttgcatttaaactgcatatatatttaataagttcaggctttcatgcagagctgtgtcattagtattggaggggaaaaaagtccaactaatagttataatctattaatagggatgaagtaaatcatgtttgggtataattagtaagagaacatcaataaaggagaaaaattttttaaatctaatagacctagaataaatcacgcattacttgtaattaccaggaaaatacttggatcatggcaaatgatttgacaacatggttctgtttaatttaccaacctattttaaatggaaacataatgcttgcaatgtattttactgtctattcgttacacaagcacattgagataataatgagaataccatgagatagtaaagaactacttgttctcttgaagagttatgagaatagccaaaatgttcaaacttcacattaaattttatatcatgatgttaatttattttaaatttactctgtcattccaatgagaatggctttctctgccaaggtttctgcaagctgtcaattgtcccaatgctggctgttgatctcctaggcagatttgggccataacacagccctttgcacccagttactaggaataattgaaattcatcagttttccacattttgatttcattttcttggtaacttctctttcacagactctcattcccacatttttgcattactgctgaagtctggaaattagtcttcatcacattgttctttcattccctctttactcaaatgcctaattaatcttctttaagcatagcttaaatcattctactctctttttcaaaaatcagtagcacctctgaccttctattttgttagcctttagttgaatttttattttgctcttttctgggagatgaaatattttattttgtcactctactcctaaagtgagtttatatgtcttactagtgcataattcatctcacctgatacacttttaacttatttatatgttgaaagtaaatgcattatataactatttgggccaaactctgttttaggtcccagtaatatgaaggtggatatgcagttgagggaaaaaaaagacaaaaatacacagcatttgcctttgaagagaccaccagtttgttatggcagcagatgataaaaccagtgattccaaaatagaattgagaaaaaaacgagagtacagacaggaaaggataatgtttcagaaaattttcagtggtaggtggggtgctaggtaaaggtgagtcaccaggaggtgtaccaggtgtgttgtatagcacaacaaaactgccatacaatatagtatattcagaaaactaattacagtagttcaataatactaattcatgagaaaccagataggttatctagtgagctgatgagaggtcctcacagagtttaaacagggaagtaccatggtaaaatttgcaatttaaaaacatcattttggaagcaatgtggtagatgggtttgagttgaatgaaccaaagtcaagttaactaggtagagagctatcacagcaatgtggaaaaggaataatgtggttctggacaaagggagtgtcagcatgaacagagttaaggagacagatataagtgacagctcaaagactttaaaaacaaatatactttatatttcatagtaattttaggtttacagaaaagttgaacagaaagtatagagggttctatatgctttcttaaatgctgcctgagtttctcctattattaacatcttgaattaatgtggtatatttgttacaattaatgaaccaaaattgatacattattaactacagtcaatagtttacatcgggtttcagtctttgtattattcaattttatggaatgtagagaaacaaaaatgcacaatataatatgtgaaccattacagttacagtattgtacagaatagttttcctgccctaaatatctactattttttttcattcatctctcctctcctcccaccaccaccctaaatctcaggcaaccactgatctttttactgtttctatagtttttctttttcaaggttgtcatatagtgggaatcatataatatacagcttttacagatggccttctttcacttcgtaatatgattctaagtttcctccatgtctttttatggctcggtagctcatttcttgtcatttttaaataatattctgttggctggatacaccacagtttatctccaaccattgaagaatatcttggttgcttccaagttttgacaattatgaataaagctgctataaacatttgtgtgaaggtttttgtatggacataaaagtatttttaaactcacctggacaaagatcaaagaatgaatgctgaatcatttgctaagggttttatttcactttgtaagaaactgtcaaactgtcttccaaagtggctggtatgaatttgcattcccttcagcaatgactgagagttcttgtagctccacaacctctccagcatttcgtgtcagtgttctggattctagccattctagtaggtgtgtagtattgccttgttgttttaatttgtagctctgtaatgacagataacgttgagtatcttttcttatgcttatttgccacatgaatgtctttagtgagttgtctgttgagagtttttcacactttttagttgtatttttattgttgcattttaagaattgtttgtatggcttagataaaagtcttatcacatatgtgttttgcaaatattttctctcagtctgtagcttatctttccttaattttaagtttctttctcagagtagaagtttttcattttaataaaaatcaacttattaattttttctttcacggattgtccttttagtgttgcatctaaaaactgattgccaacacaaaaatgtgaatatatttaatgctataaaattgtattcttaaaatagttaaaatagggctaggtgcactttgggagatcaaggtgggcagatcacttgaagtcaggagtttgacaccagtctggccaatatggtgagactccatctctaccaaaaactagagaaattaggcagagtggtggggcgtgcctgtagtcccacagctgtttgggaggctgaggccggagaatcgcttgaacctgggagacctaggttgcagtgagcttagatcatgccactgcgctccagcctaggtgacagagtgggactctatctcaaaaaaaaaaaaaaaaaagttaaaatggcaacacttttatgtcatatacattttacaatggacagactacacaaaaactcattgccaaactgaagatcacatagattttctcctaagctatcttataaaactttaatagtcttagatatgacatctaggtctatgatttattttgagataatttttgtgaaaggcataaaggtcagtggctaggttcattttcttgcatgtggatgcccaattattcctctaccatttgttgaaaaggctgtcttttccccactgaatatcctttgctcctttgtcaaaaataagtggaccttatttatttgagtctatttctgggctctctattttgttcaattgatctatttgtctgttcttttgccattaccacattgtcttgattactgtacctttatagtaagtcttgaaattggtttttgtcagtcttccaactttcttctttttatgtaattttgtgtttgctattttgggatttttgccttttcatacaagctctagaatcagtttgtcaataaacacaaagtaatttgctgggattttgattggaattgtgttaaatctatagatcaagttgggaagaattgacatcttaataatattgaggctgcatagtgcttattttaagtaaagagtgaagagagaggaattagggattacttctatacctcaaattaggacaactaggtgcgtcttgaccctcagttgggtataaacggaggtacagattttgaagtgatgatgataaattagatgttagatatttagaatttgaattgccaaagggcaaccagatagatataatcaccatgcaattgaataatcagatatggaatacaggggcctggcctggatataaagatttaaaaatcttcaacatacatataatttattgcttatggagaaaatagatgtgggggagaatatgtgagaagatgttaggaaatataaaaatgttcagtgtgaatatagaagaagttgccctggaaggaactatagtgaaaatgtcagaggtgaaataaaataaaacaatccacagcagatgaggttgttttggaagccacatgagaaaatgattccaaaaggaacttgtcagtatgccaaattaacatagcatgaagatagtttgttcactatatctgtgtgatgggatcatcgtacaacgggcctcaatggcatgcaatttacccatgtaataaacctgcacatgtaataaacctgaacctaaaataaaagtcataaaagaagaaaaaaatagcataaagagtgaaagcgcaaggggaaaccaaatttcatggacatgaaataatggagacacaagtatgaataactcttataaaacaaatgcttaacttgagagaaggatcaatataattaaaggaggatgataaaaggactagggagggtattttgtaatcatctcacgctcattttcatcattaccatcattgccatcagtctcattatttagctgggacaaattggtgtatatttatatattgagggcaaataactagttcaaaattgaaaggtaaaaaacaggccaggcgctgtggctcatacctgtaatcccagcactttgggaggccaaggcgggcagatcatgaggtcaggagattgagaccatcctggccaacatagtgaaacctcgtctctactaaaaatacaaaaattagccggacatggtggcatgcctgtaatcctagctattcaggaggctgaggcacgagaatcgcttgaaccaaggaggcagaggttgtagtcagccgagatcgtgccactgcactccagccataaaaaaaaaaaagggaacacattttcccaaagtaattaaaaggaatttccttccagggataggtgcaagaattaagcttaaactggacaagacacttttctctcaagcaattaataagtaaacagaagtggttgaagaatgagaacaagcttgatgtttaaaccttagccaaaaaataaagaaaaaaatataaattattagtatctaataatcacttggatactaatcatttgattattggacactagtaaaagttaattaaaagtaaattaactaataaatgttaatcaaaatatttctcctctcaacctgaataaatgttcaagaaaatatttaacttacttccaatatgttttacttcaaaatttagctttggcatattggatataaagtgtggaaattttcaactccttctccctaaaatcatgcaaaatatgcaaatgaaattgagccatggttcaatgaagcaattcaccaggctctttgtcattactgagaataatgacaatgcagagatgtcagacattgcagcacatttgaatctcccagtatactttgtacaaatctcacatagatggatgaataagacatgaagtttagatatgggtttgctccttgaatgatatctggtgccactagtttcaatctttcttattgatgctctttttgcattgctctttgtcagtcaggattcactcatagagaatttaatgcaggtaattgattacacagatgtgaaaaggcctgaaaaaacagaatagaggaaaaagaaacattccagattttaactgcataatcattcttaaggctgagggaagaatagtaggctatggggtcaccagtgcttagaatcatggagggttgagccagtgctgaaaccaggaaaggtaaattcatgaaggtgttgggaacttcgagagggtctgagcactgatggtaggctaagataaatgttctgtgttgtagctactagaactgcaaaaaacaaaaacaaaaactattaaacatttagctttacacgtttatagagaccataaccaagtattttttttctgtcttcctgctttcctttttcctatgagttcctctaatggaagaaacttaactagaagtcagctggccaaggaatgtggaaaacatagttaacagggccctaactcccttaaaatgcataatagaacatagagggatagaagagggaatcaaggtcaagcacatttatgattggcaaaatgaactctccacctggagcattgtttgacaagattcccgaatgaaagagggttttaaatgaaaataaccattacctctgtcatccactcaacagtatatttgaattcaagacattccaaacatgggccagaagacctaatttttaatgagagctttactcttaacaggaaaataaggaaaacatctacaacaagtgtatactcaggaggattcacagagactgtattttgaactggctcattgtttggtgtcctgaaggttttcccaccccagggagatgcatcctattaagacaacacatagatgagattacagcagtattgggtacagtaggagacagggtcatacagtggagaagagtaagacatcttgagcccagatgtatttttaggcacatacatttaggaaagataatggatggaagttgatgatctaaaaattggtttctataaaaataccacaatcctgtacctcttggaaagtcttatgaacttctctatgtatacttcaccttgaaaactgctcttatagatgattaagaaattgtgtatatttaaataataataaagctctaaaaggttgtgcaatgaactttagtatgaaatgatagttctttgtagtttttagcctattgcaaacatattcaatttctgaagggagaatcaagattttgcctctttaaagtcaagtcaacattattactgagcattaattaatcacgtatttaaaggtcaacaggtttttttgtttttttttttcttttttttgacaagagtctcactccagttgcccagactggagcagtggcgtgatcttggcttactgcagcttcgacctcccgggctcagatgattctcccacctcagcctcctgagtagctgggactacaggcacatgccaccatgcccagttattattttttttttttgtatttttagtaaaaacagtgtttcgccatgttccccaagctggtcttgaactcctggattcaggcgatccacccacctaggcctcccagagtcctgggattacaggcatgagccaccgtgccaagccacggtttttgtttttttaattgaaacagaaagtaaagaccgtgattcttgaataaggtatttgtgatgtctatggttcaaaatgtttatgatttaagacaggtatggctattaaaacacatattactccttaaaaacttagaaaatacaaggttgttcaattataatagtattctgcatttcctgctccaaataaaaagactttgaaagagtgggtctccatttctatatttgtcccttagaacctcagacagcgtgttttgagtcttcatgaaccctgtgagaaagtaactaacctacaactatttcttgcatagctttgaaatataataaatcaattggacctaaaatccattttaaaggttcaaatattaagctttagttataaaattataaagcctttctcaacaaatagtctggtttgtagtgtagagactccattttcataaagattagtgatatatacccatagtctttacttctaatttatttaccagcgtatttccttatctgtccttcctctagcaactacatttcggcataattattgagagatattttttacacgaattttaaattacctagattccactagagtgctatatagtaagttgaataatggcaccagagatataaagcctattgtccagaacatgtaaatattactttatgtggcaaatatattgcagatatgattaagaattttgagactgagatgttatcctgattatctgagtggccttaaatgcaatcacatgtatatttataagagggcggaagaggcagctttgaccacacagagaaggcaacaggagaaaatagaactgagagaggtttgaagatacgaaccttgaaaattggatgatgtgccagatgataaaccaaagaattctagtagccattacaagctggaagaggcaaaggacacattctccactagagcttctaaaaggagtgtggtccctttgataagtcaattttggccaagtgatactgttttagacttctggcctccagaaatatgacagaataaatttttgttgttttaagccaccaagttttggtaatctgttacagcagtcataggaatctaatataggtaccatgcatcatgtatacagaaaactatagtagcaactgggttaagttaagccaatataattctcatatgtctcttccaaattcagtattaaccaataagaaaattttccttctaagtttctattattcttataaaaacctgcattctgtgttgctatgcttacttaccataattgattaactctctggttgtacttttgaaagactatatccaatcactaatcaaaaagcagccattactcagtatgatacccagttggatgagttcaagtaatttgctcaatggggagaaatctcaaacggtttaaattgtgatgcctttttagccataatgttgatgctatattgactaaattgtaattatattatacttgtgctatttttggcagtgagaaaattttttattcaaattatcatactcattacatatgtaactattgaaaaataagttttgaaggcttgtaatcatgttgctttatttcatagctggcatataaatgtaaaaccacactttgaaactttaaaactattccagaaaagtttttacattttgagtttggtaacattttgttaagattgatcgtgaatacttagtctttttttcaactactgttaaaaaatgatggaaaatgtatcatttgttagcagacttttgaaagtcctgtaggcttgacatacaaaagcatgaattattttgtatctgtaagaaggtttctacatttgagagcagcaaagcacaatcaaggaacagctaatcttagaccagaaagaaactggatgaaccttctttcacatcctgaaaactaactgactttttttgaagatcaaactttttgaataccaacttatgctaaactcataatcttacaattgttttacgacataattattcatattcccattttaaagttaaaataactaagtctcagagtagttaaatatcgcctccttggagtactaagtcggaattaggtaaccaggtctgcctatgtcttttctgtctccatgcagcactatcttaagtaatatagccactttatcaattagtgagataatctccatagtttctaggcactttaactttatttacacataagaaattaaattttgaataccaacacctctttcaaaatccatcttcttttagaaatgacagggaaaatgtcattcaacagacagtaaaacagtgcccagtgtagattaaataaaaacaaaatgttctgttctgagttttgcaatgtggtataatgagtttttcacaagaaaaaaaaatggccgtaataagaagtgcccccggctctcatacttttaatgttattaaattaagttcctttgaccttaccttgaaaattccattccaaagcacactaacaagctatttgttactttttaattatttcaattgttatctgaaatgtgagcaaggttaaaaattttttgtgggaaagtattaaaacttcgagttctcattaagaactgcaaaatttgtcctttcagtcttctgaccaacattctccattcattactgtagagtttccctctgaaagaggactacagagataagatgaggtcagtgataatggcgatgatgatggtgatgatgatgacaaatctgacattaaagaaagttcaactgtggcgaattctattgtgcatttccagtcacctctaggtcaaagtcagatttttttcatcatatatacttttttgatcttataagccaattgtatcagttaattcatcatcattagactgagtttaatgaaagagtaagggtataacattttgagtgcttattatgttttaagcactgggctagccccttgacctacctgacctcaaatggccactgtcatctttagtatcattaatggtggttttctgcccttgctgcatgtcaggcttatcaagggacattaaaaattattgatggcttaggctctatgacagaaaaattacaacagaacatttcaaaaggtcagttacagccatcagtattttttaaaaattaaattaaaatttgaagccaagggaaaggaagtatcatcaccttcaagataaaaatgttattccctcttatctctatttggccagtttagaaagttcagggagactttcttcactaaactacctttccagcaaaaaataaccctatgaagtatgagatattgaaatattaatttgctttgcttttctccgttcttcctcatagtcaaaataaatcaataattataaaattattcacccaaggactcttgcctctgagtctgatatgcttttgtatgtcttttctgtactaaatttactgtttccttttataagtcaaaagcatgtgtctggtctagggaattcaagtgaagagaattcaaaattagaatgaggaacataaaacatagcacctggctgtgcccagttacttaaatcaagcaagctaataactcaggtagaaccaactagccttgtttgataatcctggcatggaaagttactaagacataaaaatcaattaaaaatacataattaaaaaaatacgtgttttaaatgagtttctatattgtttgtttgtttatctaacatgctcatatggatagcaaggtttattcccaagtgggttgagttcctttgacttgtgtagcacctttttttatctaaatatttttttttttaatggagcagacatagagttactagaaaaattcagctaatgctcttcacagaagaagcacagaagagatctcacaaacagaaaatcagccatcataaaatgatactgtcaggggcacctttatcacctttatctatccatttaaaaatgaagacttaaaactgaagtctacacacttacctgtaatcccagctacttggtaggccgaggcaggagaattgcttgcttgaacctaggaggcagaggttgcagtgagcggagatcgcaccactgcactccagcctgggcaaccgagcaagaactccatctaaaaaacaaagaaagaaaaccaaaccaaaccaaaacaaaacaaagcagaaaacacacttaccaaagatttctaaaaaattaaaaatctggccgggtgcggtggctcacgcgtgtaatcccaacactctgagaggccgaggcgggcagatcacgaggtcaggacatcgagaccatcctggctaacatggtgaaaccccgtctctactaaaaatacaaaaaaattagccgggcgtggtggtgggtgcctgtagtcccagctcctcaggaggctgaggcaggagaatggcgtgaacccgggaggcggagcttgcagtgagtggagatcgcgccactgcactccagcctgggcgacagagcgagactccgcctcaaaaaaaaaaaaaaaaattaaaaatccaaaaatctacttttagtcgtcagcaccttatgtccaatgaattggtttttagttttattgtttttaatttccattttgtttgtgtggcagaagatactactttttaattacacttcaaatagtttgcaaaagaaaataatagtagcagtaatgattattatgtaaaagtgggcttttcaatagaggtagacgttcaaatatgttaatgaccaacatgctgagacagatacttgagaagctacattgctttatccaacaaaaatatagccactatttctgtgacacctactgtccaagacattttgcatatattaaacgacttagtcatcataaaatgtgctccttatttccattttgtaaggatgataaacgaaatccagagaggttaacgaactgcctgagaggtagaccaggtgattccccacctgtgtcacaccccacaccagcaggctttttgctcctcaaggctttatgacacattggtagagagctcattgctgtctggctagatcaactatttgcttatttgtttaggagtcatgaaatcctctttgactttctattgggttggaactatatataagactaatgtatttcctacaattttacctgggaataaatatattctataaagactgtatgtgagttgttaagatgtctctagtatggtgaaatacctagcatatttgacagctcatttttaacatttttctctataatacaaaattattttcattaatagccatggaataaaataaatgataataatggccataaaaataatacaaacagttaaaaaattattgaacttttatgtataatctgccagaaaaatacctacaataaatgatatagtatgaaaaagaaagtaacatgttaatacttttaaattacattaatgtattggactaaactaagtattagttatcatagtaatggattaaaatattgacatttctgtttcttgttttagcttctgcaaatttctatacttttaattaataaagaatctaaagatttacccagaggtatagaattaaagtaaatcaagcccttcctttattttggtaattgtgttattagtgtttatttctaatttatcatttaaatgcagaaccaggtggtaccacagaggcacaaaatgcacagaaaaaatcgggacaaaatattatgaacttaccctaaagacaatttttgtgtagctgggtctgtgagtgttggatatcagctgtgtaggcaatagttatttgaattaacttccatgtactatacagtgtttattagaagattagtaaaaatgtgctaatttaaaatttatgtgcctatatatgtatataagtatatgtatatattaattatgctatatgttaaattatgtgtaaagtaatatatatattaaactacttatttatatagttaaaatacaatagtaaccacagcagttttttagaactgtcctgtctgatatgacagccattggccacatgtagctacttatactaaacttaaatttgtcaatatttaaagaaactcaagaatattaaaacttacttaaagaaaataaaatttcaattcttcagtcacattagccatgtttcacatgctacatagctcatgtggctagtaactactgtatatgacctcatagatacagaacatttccattactgcagaaagttggttgggctgcattgatttagaatttatatcgtccaaagattttcttgattagaaatactttattactaacgttgtttagaattaccagtgggagaagatgaaaaatcaaactgacttttagtaggtattattattacataacatttgtctacaggcagtgcaacccttattcctttcaatgggggccatccattcccaccaccttgtcctgcggttgctgttgctccagtgacccattaatgcttctatggctttcacattcttgtagacaactggtgccttgccacttaatcagaccttatgcagagtattattggtgtggttttgatgccaagttgttctacttcctcagaggacacaccccatcaatcattctccatcttttctctctttactgtcaattcaccatgaatcgaagcaagctgtgtcttaccttcatacaaatttacattattgtgccttggtttattttctctgtctagtcaactttgaaccattttcatatcctacttttctgaaattgaattttatgattctgtttgcctcccagtcattcctagtttcattataatctgccttccgcctaatctgtcctggctattgccatcccaatctctacaagaactcatccctgaccgaaccctatggactgagccctgacaccatgatcccgtggtgtctataaaacttgtcacggtatacttgaaaggtggatttgtttgtctcttatgggcaggacaatgtaaactcctagaatatgtaagtaattctgagccccaggaccaagttcagcttttttttttttttaatgtagagatcactaagcaaatatttgtagaaggaagggaagaagggagggaattttgatattattttgaataacctagttgtgaactcaagtagggggcaagaagacaagcaattaaaataaagaccatgcatgtctgctatcctcaagactatggagtcctcaagatgatatactatgatggcaagcaaattactctgcatttgtgaagatgcacctcctccaatgatcagatgtattacagatgcatcagtgatacactgtaaatcgataccttgaaattgtccatggctctattcatttaatgtaagaagtataatgaagggtttgctttatgctaagcattgtgctagaaactgaggatagcaagatgactaagacatttcacctgcccttaagaggtaaatttatttgttaggaacaagacacaaatatttaaaataattatgatgataatgatagttaatgttcatttagttctcctaattttccagcactaaatgcttctcatatattttactatataatttacttaacagcatataagtattaatgttattacccttttataggtgaggaaactgagacagagaggatgagtaaattgccaaagataatacaagtagtaattggtttagttggaattgtatccaggtagcctggaaacttggaatatttgtaaggatttataagactccatggaatatatttatataagactttcattttaacccaaatatacgatgtggcaagagaaggagtgtacaggcaagcatgggaagtctgaaacacaacaaagtgcaaactcctcccaggttcttagtcacacatggatggactttgcctccagaaggaaccacgttgaattgtgccataactcttggctccaagtgaactcaaggtagaagttaccaggaggatatgtcatgtccctctggcttctggtcaagctggactgtctaacaggttatgctgggtgcaaagcatcagtaaacaaacttgtactgcagttagctagggagttctggactttaaacagcacatcataaatcccactattcttatcttgaaaaagattcaaagccagtcatccaggcatctccagaaataagaaacaataattctcagtctagctttgtatttactctatcctacgcagaagagctaatcatggtgatggggatacaagggagaaaagtttgggaaaaagcatactgatgatccatgagtgaaagcatatacaaaactgcagaaacaaaggctgttttcctagtgctctgctgggacaaggggtggacttgaaatgacattaattactctaagccagtaaatgtgttcagcacttcaggtatgtaatatttatccacataacaaccccatgaaatcagtttcccttcatttataactgagaacattgaggcttagtgagaagaagtaattcgtcaaaacttagatgaagagaaaatagagaagcgctatcaccctgtctcaaaaataggtgattatgatttttgcaatgttgtctgcaggtaaatgtggaaagaattgaagggttgtaggtaaaggtcaatagagacttgtggttttatttatggccaaatgcagtagaggatcttgttggtgactaatagaattttttttttcagttcttgataactttaaagaccttgatgaaaatattgggagtagtctcaggtcagaaagacttgttctcattcaagagtccatcctctttttgtctatcaggaaatgccaggactggctggatagcgttatgttttttattgctctcataccaatgtttagcatgtgattgaccgtcactctcctgaagaaaaggactttggagacaattgttgtttttttttttttttagttttatcaagctgtatttaattttggtgtgtcaatatgacagatgtcaaggaaacttcttggctttttttcttaatctcttcagcttaagggggtgtctggcagcctgattttggtgatgagctggctgtcacagctgtaagtagcgccaaggagaatagataaaaagatttttgaaacttaagggtatattggtagaattattgtgaacagaagcagtccattttctgaagtggtttcatgaatatactctatcatgaagatatagatattgatatgaatgtatatatattatatatctatgtgtatatgtgaatatatgtaaaatgatcaaaataatttatgcctggactaactttcaaacttcttatttttattatttttcttaatctcatatctcaaagaaaccaatttctaccaattcttgctttcattaaaaaaattctaacagtcttagccataattgattactattgtccattcataagcattccattaaaaaagaaagaaaccaggctgtgggttttaatttaaattttcttagcttaacaaataaaatttaaaaattgagtaaattgttcttcgaatgcttaaaaagtaagtttttattatttccaatgtaatgggtgctacttcttccttcagtatcttagcgtgtttggtacagaacagaatgagttaacaacagtagcctgtctatgcctcctttgttcaagtgactgcaactaactgcaaattttagaggtccatgttgaaactccaataatctaaaataatttaaaatgaataatacataatatttatgaaaaaataaaatgcattttatgccagatatatattttaatgcatgtcggctacatgctcaagactgtagggcactcaagaagatacactatgatggcaagcacattactctgcctgtgtcaaggttccccctgatgatcagatatattacagatgcatcagtgatgtattgtaaatcaatatcttcagattgtccatggcaattcaactgatttgagtttctggcaaaaaatgacttgactaacatattggtattctggtttcatgaaatgttaatggattttttttttaagaaaatgaatttcttggagggaattgagtaacttgacatttcagcttttttaacatattagtgtacaatatgacagttttcttgatgaatatcaaagagaacagtgctgtatactgggttttcccaatatatttttggaataaaggtatttctcaaatctctctttaggaggaaattcttgatggctgagtaaaccacagccatgggagaaatactgaattacaccgtcttgagactactgggaagtgaagctaacaatattttgggttaaaatcaatctccaatcaatacacaaagaaatccccacacacattgtggagtctctgctttattaataatctctactgtcttacaaataatatactttggaacttcttcatgacaaaaacttagaatgtccatcaagagaatatcattaattattgaaaaagaagtaccagaattttacctctcattattagaaatttttcttctgctttctgcagatttttgaattatggtatttgtgtgtgtgtgtgtggtggcccttttatttttggaacacataagactaattcacatccttttatagattcggagtacggagattctttatttatcaaccttttctgaaactaagctatttctcttctttaaattatacactgtgtgatccacatgaagatttgtaggccataaaagcatcattagtatactgagatggtaacatgataaatagatctcacacagatagatttaacttttgcaactcagatctctcacaggaaaatggtacctgctctgcctacctcacagggatgccagaaaacaaacatgaaaataatgcaatatgtgtgaaaatcttttgtaaattgcaaagcagcctacaaagacaaagaactttaataatgataatgatcatgactcccaactgtacctgatcatttctggaaaatagaacagcttataagttagccaaagacaaacatcctctggctcaaatagagattgtgtcaaagaatatgtttcctttaaaacataattcattttaggaaaacactagaggagaaaaataaatatcgatattgatgttcaagatatttctaaaaattcagaaatcagctctttaagaatctatgaatacaaaaagaattgagatgagtaatctttgtttgtttgtttttggtctgtttttcaactatttttcttcttataacattggaagagcacaaatcccaaaacggtatttttttgaacgttattgtgttgtccaaggcagagttatcttaagtgaaaaatctctgaagcagtaaagaaaatatactgaaagtgcctcaatgatcagaatgttttcttcttgagaaagttatatagtacttttaaaagtacaggtcagagtatgtctttgcactcaattttgatttttatataaaatcctagatgtttctaccacagctggatctctaaggaagtagttaagaaaagaaaaatgtaagcgcagataacatatagttctttttagtcccataggaagccatagtgtcatgttactgaataaaatattttgaggttcacacaattcacatataaatctgtcttaaatataattaatatatttaatatttttcaaaataaacatgacggtattaggtttgccattaagtaatggcaaaacagcaattacttttgcaccaacctaatactttctgatgataaattcagacaataaaaaaggtaaaagattatttaaaatccatttgtatctgtaagtatgtataattattattttcatataaaaacttcaggatttttttctaccatttttgatcagttttactttagaaaaatgaaataatactgtgcataatcttttataacttgtttggcactgaagtacttttgtaggtatttttgtgaacatcataattatgcagcatagtatttagtatgtatatccaattctattgtaattaatagtgtaatttttaataaattccttttgggcgtttgaatgttttgattttttttagtataaaatctaattggtgaacattgttaaactaacatctttgtactttagacaattatttatttgggttaaagtcctagacatgtagttgttaagcaatattaaaattgaacacatataaaattgtatacttattgctggatcttcattaataaattgtagcaatttctccccaatgaaagctagatttaaccatttcacaatgtatatatactttaaaacatagtattgtacacaattagttatatagaattttatgtgccaatttaaaataaatacattaatttgaaaagtatgtgagaatggcctttagcccatccttttatcattatgaaagtgttaacaagaatgtttttttctttcccagtcagatgcagaaaatgtgaaatctcattagctcagtctgcatttattttattaataatgaggttgaacatctttttatgtttatcagccattcttttgctgtgtgtgaaatatgttaatttctattttttctctttttcatgttaatttgctcatatttttctaatggatattaacacataactagtttaacatattttctcatctctctgttttttctacttctctgtgtaactaaatcactatctttgcatttcattaaaaatcaaatactctttttattctgtaaatgacaggaatccctaagggagtgagaaccagctctgtaaaagagaccctgatacacgtaaaatgagaccctagttgtatcatgtctgtggctaagtgcctcatgccaaggtgaaagcattcacgttcatgtttggttgagtgtttctgagagtgtggtcttagccctccttgcagcagaattcattgtgctgactgctccacaatagattcctgttccctctgtatccttgttatttccagggacaggcctagaacctgcatttaataattaggtatttcttatacctgctaaagtttgataacctgtaagttgaataattcttgggtattaatccctagataaattcaggacatcatttgaagactattttttacgttcagtgccccctcctccatgaatggatcattatggaaagagatccaccttatatattcaatacattaaaacatttaagtaattcaataaagtgatattattgttttgttagatgagaataatatatcatcatatttcccttgtcagtatggcttccagtaagtccaaaattaaaatcaatgctcagtttaagaaatctcattgatttacatttctttaaaccacaaagtacaacaaaacatttgggaagccaggaagaaatgaaaataaatgtgcacttcccaagcaacctaacataacaggatattaaaatgggctcctctctttctagctggactaaggcttccaagattgagaacaatacagtagttctcagagtcttagatgagtaatagctaacattttcagtgctcattacatgccaggcactctgctaagacctctaaatttattaacccctcaaatgatttgatgaggtagaatactattatttactattatttccattcacaaattagaatgttaggcatagagagtttcagtaacttcctcatggttattaagcagtctgctaggaaagctgggatttaaacacaggccactgggctccagagcacgtgctcttagctaccaatccatgctggatactttatatcctgggagattataaaattagtgccagtggcattagcccatgaagacaaaaatatatatttgggtgagtaagaagattcttaaggctaatgatgaggaattcattattcagagaagaattatattccctttaatttttcatggtaaaattgtgtgtagacttctccttcaccttaaataaggaagaagtttaaagtgaacctcttggaaactgtaatatatattcccagctgttggagggttatacagagattagtgtcaattttcaccaagagaaaatgaaacagaaaagactactggagtggttttcctggccacagagtgaagagggaggatctgcatcccaattgaaaggtggctgcgggtccctttatcttgcaggctgtatgagagagttatgtttggaagctgactgtggcccatttgccatcctaaaagggacttgctcctggagaatggctgaaacagaagttacccaggaaaggagtaggaagccagcttggaagaaagcagctttctgaaggagacattgaccatagtaagggaatagttatatggaagatgacctataggaaatgttccttagaaaccccagatgaaccccaagaaggaactagagagggggcatctgtcacatctgcctatgatgcaactgacaaccactccagctccatgaaactttgctcatcttcgtgaatcttctatttctccttgttctgacccctgaaggttagaaatagcatcatgaaggataaaaggggtgaaatgaatacgagagaagacacatctccaaatacagcattacgagactgggactggcccatgctgaggagaggggacgcctttaaagaatacattgaacatttttaataagaatgaatttgattccttcttttcattttaactagaaaacaaaatgactatttactttttcagaatgacaggaataactaagaaacatgaggtgatttttataccaaggtagagaagatcatccctacaaagcgtctagggggtgtcttattactaaagaaacaatcatctaagcagtcttatcccaatcttcctgtattttaggaactgaacgaccaaagtttatgaaattcttttattagttttgtgtaaaactggaatatagcttatacttttgaagaagtgttacatcagctacttttaaactcactcatttctattttctgtatagaagcaggggagcacatttcataagttgtcccttcttcagaatcttgtctgccctccttataaagggaagttcatgtatctgagatctttgatttgtgggaacataaaaatcaaattgactttatgcagcatttttatagagaattatgttttttgaaagcccaatatcaaagtctgctttgttctaatttaaaagataatcaaaatatcttcaacactatgggaagtctcccagtaaacatggatttatatttagcacaatttatttgaaaaccagaaagtctgccaaagtggtataaacattaacttattttgattttagaagacagatattagtgagaagtaataaaatattgccagccttcataggcaactcatcatcactgttaaaactaaataagaagaaaagacccagttatgcctaacatggaccgatgttggttgaaaggtagatagaccccataactggctagccacatttgaaggctataatcatagaagatgggtgaaggaaatgcacaacaccaaatttgcaacatagactcatttgacgaaggggaaaatatgggacattttaaggaaaatgtcagaggaaattgcttgatagtatgaactacttatgtgtgattcttaagaaaattgtctccttaggaaattgtgttctcaaaatgtcttaaataaaaatagacataactgaatattctatattgtggtcagacattagaaaacttgtttttacctgtcataactcctcattctcctgaggaagacttaggatttgtctgagtttgagggttctggagacgtactcaacctgtttcccattcaagcctgataacacgaatcttaggctaagaccccattaaaacctaattggataattttgtacatgaataactaaatgcaaattcaaatgcagatagcatatataaactgcataaaggcaaggtgatattacctatatgattattacatgcatataacaatctccacttattcactgagagtttattgaaataaactcaatactgttctcttcatgggaaggataaggaagtcctagctttcaatgtgctgaaaggcctgtagggaaaagaaaataacaggaatgagaacacacgcacacatacacacacacacacacacacacacacacacacacagtttgatgcaatgagtaattaagtgctacattatagaacacaagactataggtgttcagaaaaaaataaatcagtgagaactggaatactgcagaggaattttctgaaaacaaaacaaaacaaaacaaagacgctatcttgaagtgtgccttgaaaagtgagtaagttatagaaaaccagactggaagtgaggaaatttcaagaaagagaaataaaatcccacaggtccaatggaggaaatgacaaggaaactggactagggaagcagcatagcacagtggctacaaacagagtcaggagccagatttacctgagagtctcagctccactacctactgctgtgaccttaggtattatgtcatcattctgtacacacttccattgtcagtaaaatggaggtaaactatcatatcaattttttatgtgagcagttttgagaattaatgagttgatatatgtataaacttatgctaggactcagtacctagaaagcatccaacaatattgttattattgttgtgcaatggtagaagatgtaattgtcatggctagaatgaagccaaattatgtaacaatagcaaatgccacttgttatagactaactgagcaatagaccctaggctcaatgcttcgtgtacattttcttccttattcccaaccacagtgctgagagggaaacatcatttctctcactttagagaggaaggggctgagatttcaagaagcaattttcttaagaattccactgctggtaaaatacagccaaagatttgcagtcagatcttttggcctatgcaccagtgtttttatctgctgcattataatgccttaacctaaatctaagagggctctgagatttaggcagggggcgtgtatctcagaccgaaatttactggatgggtttgaagcagaaaagagttcatattctggaaaaccagccaggtggcagctggaggctgttggaatactctaggaagggaggtaaatgagcttcttgtctattggcagtgctgagacctgcaaaggcagaaccaggatgctagattggttcaccacaaatttttcacactaattttcaaataaaatttacactattttagtctgggccctgaagatgagacttcagttaagtatgactcttgtttgtagagcccacctgactaaggatatggttgcttctgaaaggccaacactgagaaagcctgcacaagggacctaggttcctttcacataaggccagggttaagagagtctggtgttagcccatatacttttcacagtgctggctgggtgcatctaccattgccttcatgagactggtaatgagctttcctgttaccttgtattgcatttcacttgccccatgggagctcatgttcacgttctctgagctgtgttccatacaaaagtcacttaagaaataacaaagttgtcctggaagacagtgattgctcctaatacagttgagaattctatgctttgtagccttagaccctttacaagcaaatagtagaaataaacgtcatggctaatgcacttcggtaatataaaaggtttctacaaggaaaatactgctaacagtaaactgtttatatatagaaaagataaatcataatggagtggtaatttcagtttattttgtatctcattgtgtctctccttggggaactccaagtgctctaaagacactatctcattactattttgagtacctctgaaaaatatgcagaaagcattttctccaatttttgtttaaggatctaagtcacggaatttatgcagcttttcagtggatgaaagtggattactccttttcacagagaggattgtttcagtgaatggctgattgtctggtaagattagtcacccaatttaagaaaaacaaaaaaagaacactgtccccaacaaaaacaaataagcaaacaaaaaataccctgttaatctatttcaatacatgttttggcaacattttgtagacttgtttgaacgtcataaatacagccaggaacagaatgtgtttttctgactttatctgctaagtaaccaaccacattgttaggtgaaagttgttgataagtaagatgaaatttttaagaaaaaaattaggagacttgaggtttccagataaatgtgtaaaacagtgggaatggagctgcttttttctgttttctgctatctcagtgaggccaaccctaatcaatgacatatcaacatccctaacagagcataatctctgcatccagaaacaatgaatgaagaatggtagatcacttccttagagtttctaaggaaattgtaacagagcctactaactctttcaggcatgtgactccctaaagcacctacctcttcatgcatagctggagggtttgatgttgctgcttctctgcccacctttcccacagcgttcctgcttccccaatttcctgccttgactcagttgaatagattcaggaattacttaagttgcagcatagttctggaagatgctagtgcttgtcttcttggttgatccttttgggtaaattctttgtagaacaacttaactcatctttattaccagatataataacccatattttattgctcttaattttatgtataaccaaacatcctgttttttttttaaccgtctttcaaagagaaaatgtttttgagctactatgtactgtgaatgctgatctctggctaataattaggaaaggtaatgtgcctgttatttttggtcagttttattgcattgaccttactcctttcaataaatatttcagtggtggaaaaagagatatttgaaccgtaaattctacattagtgttttgttaaatcgttctacataggcactagttttcagctacaaagtgattagaaaatattcgttgtatttggtcattaatgaactgtttcaaagcgaatcaagaccaagctcaagcatccatcaccatttcttttccatgactgacttacaatagaaatctacagatgttaatcaccaagatacttttcctgatttgtaaaacctgagaaagttgggcattctcttatggctgctttaatttgcatatttccatatagtgtaaagcctaacagaagccaagaaattgcttaattatttgctgatcttgaatacagcccaaatgttgcttgaaatgtctatgcaattgtcttctctgcatgatcacctactaagtctgctccatgactcctccttcacatctactgatagtcagattttcttctgtttgtatcaagatttcatgtgatttatcacatttttttactttaaaacattataattgagtaatatttgttttagcttatgtagctatttcctatcactttacaaaggtctttgttaggttgtaaatttttttaactacacaagccattagatgtgtacatactcttacatctttcttgttctttccataaaacgtgtcctatctgatgcacaaggatgatattaaggtgaaagctttttatcatctaattttcattttactttcacagtcagactggattttcaatatatttttgttataaaaaactattacatatctcttgtctactttaggcatcattccacctattcctgtataacaggaaatgcgaataggcctctcactagcttagatgatgttctataagagagaagacaagatcagttatttttatatttctaaacacatttgagactggttaaaagaatataaagctatcttttggcttaatattctttattgatagatcagataaagtagaaaactgagaaatagcaaaaatttatgtttttgaatttcttaaccttcaaaaatatttcaaaatttataaactttgaatttatttgtagcttgctaacatcatgtcctgaaaactaacaatatagctgtagatataatgttgattattagaatttataagatttttagtataacttcaaatattttaaatattcttctttgcttcctattgaagagaaagcaagctcaggcatgagtatctcttttagttgaagatctcttgcctgtttgtgttgtgtgcagcctaattaattccattgaaaagaatacttaccatattcactgtattcaggtaagaatgctatttctttgtgtgtgtatttttttgggggggtctcaatttctttactgtgataaaatatgaataatataacatttgttactttaataattgttgaatgtacaattcaatggcattaagttcattcacatttttgtgcatttatcactactctctatgtcaagaaatttttcatctttctaaactgaaactctggattcataatacaataattcccctgccacctttcccccagcttttaataagcactattctactttatctgtataacttgatgattctaggtgcttcacatcagtggaattctacaaatcatacaatcattttgtatctggcttatttcacttagcataatgttttcaagggtcatttttgttgtaggatgtatcagaattttttctttttaaggctgaattatatttgtgtgtgtgtgagtgtgtgtgtgtgtgtgtgtgtgtgtgtgcgcgcacgtgtgtgatgatttggctatgtccccaccgatatctcatcttgaattcccacaagttgtaggaggcactgggtgggaggtaattgaataattgggggaggtctttcctgtgctgttctcatgatagtgagtaagtctcatgagacatgatggctttgtgaggcagagcttccctgcaaaagctctctttttttttgcctggtaacaaccacgtaagaaatgacttgcccttccttgccttctaccatgattgtgaggctttcccaggcacatggaactataagtccaattaaacctctttctttctcaggtatgtctttatcagcagcatgaaaacagactaatacaataaattggtaccagtagagtggggtgttgttgaaaagatacacaaaaatatggaagatattatggaactgggtaacatgcaggggctggaacggtttggagtgctcagatgatgttaaggtgaaagctttttattatgtaattttcattttactttcacagtcagacttgattttcaatatatttttgttataaaaaagtattacatatctctgaaatttggaacttcctagagacttgtggaatggctttggcgaaaattctaatagttatatgaacaataaggtccaggctgaggtggtctcagatggagatgaggaatttgttgagaactggagttaaaggtgactcttgttatgttttagcaaagagactggcagcattttgtccctgccctagagatctgtggaactttgaaatttggagagatgatttagggtatctggtggaagaaatttttaagcagcaaagcatttaagaggtgacttgggtgctgttaaaggcattcagttttaaaagttttaaaagggtaacagagcataaaagtttggaaaatttgcagcctgacaatgtgatagaaaagaaaatcccattttctggtgagaaatttaagctggctgcagaaatgagcataaataatgagaagcctaatgttaatcaccaaggcaatggggaaaatgcctccagggcatgtcagaggtcttcagacaaggcagcacccctcatcacacaccgagaggcctagtagaaaagcatggttttatgggtcagaccatgagtccccaagctgtatgcattctagggacttggtgccctgtgtccaggctactctagccatgactaaaagggccaaggtacagctcaggccatggcttcagagggtgcaagcccgagccttggcagcttctatgtggtgttgagccttcaggtgcacagaagtaaaaaattgaggtttgggaacctctgcttagatttcagaggatgtatggaaacacctggacatccaggcagaagtttgctgtaggggcagggctttcatggagaatctctgctagggcagtgcagaagggaaatgtgggatcagagcccccgcacacagagtctttactggggcactgcctagtggagctgtgagaagagggccattgtcctccagacctcagaatggtagattcaccaacagcttgcaccgtgtgacctcttgcttcagcgtgacctggatgtgagatacggagtcaaaggagatcattttgcagctttacgatgtgaccgttgtatctaggaagtaacttacttgctttttatttacaggctcataagcagaagggacttgccatgtctcagatgagactttgtactgtagacttttgagttaatgctgaaatgagttaagacttcgggggactttggagttaatggtgaaatgagttaagactttgggggactgttgggaaggcatgattggttttaaaatgtgaggacatgagatttgggaggggctagagatgaaataatatggtttggctgtgcccccacccaaatctcatctccagttcccacatgttgtgggaggtactgatgggaggtaattgaatcatagggggaggtctttcccgtgctgttcttgtgatagtgaataagtctcatgagatctgatggctttataaggcagagtttctctgcacaagctctctttttttgcctgctgccattcatgtgagacatgacttactcttctttatcttccaccatgattgtgaggcttccccagccacatggaactataagtttaattaaatgtctttctcttgtaaattgcccagtctctggtatgtctttattagcagcgtgaaagtggactaatactgtgtgtgtgtgtgtctatatgtgtgcacgtgcacgcatgtgtgtgtatacaggcatacctcagagatattgcaggttttgctccagaccactacaataaagcaaattttgcaatacagtgagtcaaggaatttttttttgttctctcatgcatataaaagttatgtttacactatgctgtagtctattcaatgtgcaatagcatcatatctgaaaacaatgtaaatatcttttgaatactttattgcttaaaattgctaataattatatcagcattcagtaagtcataatctttttgctggttgcggctcttgccttgatattgatagctgctcattcatcagggtggtgggtgttaaaggttgtggtggctgtgtaaatttcttaaaataaaacaatgatgatctttgtcacatcagctgactcctcctttcacaaaagatttctctgtaacctgcaatgctgtttgatagcatttcatccacagcagaacacctttaaaaatggaatcaaccctttcaaaacctgccaccgccttattaactaaattgaggtaatattccaaatcctctgctgtcatttcatcaatgttcacagcatcttcaccaggaatagattacatctcaaaaaaaagaaaaaaaacactttctttgctcatccataaaaaaacactcctcatccattcaagttttgtcatgtgattgcagcaattcagtcatctcttcaggctccgcttgtagttctaattctcttgctgtgtccaccacatctgcagttacttcctctactgaaatcttgaactgctcaaagtcatccatgatggttagaatcaacttattctaaactcctattaatgtagatattttgatcttctcttatgaatcacacacgttcttgatagcatctagaatggtgaatcttttctggaaggtattcaatttaccttgctcacatccatcagaggaatgactatctgtagcaactatagccttacaaaatgtcttacttcaataataagacttgaaagtgcaaattactttttgatccatgagctgcagaatgaatgtttgtgttagtgggcatcaaatggcattaatcttgtagagatccaccagagaaacaggatgaccaaatatgctgtcaatgagcagaaatattatgaaataaatcttttttctgagtagaaaaaaaatcctggacttaaaatatataaaaccatgctgtaaaaagttgtgttgcattccaggatttgttcttccacatatagagcacaagcaaagcagatttaccataattcttagtggctctagcattttcggaatggtaaaggtgcattggcttcaacttataggtgctttagcctataacaagagaggcggcctgtcattgaaagctttagagccagattttgacttttactctctaactatgaaagtcctagtatttcttatctttatccaataaaaggcaatagaaggttccttatgctacattgaaaatgtgttgtttaatgtagtctatcaatgatcttaactagatctcctggattacttgctgtgcttctacattatcacttgctgcttcaccttgcaattttatgttatgtagatggctcctaatgaaccaacctctgctagctgctgacttttcttctgcagattccttacctccctcagccttcatagaattgaagtgagttatggccttgctctagattgggcttttgtttaagggaatgttgtggctggttgatcttcaatgtaaaactttcttgttatcagcaataggcttttttgcttttttgtcattcatgtgttcattgtaggagaacttttaattttcttcaataatttttttttacactaacagcttggctaagtgtttgataaagagacctggcattcaatctatgtcagctttcaatatgccttcttcaatgagcttaatcatttctagcttttgattaaaaatgagagaaatgcaactcttcttttcatttgaacccttagaggacattgtaggattattaattggcctaatttcaatattgttatatccccaggaataggagggccaaaggagaggaggggagatggggaacagcctgtcagtggagcagagagaacacacagcacttatggattaagttggccatcttagatgagtacagttcatgtcatcccaaaacaattacaatagtaacatcaaagatcactgattaaagatcaccataacaaatataataataattaaaacatttaaatattgcaagagttaccaaaatgtgacagagagagaagtgagcgcatgcttttggagtaattgggctaatacccttggtcaacacaggattgccacagatattccatttgttaaaaaagacaccttctgtgaagtataataaagtgaagcacaataaagtgtggtatcttgttcatatatgtgtgtgtattccattttttattgatatattcatcaatggacatttgggtaatgctcaccttttggttattgtatataatgctgttatgaacattagtgctcaagcatctgttcaagtccttactttcaattcttttgggaatatgcctagacatggtattgctggattacatggtaattctatgtttaacttttttgaggaatcaccatattgtcttttgcaatagctttaccactttatattcctaccagcaatgtccaagagttccaatttttccacatcttgccaacactcatcttctgtttttctctttttaagtaaagaattttaagtgccaaaaacaatatatgggagatttgtaagtatattttttttctaggaattttgaccacagcaatatctaggaggggacttccaaaagctcctgaaataatagaattgaaagataaaaaaagaaaaaatatataataataataataataataactgtatttctcaacataaacttcatcaagttcaagatagttttgtaaacaatgataccagacatttattccatccctaaagaattgagggtcctgagaatgtaaccatgtcaatgctatcttttttacattattaatggaagaaaaacaagtgcctttaaagatttttttaagattaagaaacaaagcagtagccagaggagccaaatcaggactgtaaagtgtatgcctaatgatttcccatcaaaactcttgcaaaattgcctttattggatgataggactgagacggagcattgtcctaaaaaaaaagaaggattctctggtgaaggtttcttcagggtttcttttttgtttgtttgttttttgttgttttttgttttatttttcttttgttgttgttgttgttgtttgtttttgctaaagatttggctaaatttctcaaagcactcttacaataagaacatattattgttctttgaccatccagaaagtcaacaaacaaaatgccttgaacattccaaataccattgccatgacctttgctcttggcagatgtggttttgcttcaagtgacttcctcctcttggtatccattgctttgattgtgctttgtcttcaggattgtaccagtaaagctatgtttcatctcctattataattcttggagtaaattttcaggatcttgatcccacttgtttaaaatttccattaaaagctctactgttgcctgtggcttgcctgggcacaatggttctggcacccattcagtggaaagttagttcaactttttcagtcagaattgggttgagatgtttatgatgttggctatttttttgtgctattaattcttagttctcttcagttagaatactgatgttaccaggaattctgggttgagatgtattatttaactgaggacatccacagaactggagcattggaccagcaatctcagtttttgtgatagtgaacaaagaattgcaaactaacaccaaaatgcaagttcaaagcagagtttattgaagcactgtaatatactctcagagggagagcagacctatttctgtgaagtgaaatcagcccctctttacaaaactcagaggactttcatggaggttttgtgggaggagttgaggtttgggctatgtgtgagtgacaagatgaagtcatttgattggcagtttacggatacatagctaaaattaaactgtacatgtttttacccataatttgttaagaaaagccaagttggagggtgggggggttggtaaagccacatgtaaattttattataacgatggtataatgagcttgggatgaacttgaggacacagttctgtgttaggggatttccacctgtgccctagtttctccttctccaggacatgttggacacagattttattacaaactccatcctttaggatggatggagttagggaagttctggggctgaatttagatgagctatgggctgtcttagtgataacctttttgttctcttttcttacccgctcccagcttctaatatctatctaactacctaacactaacaaaattatatttttaaagacatagatgtggatgatctgccactttgggattcatcttcaacatcaacttatcctttttaaaatgaattatctatttgtaaagtgcttatttctttagagcattttccccaaaaacttttttaagacataaatgatttcacattcttccactaatcttcaccataaatttgatgtttgttcttgctttagttttagcagaattcaatttgttctgataggaactctcttcaaattgatgtcttattctttttagtgtctcaaactagattctgttcagaaatgctataacaagtaagtatgagtttatttaggtacaaaaatgtttaaaatgtatgcatagttttttcataatatgcatttttcatgaactttttgaaaaccccttgtatcacattctcttcccattattctaacatgggctggtggcaatagccttaaattaatgctggtataaaagtcaaaccaagtagctatattctctccaataatattagctacatcttattacacccgtctccttttctaaaaagtgtctagtcataattactcctactgaatgaaaaaaagtagatatttatttgtgtaaattcttataatacagtatttatgaaacctccacaattctccaaaagcagagaatatacatttgaattcatttaaagaaacaaaacaatttcaatttgattcagatagatcacataaacttaatcccctctttatatttttctttattttcaatggatcctataacatatatatgtcatttctattttgagaaaaaagtcatacaaatagtcgtaagctttaagatctggattaatatgcattattttattttaaagtaatgagtaggtgaaagtcagtgttatctagcatggaatttgatcttattctgctctttcaaaaaagaaattacaactgtaagtaacatattttaagaagactattagccaggcatagaaagaaaaatattgaatgatcttagctatatagagaattagaaaaagtggaactaataggaatgcagactagaaaatggttatcagaggcggggaagggtgatggacaaggaaaagggagatgttgatcaaaaggtataaggtttcagttagacaggagaaataagatttagtgatctattatgcaacatggtgactagaagaaataataaggtagatttcaaaattgctaacataatagattttaaatgttttcactaaaaattaagtatatgagttaatgaatttgttaattagcttgatttaatcatccaacattataaacatatatcaaaatgtcacattgtatcctatgaatatatacaattattatttgccaattaaaaataaaatttaggctgggtgcctataatcccaagcatgttaggaggccaggagttggagctcaggagttatagtccaccttgggccaaatggagaaactccatctctatagaaaatataaaaattagctgggtgtgatggtgcattcctgtagtcccagctacttgagaggttgagatgggaggattgcttaagcttgggaagtggaggttgcagtgagccatgtttttgtcattgcactccagcctgggtgacagagtgagactctgtctcaaataaaatttaatttaattcaaaaaaacgaaaataaatgatataaactacaacaaataagactgacatctaaaatgacaatataattttaataaatcaaattacacttaattatatatttaatagtttaaaaaatattgccaattaactgacaactgaaaagcagagaaggagccattattcatagataacagatgggcacatttaaagattcaggagtagaaccatagctatttcttgataagacaataatataaacagtaaggggcttttccacaaatgaaggcactatcttaaaatagagatattttaaacatgaggttttgattgctttaatgacctaatgcattcatacatttaaaatttacttaatatctactatgtgtccagtactgtgctaggcaagagcagactcaaacaattctttggttttctaattcaggtattattcaattctttacagccatcatatttttatttaagaaatggcttgtactacctaaactaattgtaaccttaaatgaagtaacaacttataatcaatttaatacattcattgactaattccacaaacatatacttatttcccactctggaccagaccttatgctccatgttagtgagcaggtatgatgcttttccctccctaaatagttcagagacatttcattataattgattctggatcagtgcactaatccagaggataaatcctcttttttcatttttggttagttatataaagcttaggataaggaatttaaaaaaaagctatttcttaacctttaaagacacaagagattttctatttattttctcaattctgtgctgcattagctaatctcaaaaactttctggcatgataccaaaatgaactgagatcttcagcatgctttgaatcagtctccaaataaagagatcattgagcttccaaatgatgttgaaactcattatcctccaacagggaagcattaagccattatcccctggaaacattattactatgaaacatctgcaaacatcagtacatggtcagagattgatgagatccacttttttgtaggtttaaatatattcaaaagatgaagaaaatcaatgaacatttataagtaatgagagaaaaaagatcttatagcttaagcccattttgtaggatgtagtaatgtacccataaaactacagaattacttataagcctattaggatgtgacattaatctaaatgtggggataatgaacatagctatagaaattgacaatcaggaatttgtaagagtgaatgcattgaaattatgagccatctaaatgaaataaattggaaatcaacaatggatataattgacaagctggaagtagcttccctgttagaggtcttgtagacttatggaaataaaataaagtcattcaaatattaatagtcaatttttcttcctaaaatctttcagataaatagaaaactctcaaaatgatcaaccttgaaatatttcagaagttctttcagctttcctaaaactaaggaaatcaaaatattcagaataactgtaaatgagatagaactgtattctgtggctcagtcgaattaggataaaaagaactttatgtaaattaaattaagatattaaaaattaataagataattggccaggtgtgttggttcatgcctgtaatctgagtacttcgggaggctgagacggggtagattgcttgagctcagaagttcaagaccagcatgggcaatatggcaaaaccctgtctctacaaaaaataacagaaattagctgggcatggttgtttgcacctgttaatcccaactacttgggaggtcaaaatgggaatgatcacttaagcctgggaagtgcgggttgcatgagccaagattgcgccactgcaccatagtctgttgcagtgagaccctgtctcaaaaaacaaacaaaaaaaccccagagtgagaccttgtatcaaaaaataggataatcaggtatatatatatatatatatttaatgtttaaaatattaacattaatatacatttagtgtaataataaacattaatatacatttaatgtttaaaaagtacaggaccacaaagtgattctgtgagcagtccttaaaaacatctgtcatattacagctacgctgtgagtatgtttcaaaatgttgaacaattatcacctgaatctttaacccaggtattggagagcaatgaccagatccctattggctttgttggcaattaaaaggatggtaaagatttcttttctcatcttaaaattgtgtttgctttcctattagcaagtattaacataatataaaaagtgatctaatattacagatcaaggtgtcaaaattgttttcatgttgaattaaatcattgttttaaattattgaatgtagaaactagcaattattacattatttcacatacacagaacaagaaaaaatgtagagtatagagcagtggtccccatgccctgggctgctaccagtctgttgcctgttaggaaccaggccatacagcaggaggtgagccatgagcgagaaatcttcatctttatttacagctactctgcatggctcacattaccacctgagctctgccacctgtcagatcagcagcagaattagattctcataggagaacgaaccctattgtgaactgtgcatgcgaggaagctaggttgtgcgttccttatgagaatctaatgtctgatgatctgtcactgtctcccatcacccccagatgggaccatctagttgcaggaaaacacgctcagggctcccaccaattctacaatatgctgagttgtataattatttcattatatattacaatgaaatatataatagaaataaagtgcaccataaatataatgcatttgattcatcccgaaagcatcccttgccctgtctgtggaaaaattgtctttcatgaaaccaatccctggtgccaaaaaggttagggaccacctacataggctgtgcttaggagtcattttgatatagatgaatatgccagctctgctattttttatacctgtaatctgagacaaatctattaaactttctaaatttaaatgttctcatctgcacaaggtatataatatctatatcttaggattgttatatatggttacttcttataaaatacttagtagaccacctcacacatagtactcttccaaaattattagctattattagtgattattatttaatcatattagttactagtgaaagtgtttgcagtgtgtatggtataactgtggcttccagatacttgtagcatacagatagcaaataagagtatttgagcaggaaaggaaagagaaataggcaaggcattcattctcttggaaaattccatgtcattctatttgcattttacatttaactatctctgcttgaaacacagaaaaatgtcacttatactatttgaagttattctaaaataatgttatgtatttaaaaatattaatacaagtagttgaacaaaataaagctaatttgaaaattaaatcaatattatctctaaagatataaaaatcccagatttacccaggaaaacttctgctattgaaatgtagtcacttaagaggtttgtgaacagaatttttaaaaatcccagtccacaaaccatcatgtcagagagacaatacctagaaaatctaataaattatgttgtattgactacatctgctgaatagtcccttatgtgaattcattcaatctattccattctttgatgaatatccttgttctaaaaaaagtctcaatttttatttcttttctttctattattggctgaaagaagctagccataaacaatcaggtccacagctgcctatgagaattatgaggctctttcagagttattgggaaactccctgagttgctgccctgcagacttaggctgattttttgcttttggctccttatcttgtcactcaatagaagaaggcatcagaaggttaccaccaagctgaaactgaaatagtctccactgaccccatggcatgaacctttcattttgttctctgggatgggtcacatcttatttgtccattgtaaatttgtagtgtctattcactgaattccctttcagtattttaaatcaatttctcaggggcttcctaggaaaacaagcacaaaagaacagaatttgagatgccactcatgaacttacttgtcttgtctttgcaagtaggatccagtccaaataaaggtacaaagccttggtcaagaatttcagttttttaaaccttatataaagaaactcacaaatctgtcattcccttaagttaattatagttaccctatgtttgccagccttatagtgtatataaaattggttataaattaacattacaaataaagttattattttacttctttgaaagtaattaattgatacatagtgaattaatatgcacaggcagttttatttcatcaactattctattgcaaaaataccaagtcacttttcaaatcttaatgttagaatagtcattatctaaaacttgagataagagtttcattacttaacatatagtgaaaaagaattcttaattctattttcattgtaagtacttaatctctgagatttcacccttccaaaatttcccacattcctgacccaatgaagcaaatggtgatccccattttggcataccagattggcaggagcaagaggcttttgcagggattcctaaaattacatgaagtcattactgatatttgcccagtaggtacttatttcacatattcactgttgacagttggactcaactactggtctcctttaggactagacttgattccactctcattggtccatatctgtgccatgataattgttaattttgaatgcagtagtctacccccactatccatggtttcagttacttgcagtcaaccttgatccaaaaatattaagcagaaaatatcagaaataaacaattcatgttttaaattccacgccattttcaggagtgtgatgaaatcctgcattgtcccactccatccctttcagtcatgaatcattctgttacctggcctattcagctgtatttactatttgcccaggagtcaggagccatctaggttactagattgaaaaagcctaggagatacagagttcggtaccatccgagattttaggtattcactaggagtcttggaatatatgcccctaggataaggggaagctactgtaatatgtattgttgccccactagaaaacctgatgctatgttgaggcccaggaagctacaaatgtatatgcacacgcattatttctctttcagattctagtgagtgcacttagagagaaaagcattgtcttgttagaaaaagcatgggcctgggaatttgtcatcctggcctccagacgcatttttgcattaattaaatttctgcccttaggtagatcatttaaccctgtctgcattccatttcatctggaaagtgtgaaagttttaagtgtatataaaagatttaagatttatagagaggatatatgtccatctaatatgcttttcatttaaaaattatatttccattttgggtcattgctaagtagaagagatgcagttgaaaaatgaaatgcttacctatcagtggacaaaatgagaaatgttgaaaaaagtccaaatgaagagtgagagacgctggaggggaaggaaagacagagagcttggctgaggctttctaagaggccagtccttcccagagagcatggtaggctctttggatggtatacagatattgtgaggcctttagttatcatttgacgagtttctacttcagtaattagtgcacagtttaagcacttaaataactgaactcttgtgcttaaggtgtaattagtctgaagagcaaaggaaatattattaaaaataagattgactttgtacatcagaactattaatagtacagctcctattgcatatgatgtagtaggtgctttagaaaggaaagaaagtttagatgtaagagatctggaaatcaaacggttagattataaaatataaatttaaaggcagcataatcaattaaatatatccaaccatcactaaatctgaaatttggaatactacaattgactcctcttctagcaatttaaggaaacaaaatgtggtatataatggccattgaacatttatcattattagtaaagtctgaacaggaattgtattgcttttattttattagaaactttttgatgccatttatatttattcactcaacaataatctgatctagcattaacgtcatcatcctcccatccccatatgattttgagacatattgtacaatctagaaataacactggtaaacattgaaaacacctgtaatcacttcatgacttaatcatcaacgtagaattgaactcacagaaaataatttgtttcactgagaagagagaccatggatgttgtccatgattattgccattaaatttcatcattcattatgtgtttctggctacagaatgataaatgaatttactgtgaaatgtaaaactgctacatattcaggaatataaaataaaatgtggctgagaataagcatctaagtaaacttcttcagatctcctgaaaaaaaaaaataattttcctgaaagtgagtggcacagccccataagccaaatttaaagaaccttttgttaggctctttaacatggcaatggtatgatgttgggggaagaggggatacatgaaaattcacactcataggctatgatctacctcctaggcaggaactactgtctgagggtcacatgataagatacctaagtgggtttgtttattggtttccctgttttagtcttgtatgggtgtggaatattattgaatgttgggcttttttggcatcaatttttataatcttttgttcttgttttttctctgtctctattttgtatgtgttaacatatgaatagaactagcagaactatcagtgttaaactaccctggtgttcctgtgattaacccaactgggatattatgcagtattatttatatggatttggcttaccatcttttgcttagaatttttccatctattttaagtgagataagagagctaagttttaaaaatatttcatagcaaatagtcaagtaatgtttcagactactgcatggttttttctttttttttttgtatttgtatacatttatggggaagaggtatgatttagtttccctgaaactacctatttgctttgcaaaaattttcttcttactgtggagagatattttaggaactaataggtctttttaaggaaacagttgtcagaagtttagaaaatttttcagcttcagtttttttctattaaattcaattaaaattaaaacatttttattaaaaaatgtgtatgaatgtgtcccatttttcaattcattatgcattctatctgaacatatgcagaaagaggtgtctaaataatgtttgtacattattatgatctttatgtttcagttttaggtgattcaaaattttatttagtcatttctagttcataaatttatgtcataatcatacatggttttatcagcaaagaaagctgtaattctttttaaaataaaatatatagttacctgttttcttgcctttaacatcaatgttgaggcaatgtgcctcaatattttctttttctacaattaagtctaaattattatcactgcaaattgacatctttgtgcataacctgcgcatatgctgggctgatgttccaacgacaagcacccttagggtctgaaggctagggtctgcttgagatccatgaccatctgttctgattggcctttgcccctgccacctttgtctttaaacatttgggctgtcatccacaggtgtatgaaagaaaatattaactaaacttaaatgtcataaatctttgtaaataaagattataaaataatattattataaactaagactcaaaagcaaatactatattttatttttcaccatcagcatgaaaataatgtgtgaactaagagttcatttattatttgcttgtttgaaacctgaggaaaactgaccagatgacctcgctcatagttctagcagaatgaggcaatgaggaggggtaaaaaaagaatcatgaggaaaaatgacttgagttccagatttgaaaccaacagaggtcacccaaaggaaagaagaagaagctatcaattaccatagcaagatgttgattctgagttggctctcagatcttcccgtctccctgctcctttcttgtggcagtcagggaccggtgaatctgcttctttttctgatgctggtactttaacactactactaatgatgatgatgatgataataataataataataataataataataataatttttgctctattttctttttctgaatagacgtttacttttgtaccttacccaagagcaaaaatgaatttccgaagcctggttattagtctctagagatataataaggtttttcactactagcaataatagcaaagaaaaatttaacatttctaggtatcataagacaagtggtcacgatgaaaactggaatcagacctaggaccagttctgtggaaaagtagaatcactttctcacatcagattttactttctagttctttgcttgcttctacttgtatctctcctctgagactgttctattgaaggtcttcagttatatcaatgcaagaattaagtatatacacctttcagcttttgactgaaattatttcatttctctaggcacttgagacagtagcctattctgttatctgtgaaaggttcttcatagatgctgagacaacttctctcatttctttccgttttgaccattcactcagatgcttctttgcttatatgctgtagccttccccatcaccttttaaaaattattctgttcagaatatgtaaggaacacaaacaaatccataggaaaaaatctaataatccaatcaaaaaatgggcagaagttttaaatggatatttctcaaaagaagacatacaaatggcaaacaggcatatgaaaatgtgctcaacatcattgattataataaaaatgcaagttaaaactacagtgagatatcatctcaccagttaaaatggcttatatccaaaacacaggcaataacaaatgctagtaaagatgtatagaaaagggaacacttatacaccactggtgagaatgtcaattagtacatccactatagaggacagtttggagtttcctcaaaaaaccaaaattagagctaccatatgatccagcaatccctctgctgggtatcagtatatcagagagatatctgtatttccatgttggttgcagcactgtttacaatagccaacatttggaagcaacctgtctccataaacagatgaatggataaagaaaatgtggtacttacacacaatggagtactattcagccataaaaaacaatgagatcctgtcatttgcaacaacatggatggaactggagatcattatgttaagtgaaataagctacccacagaaagacaaacatcacatgttctcacttatttgtaggatctaaaaatcaaagcaattgacctcatggacataatgagtaaaaggatggttaccagaggctagggagagtaatggggggctgggagggaaaagtcgggatggttaatgtgtaccaaacaaatagtaagagagaatgaataagacctactatttgatagcacatcagagtaaatatagtcaataatcaatatacatttaaaaataactacaatagtataaatatacatttaaaaaatcctgtaattgtgttacaggattttttgtaacacaaaggataaatgcttgagaggatggatacccatttcccatgatgcgattattacatattacatgcctatatgaaaaatgtgatatgctccatcaatgtatgtaccaactatgtacacaaaaaattaaaaattaaaaaatattctatttaaaaaatccatatatcttattgtatgtttcttctagagtcaccggctccaccctgatgctttcaaaaactacctatttgttgataaattgtttcagatttctctcttggggtttataactgttaatatctactcagtttttggtttgatatcactggctggctgctgcatgttacttcacactggataaatccaacagagccattttatcatccaacaagaaaaaaggagttagctcagatttttccctttgctgaatgttccactttcgaacagcctctaattttataaatgatatgatttctcatccataatatctcatctttcacctaaaaacccatgctgttctcttcgctcaacatcttaccatctctctcacctggataattgcaatggactcctacctggtctctcagcttcaaaccttatatcctcagatctgtcctgtactctgctgtcagtaaggcttctaaaacacaaaactaataattttgttctctttcattgttttggtccattttctcctgaatcaggtatgtatcatggcaaatgggggcccttcattatctggctctgtgccttcctttcactctgtcccgccttgcagtttgaacttcaagcaccctgaattcttaccagttttcggaagataacaaactctgttgagttgttgtgtctttatatcattgcccattctattatctttctctagaatgccttcctctcaataggaacatttgctttttttcttcccagcactttgtttaaatattgtcttttctaaaaaattccttgaccacccctttcttcctccttccttctctctctttcttctttctttctttctctttctttcccttgctttccctttctctcccttcctaccttccctcctctgtctctctctctttccttccttcctttccttctttctttctttctttctctctttcctttctttctttctttctttctttctttctttctttctttctttctttctttctctctttctctctttcctttctttctttctctctttctctctttccttctttccttctttcatggagtttcactcttgttgcccaggctggagtgcagtggcacaatcttggctccccacaacctccacctcccaggttcaagcaattctcctgcctcagcctcccgagtagctgggattacagccatgagccatcacacctggcaaattttttgtatttttagtagagacggggtttctccatgttggtctggctgatctcaaactcccgacctctggtgatccacctgccttgggctcccaaagtgctgggattacaggcctgagccactgcacctggccgaccacctctttctcagaaggaatttactcagctttatttcagtgttacttccattgtaacgtttgtgtacatcaatactgcagtcctaataattcactttacaactacaacatggaaataatatagaactctgaaaattgctgggagtgtaaaatgagataagtatgtgaaaatgccaggaacatagcaggtgctcagaaaagcatgaacttttttttttctatctatatatttacagaaactgactatctctggagcaatttttgttatttttattggtttctctaattaaatggttgcttttgcaccatttctctaatgcaaaaatttaaaaatatattttattttgaagtgtctgtatgtttggaagataatgacagaattgtgaatgctggcgcctagatatacaaagaacaacacctatcaaggtgtttcttacatttctttttcaaagatggcaattactgaatatttaattgctgcattaagaaagattcggaacttgataaccagtgagggaggaaggaggagggagaaggagttgtggggtctacccttttcgcttatctcttcctttccaacacacctgccacttgaaatcaccctcatttactcgagactgccacagatgcaggagaaatagtaagaaaatcttttttggtacaggctctctattggtgatactgtttatatttaagtcagcagtaaaataagatttgcttaaaacaaatgcctagggtagcttcctgtgaatatgggatacatttaggttggacatagttaggttcaatatttctcttattctgtaaagtcactttaaaccaaaatcatgttatctgaaatataaattaattaacacatcctatttaacaaaagaaaatgtcaaggtctcctaagctaattagtgattcatctttctcaactatcatttttcatccacaattagagagaaagcttttgattgttgtagctatcatttttctttttataagttgtaaaacatgtactaggacacatctttggtgaacatattgtcatctaccaatataatggcacattattttttttcatcaaaatgataaagtcttttgatgaacatattctttgattttataaaagtgatcaggtttccagtccagtgactgcaattttaaagggattcattaaacacagtggactaattatcttgagcagtcatctttctctgagttttgaaaagccagtccaaaagtgaattttattatagagttattacagagaaagatctgtaagtacacatccaaatcttttctagtgtctagttcaaatgtttttccatcttttttttggtttgtgcacacttatttagagaaggtaaaagacaggtcaggtgtgtgactgtgacctgtactagaattctctgccaggaaagcagttttgatttgaaaaattgctttcaaaaaagtctgaaaataagtaattgaaactaaagtggaaaatgtactgaaagttaataccgtaagttgagcaaataatttcttgctcaaatatacttggtttaatgactcacagcataaaatacaattattgtaaagtaatagcctattcttctaatgttttggaatatgtatgttaatttcaggaagcctcataagcgctgttttttttcatggcaatgaaaccaacttaaccctaaccttaaattggggcttaacaaaaggatgcatctcaacaatctcataacatgattctggtttgaatcactttcttggctctggcctcaaactctcttcagctccagattctggttcaaacatctactaaatgttctgaagttcttcaatgaaaaagatttgtcactgactttcttatcttcttaatgcaaacatcagactgcattctctttaaattaatggcactgccctccgtataatcttcccagctaaaattctcagagtgctctttagtcctcttcctcccttagccctccacacccattccctgaccatatcccgttagcttcatctctgaaatacttctcagatcattttctcttttccggtctcaggaccattgtgtcaattcctgctcccaccttctctgaccttgattattgctcttgttttctaactggtgtatctgcttcacccttacctaatttatttttattttaactgccaccaacttaatggaatagaatacaaatcttcttcatcttgcttaaatacctagtttttctcgatgaattatagtttatactcattaaagtatgtaagttagtgtatgaccccaaactattttcctaagggcatctcctgcacttcttacttctctttccagcccaacttttcatcctccaggtctttgcacaaactttctttctattaaaaattcccttttgtgacttgacttgtacctttctttacctatcacattgatagtcattttaagacagttaaaatgttccatttattaagatccccccaaaaattgaacctctctctattgtgaacctcatcaatagtttgagaaaatatttttcatatcatataatacagagattgtccccaaacttggtaattcccagaataacttgaggaattttaaacaactgaatttcacatgcctagattccactataaatttctgagttattattctgaagatgaggtcctacaggctccctagtaccttgagaggagtgaatttactaagtcatctctctattctcaatctcctggatgattctttgtacaaaaaagtatcttaatgagtagttgcaaaataaaagatgaactaattagttatttagtttttcattcaaatctacaagctcattctgccctactctccatcctaaatctggggtaggttgggctagtgtctactgaaacttgacgagggtatttggagatcctttggctcacagacctctgtagtgttaaagagaccctgttaaagtgaattgagcaagggctttagaaatagaactggattcatgcttggctttactttttttagtactatgatcttggacacattacctaatcaggctgagccccagttacttcacatgtaaaatggtgattagattaaatgctacagagaagagagcagggagaattaagttaaaggagatggtgaaggtaaagcatggaacagagtgggcatgtatcatatggaggttcctattacaacaaatctttagtcattttcactaacttcatgagttaacatctgataatagttcatcaatgaactctttcttccaatatttaacacattaaatctgtaactataggcacagaattttgctcaccaatttgaaataagatacacagctctcactcaattatcattcaagaggaaaacatcaagggtaaaataactccgcatctatggtctacagtcctgctttcgtctagggaaggttaaagaatgaagaccaatttaggggatataaaatatttgggaaagtctttggacacctatcctttgtacaaggccactggaacactttctgagctcccaaaggaaagaagagtccactcacactaatatgtggtgtagagatacgtctagctgagcgatgatataagaacatttgtgtatgatggaatgatgttgcagcatttatatctactcatcactctctcttaatcttgatagacttgaacaatagtaattccaaggtaagccatatcatttagaatattccattgttaaacatacttcagaggaagttattaattgataattaattattctattttaatttggccaagaaaacctatcattttggcaactgtactttgagaccatgcttcacatgatatttttgtttacactctacatctgtgcctgtgtgcaataaatcaggctcaatagtgtctttcctgtcacattccatcatgtcacactaataaaatttgacatgctcagggatgtggcgatgaataaccgtatgtgatgacaccttggggaatgcttaaaaatgatgctctgtgatggtttcaaaaccttatgtatacttccaagttgtctaagtaaccttaactaaatacattgttccagccatgaaaagatcaatttagttctttagcaccaatgtcactaaacgaaattaacatttaagctgattagtaatcactaaataacacaggatcataaaatagagtacacctaatatttcaaaaaagctctaccatatttcatgtgaatgagcagaccaaagctgtaagacactgataaggaaaaacaaagacatttatcataggtttaaaataataaccatttgggacttttgtggttgttattatcttctttattattatatctcctaaaatagtcattatttctataactactaatctggcttctgaactaaatcccctcttcatgctaagaacatcatatcatctagtctttgtcaacattctgcgtcattattcccatttactagttgactaaacagagactgaagaaatggaattaacaagctgaaattcacatagctgataagtagcagaattaaaactagaattcagatattttgtgctgtgtccaaacactgcaatttccagatccttccagtctcttgtgccccttggagctgaacattttcccaggacaccatatccttgtgggactccaaccacctttcctggagagattgccttgtggttaggattctcttcaccaagagaagaagggctagagatctctatctgagaactgagagctgactcctacaactgtgcagagaaacctccgcagcctgtgaaagcacactgggcaagcctactctgattagtagcacattatgatttctgaagtaaagcagtctctaaaacccagcaggatgcatctagaggaagtcctctttacactcttcttgaacttatatatactagatttggtgctaagctttgaaaatgaagccaacagaacattacctatgttacatgatctcaatagtctacagttttatattaaaaaccacttccccattggaataaactaatccacatgaaataatggcttatgtaatataaactattcctgattttactactatttaacttggaagtggtgaaagtggaatatatactgtagactattgagatcatgtcacccaggtaatgttctgttggcttcattttatatgtatcttttacagagatggggtttcattatgttacccagactggtctcaaagtcctgggctcaagcgatcctcccaccttagcctcccaaagtgctggaattacaaggcatgaaccaccacacctggccttaataggcaagtttttgtaaagaatttcttgctttttatggagaattggtaaaatatcctaatatctggttaaagttgacattatatattccagtttggataaatattatcaaaacattcactcatatgtttgttatttgtaatactttttctgatctagaaaatgcaatatcatagtgatttttaggggtagtttctgtagcaatatgagatagtaaattttatccacatttattatatatgatttgtcataaacagcatgttgataatgatctacacagataatgaatgagtaatgtgatgaataagaggaacatatttaggatttgtcatatgatatgtcatctttgaaaagctaataatattcttcactctctagtttaagattagtatctgtatatttcagtctgtagcatgtggacaacatcccttttcaggggcggggggaagtcttattgaatgggaatataatttgctacagctggtcaccattttttaacaagtatagatacacatctccctagcccactttcttttactttttttaaaaacattcaattccccaatgagttctgaagatttatcatgatttcatctcataaacaaatacaaaactttaaatattgggattgaaaatgactatgaagataccatctaactgtgtagtttttccaaatgcattttatctgtctaaccaaagtcaaattcctaaatagcttttgacccaaaaatagaatctagaaaaatatagttcatttgttgattcaatgcaatgtaaggtagatctgaaataaaattcccaattgtttgggaaaataatcctaatacttctcatttactaatacctttaattttgttcctaaagtgaaaccacagctaccagcaaaagcatttgttgggttgaactttttttttttaataggttgggcatctttttatatttatgggctttaaatattcttttattattattattattatactttaagttttagggtacatgtgcacaatgtgcaggttagttacatatgtatacatgtgccatgctggtgcgctgcacccactaactcgtcatctagcattaggtatatctcccaatgccatccctcccccctccccccaccccacaacagtccccagagtgtgatgttccccttcctgtgtccatgtgttctcattgttcaattcccacctatgaattctcatattcactatgagtgagaatatgtggtgttcggttttttgttcttccgatagtttactgagaatgatgatttccaatttcatccatgtccctacaaaggacatgaactcatcattttttatggctgcatagaattccatggtgtatatgtgccacattttcttaatccagaacttttatagttaaagccacagatttttttagaaagttcttaatcaaaatggtaaagataaagccaagtttggtattgagtaaacacatgggaacatattttcagtattgtttaaagacatgatggagagtgttaccagtaagtaacattatcatcaagaataataaaaaccacggattttgtacctattgtgtccctatgccaaccaccaaaataagagcttcatgtaaaagctttatagttaaagctcagtattttttaacttacaagttttgtttgttgaatgtcactttttgaattgtgaaaccttgtttctgttattcctttcttcttttgattttttggtgggggtgagaagtaaagggcttaatttatcaattttttgccttcagaacagataaattattaaagaatcagccaaatgcaatggcttattatgtgttttatgaaaaataggagagttaactctaatgtttccatttcatttagtgttatctttttttcctttgcttatctgtttgatttctatcacttctgggttatcagtaataagtctagtcaaaagcagttataacggaaacagcattggtcacttttagcaaaaaaaaatgtatttttaataatttatgaattttcaatgactaaagttgaagtggatagtagagcagtgtgttgaacctatacctgcttcataaacattttctgcatagatcttcagttgaaaagagacaataattctaaatgcaggtgtcgtcctttaaatgaattagatctattttcctcttctctccctttcttcttatttccttccccttttcatttttcttcctttgtttctttcttcttcctctcctccctccattccttcccactagataggttggcaaatataagctgatatttttacgcaagggaatgaccatttttacattttgttagtttgaaaggatttttttttctacacctaaattactatctctcaaataatgcttcttcaagcattcttcaagggttttaaaatgtaccaccgaaaatactcattttgttataaaatgagctttgataacactacatattctactatagaataaccttattagcatgtaagtgactcctagaattactatattaagaaaacctgatcaaaaatacccctttcttgactattaccatcttgtgaagtgtcacaagatgtcctatgtgtccaggacagtaatttgagaaacactaaactcagccaattgtagttatacatcaggacccatatgttctcacaagtgccttgtttctttttattttgaaagaaactatcgtggaaaactggggggaaagtcagtaaataaacttaggtggattggtattttgtaaagcaatcaaaatgctagacaattctgtgtcggttgccatagaatgaatggtcagctcacagggagaagaactcaggagtttacatgaagctcttattttgatggttggcacagggacacaataggtacaaaatccgtggtttttattattcttgatgataatgttacttactgataacactgtccaccatgtctttaaacaatactgaaaatatgttcccatgtgtttactcaataccaaacttagctttatctttaccattttgattaagaactttctaaaatttcttctttcatgttgtaatcatataatttggatgtattagatacacagcataacattatgttgctgtctgaagcattaaaataatatctgtaaacttttagatatcagtaccattgtctctaggctaaataatgagattaaggataataatagcacaaatgtatttggtgttttttatttgtcttgctctataccatatattttacatatgttgtgttatttaatcctcagaacagccatatgaggcacatgtcatttcaaggtatacatttctgtgttactttaaaatatgaagaaaatgtgattcattaagagataataacttacccattatcacaaggctgttgcgtagaactttcgggattcaaatcttggtctatcatattcagagctggtgttccaaactgattattctgcttcatgctacaactgtatggctaaaaaaagaaatcaatttgacttttgtagtgcttttctgccattcttacagtctgaaattttaagcataattggggtattacatttaccactcagctatctctgaatttcaagtgttctgctgatgagacatgaactatacagatggtgatatgtctggggtttatacaaaagatagaggatacacaaagaatgacttcagaaggtgatatatgcaagcaggttaaattgaattgatgaataaaatgataaaattgtatttcacaaaaaagaaaaacataagaaaattgcaaagcagaatgggagaaaccaagaacaaatgagaaagcttttttggcacatttgtcaaaaaatgtatatatgaataattttttggaaggcagaatcccttaagataggagttttagcatgtaacttaagggaagacatatgtgcaaacccatgtcatgctaaaattaataaacacactgtacgtaaaattaaatgtctttatatacacagtctgtaaagaactcctgcacttcaaacggaagatttggtttaaagagtgtgattatgaagtactgtatctagtttagactccgggaaccagaattaaaaggcaacttcaacttggttcaacttttcttaggaactaggaagtaaaacaagccaaacatacaattatgctgttagatgctttcagaaaagaaatgagagagtttctaaacagaatcactgcatctcaatgttgacctattgtatatcataccatgtgtttgttatcagaatgtgttttgggaaagttttacaaaacattttaatttataccttgaaaatgacattttatttgtatataagttttatattactggtggctattttctgttaaagaaataatttcagaatgtcaccatattttccacaattgtgaaaaagactttctagattggtgtcctgtcccctggcgtccacaaatgcaatgccttcaagttagactgcttagtgtgcaattattttattgaatattcatttttatgcattgggattccaacataaagtgaattcctgtgcttcaagaaaatatagaacttaatcaccaagttgtacatttaacctttgagcaatgtgggagttaggggcaccaaacccctgcacagtcgaaaatccaggtataattttaaaacgtaactactaataacctgctgttgacaggaagttttaccaataacaatatattaacacatattttatatgttatgtgtatcacatactgtattcatacaataaagtgagctaggaaaaatgttagtaagaagatcataaggaaatactctagtatatttatcaacaccttaagtttgtgttgtctgtttgcaagacgaattgtctgtctgcaatagtaggcaaccacagctgcagactttaatccatggtacatatcaagcaattcaactttttcttgtaatatcatgacttttctctgatttttgagagtactttgagcatcactactggtgctttatgtaagtcccatagcgttatttaaggtttatggtattgcactaaacatgacgaaaagtatgtgaaaagtggaaagatcactttttacttccatacacaatttattggagagatgaacttcccaagtggagatgattaacagattcttgtaatatttgagctcaccacaatagtagtaggagagggttatgaaattattacagcagtatgtacgtaccacagttatgttttatccagttatgaattaatactgcatctttacatttggttatatttctctggactgaatggtaccaggtagggtcggtatttgtgtgaatgagttttcataaattttaactttttataatagatttgtgtatattttaaatgataaaatagactaattttttgcattttttaatgcatttatgacatacctttttcctttttatatatattcttagactatgtggtttgtctgctagtttttttgaattgccacaaatttccaaagaactttccagtatatttctagaaaataattcatgtatgggaggctgagatgggtggatcacctgaggtcaagagttcgagaccagcctggccaacatggtgaaactctgtctctgctaaaaattaaaaaaaaaaaaattagccgggcgtggtggcaggtgtctgtaatctcagctacttgggaggctgaggcaggagaattgctggaacccgggaggtggaggttgcagtgagccacgatcgtgccattgcattccactccgggccgaaaacagcaagacagtgtcttataaataaataaataaataaataaataatccctgtataagtgaactctcgcagttcaaactagtgttgttcaggagtcaactgtattttgaacaaagcaaccaattcttgaaaaatgaagttggaatataagcagggtgtactttctataacgcttttaaaggattgtgaacaattgggaaaatagtttctagaattaatgatttttataaggagaataaaagaaaaatactgcagtaaaaatgtcttagagtttgaactctgtgtattccagctcaggtgaaactgcaaattatggtagctattattaaactaagctaaaatctcaaacagaaaaatgagaggtccaaatggtgattgttaagttatataacttgtcataaagttccttattatataagtaacctcatcttttattatatcttaaatggaaactaaagaaaccacaaaataagaccttctgtggcaatagcagtaaagcaaaataatcattaaagcatagatatgaagatttaataatatcatacaatatctatttcaacagaaatagtacattgtagttgactttaagtaccaataatatatatttaagcttgtttctattcaatgaaatgattagggacactaactgtcttgttagcaaagaaagccttatccacagagaaaagaaaataactatcccagtactctttctcagaacgggcatttttcttctgtatttctctttgtagcctttatagtatttataaactgattatcataagctttttcagtagtaactcctgttaagaaaacacaaatcaatggtactaaaataacttaaagctacatgaagtctttttagtgtgtttgtgcatatgtgtgtgtactgtgtgtgtgtatatatatatatctatatatgtagatatatatacaaactgttccactgcattattttagcatatctgtgagctaaactgaaggagggaaaaagtaaaaggattcagctgtagttgtactaagatacttaatttttatttattttaggtgtttaagagcaaactttatatttcttgctgtgtgcctcaaaagtcctaatgggcaatgaaaacctttctagctaatgctattaggacttgtggtcagttggttagtaaaaagtaaccccttaaagcttaaagaaattgtaagatgatacacacagagctaaccattttaacttaagactatccctgaatcccttgtagtagagctgaatactttttttttttttttttttttttgcacgggcctgctcatgctcaaagtggagttgcacattgtcttttcttgcataaaacatatccttattcatcaacaataactactaatttgggttcttcaaagtacagtgagaacttaattgatacttgtgaagctatattgttacaggccagtctttgttcttggagctcccaagatgggggcgggccactcccaagatggcaggaagccttttgttctctgacctggggttcttggcctcacagattccaaggaatggaaccttgggccatgtggtgagtgttatagctctattagaagccatgggtcaaagaagagaaccgtggaacccagtgactagtgttcagctcaatcaggacgaacccgggcacttagccttgcaggaacaattgcgaacctttagctggattgggagcacagtggacaccctgccccatccggaggagtgaaagtcaatggcaggtctgtgatggtggggaacagcagtggtggacagtgaacgaaacctcagctcgagctggaacaaacacggacctgaacagtgtacacttgcaagatttaatagagtgaaaacagagctcccataggggacccaagggggttgccactcgcggctcgaatgcctgagatttatatcccaatcattgtccctccacctgtgctctcaggcaatatatgatttgactatttctttacctcctgcttttagcctaatttgtattttagtgagccctctttactacctgattggtcgggtgtgagctgagttacaagccctgtgtttaaagttaggtgtggtcaccttccccagctaggcttaggaattcttagtcggcctaggaaatccagctagtcctgtctctcaataggaatgtaaaatctttctagatttatactatttcttcaatagtctaaggtcattgttctcatacataattcgataatatctattcctgagcctttcgaaagcactgaacctagttttcatagaaatagctctttcatttcaaaaatattttatcagtaaaaaaatattcaattaacttatataattagaagtaacaagtataactgccacaaacaggttggggaagaaatatatattcttataagcatacaggtttggatggtgggaagtcaagtgctcaagtgcccaaggatggtatacctgtcacctcatccgagctctagatactatggtttacagagaaataagaagctattggtaagcctgcaagtcagttatttagtgataagttaagagagattttactgaaaaatttcgaaggccttggataaaataagaaaccaacttttaatacacttcaaatatacttcaacattctgtttggacacttagaccccagactgtgcagatctgtggaatagttatttagaaggcatgcatttactgattttaaaatgaagtcactaaacactttattttctttgataaattttgtatgaaaacacatttcaagttgaaattgggtatgaccagaaatccaaaattttactattcatttcaaaatagggaaaaatggatattttatctcatttaggccacagtgatactttaagttttatgtcatggcccaaattgatttacctaaccaatgaaagtgtcaatccattgcctttgtagatgcagaaactacggccttgttctttgcaatagtaaacacaaatgacaaactgcttctagacctccctgagcatgggtaaatctttgttaataaacctatgaaatgtgaaaaagtaaaggtttctttcttttagtttatatctggagtgagctgggaatattgaagttgagggagttgtagggagaagtattggacagtctacccccttcagtagaaggatttgtgagtctccagtagaatcaagctttgtaacacaatctcttactgaggctgaattttttcttgttttcttgttgccttttatgtgcttgtttatttggttttccctgaggtccttgccttggtggtaggtttgtaaagaaaaagtcacataatccccattatattgtttgaagcaaaagagaacactcagctctgcttcaacactttctcccctacaggtgccaccaccagcagcacactgccaatgggctttcccaagttatctctgttctgccttcacacttcgcagatgggtttcctctgcttcaacaatactttgctcattcagaaacccaaccatttttttactcatctttcacctctcagccccaaaacaaacatctcctggccttgcattatttacccagaaaaatctggcatgatcaaatcctgggcttattcttggtaggattaacactatggaacaaaatgcaccaggaaaaaaagtgtttatatgaatgaccaataaggctggtctgcctctagccttaactgaactgtggtttccggtcaatttataacatgtggttatggtgtgaatttctatttaaaaatgcaacaacagcagtaataaattatttggggttcaaagtattcattagggcatttatgtctattaccttatttgttccttgtagtaactcaatgaagtaggcacaaataatgctgctgctgcttcttcttcttcttcttcttcttcttcttcttcttcttcttcttcttcttcttcttcttcttcttcttcctcctcttcctcttcttcctcttcttcctcttcttcctcttcttcttcttcttcttcttctccttctccttctccttctccttcttcttcttcttcgacagagtcttcctctgtcacccaggctggagtgcagtggcgctgtcttagctcactgcaatctctgcctcccgggttcaagcatttcttctgcctcagcctccggagtagctgggactacaaccttgtgccaccacacctggctaatttttgtagttttagtagaaaatgggtttcaccatgttggccaggctggtctcgaactcctgacctcaagtgatccgcctgccttggcctcccaaagtgctgggattacaggtgtgatccccatgtgtgggcagctccatatttttatagattaagagactagggctttgggggattaatttgttcaaattccaatagctagtgttggcaaatgtgatccgagcctggatcatcttattttgaagtctgagatcttaatcctgaaagacattgctgtctctaattaataattgagttattttagacttgggggaactctgagatgccaaacaataggattttgaaatcacaaaaggatctatttgaaatatagtccctgacacttacagaaattgacttgttgtataattgacctaaagtaaggggtgactggcaaaagatgtcatggtctcatcaaaccctgtagctgaaagggcactttgagttcatggcactatataataaaatcagacaaaggaaggaagcataataagttgtgaactagtaactatgacactcagagaccaattgaagaaacagagaacattctagaatatctggatgaggatttagaatatgtcatttgatttgtaaaatatgactttttgacaacattcaagagaatagttcaagcaaaagatggaagagggcaccagtttgcagtagtaaaagagtaaatgggaagtgagaaaatgacagcagttagtataatctacctttcaaaatgtttagcaagatatcctagttaagcaattcagttaagcaaaaatgttgagagtgattgtggctatgtcggtcaagttaatctatacacaggaggtcatttaccatactccttgttgattcttctcgcctatgaaattattttcttttgccttgtcaagtgttttactaactgtacagccactttttctccttcctgaatacagtaaactaaaaatttctttctgacatgttttatagcaatgtaacaaatttaatgttcttaatatacccttgtagaacttgaaaattgaaatataggtatttataaataaccagagtttattatggttaagcaaaattcagggaattgtatctcacttataatttgaaatttaaatcatttgaatcttcgttttctccatctcattttgaagtaataaaacatgatcttagctttggaattggtctttgactagaataaaaatttaagtaaacattttgatccactagtagtgtatatttcattctcacctccctcaaaaggaataaactttaataagtagagctaattatatcacagtgcttggtgaaaacgcattcaacagaaggtaaggagtatagtatgtctagtggtaccaaagaaaaccagggctttgagagacgataattcaaggcaatgattacaatttgaggctgctgcatgggccctcctggggtatgaattaatcctttgaacctttctgtttcacattatttaacaaaggacctaaaattaatggtaatacctctttgactcaaaaagttaatccctgactatgtgaaacatgtgtctggctctccttataaagttagattcaacattatgagcttttattattttataatccagcctacaccattccacaataagttcctctcttctctgtatttattaattgttatagaggtagctgtttttttatatttacctgaattttaatatttgagtaatttaaataagttaaattattttagattttagaatatcacataagtatgaaaataattatgttaaatctatacatcaaatatttaataaagctgatcctatgtgtaccctatgactcagcaatcccactttagaaaacaagttaaagaatatttattgcagttttgttcaatttagtttcaaactagaattaacctgaatgtgcttcaagaatgaaatggataaataaatagtgctatatttctaaaatagaatactgtatcagagtgaaatgaataaaatattgtcacaggcggtcatatgaatggctctgaaaaccataaatgtgagcaaaagaaaccagacacatatgctgatgaatccacctgttatctgtcttctgtctatccatccatttatcatccatccatttatccatccatccatccatccatcatctagctgtatatctaatcaacacaagcaaaattggcctatagtgggatgaaaagttagagtagtgattcttatgatgaaaagggactgtgacacagcatgatggatattacagaactctaacaatattctatttatcttttttaatgttcaaatgatatttttatttatatttttaatttttacaggtacttagtaggtatatatatttatggggtatgtgagatattttgttacaggcattcaatgtgtagtaattacatcagggtaagtaaggatccatcgcctcaagcatttatcatttctttgtgttacagacattccgattatactgttttagttcttttaaaatgtataagagatcaatgttgaatgtacacaactttttgtgctatcaagtactaggtcttatttattccatctaactatatacttttctgcccattaacaatctccacttactctcatcccaccactcactacccttcccagcctctggtaaccatccttctactctccatctccctgagtttaattgttttaatttttggctcccacaaatgagtgagagcatgcaaaatttgtttttgtgtgccttatttatttcacttaatatattctacagttccatctatgttgttgaaaatgacaggatgtcatccctttccttttttatggctgaatagtactccattgtgcatatgtaccacattttctttatctctctgttgatggacacacaagttaattccaaattttgcttactgtgaatagtgctgcaataaacatgggagtataggtatctcttcaacatactcatttactttcttctgggtatatacttaaaagttagattgctggatcttatggtagttctatttttgcttttttgaggaacctccatagtactctccatagtagctgtactaatttacatacccaccaacagggtatgagggtttccttttccatatctttgccaacatttgttattgcctgtcttttgtataaaaaacacataactagggtgacattataactcattttagttttgatttgcattcctatgatgttcaaggatgtagagtgcctttttacatacctgtatgccatgtttatgtctacttttgagaaatgtctattcagatattttgccaatttttaaattgaaacattatttttctattgagttgtttgagctccttatatattctacttattaaattcttgtcagatggatagtttgcaaatattttccctcattttgtgcattgtttcttcactttgttgattgtttcctttgccatgcagaagctttttaagttgatgtgatcttatttatccatgtttgctttggttgcctgtgctcaataaatctttgcccagactaatgacctggagagtttccccaaagttttcttttcatatttttatggttggaggtcttaatttaagtctttaattcattttgttttgattttttcatatgatgagcaataggggcctagttttattcttctgcatatggatatccaattttctcagcaccatttattgaagactgtcctttccctaatgtatgttcttggcacctttgtcgaaaatgagttcattgtagatgtagggatatttttttccgggtgctccattctatttcattggtctatgtgtttttatgtcagtaccatgctcttttggttgctatatttcagtaagataatttgaagctaggtaatgtgattcttccagttttgttctttttgctcaggatagctttggctattctagctctgtgattccatatacattttaggatgactgttgctatttctgtgaagaagttcattggtattttggcagggatgcattcaatgtgtagattgcttttggtagtatgcacattttaacaatattaactcttccaatccatgagcataaaatatcttttcactttctgtgtccttttcaatatttttcatcaatattttataatttttattgtagcaatctttcacttatttggttaaatgtattcctaggtattttattttgtttatagcttttgtaaattagattactttcttgatttctttttcatattgttcacatttaaatgctaccaatttttctataatgactttgtatccagcatctttaatgaatttgttgattagttctaatagtttctggtagattacttagatttttcccaaatataagatcatatcatctgaaaacaaggataatttgacttcctatcaagtttggaggctctcaatttctttctcatgtctaattgctctaattaggacttccagtatgatgttgaataacagtgctgaaagtgagcctccatgttgtgctctagatcttagaggaaaggctttcagtttctccccattcatgataccatgaatgggtatcatggtatatgggtgtatggtctgtatatgggtctgtcatatacagcttttattgtgtagaggtatgttcattccatacccagttttttgagggatttgtttttaatcatgaagagaggttgaattttatgaaatgtcttgtcagtatcagttgaagtgatcatatgattgtgtttttcattctgttgatatgatgtagcacattgactgacttgcatatgttaaaccatctttgcgtgattggaataaatctcacttggtcatgatgaatgatctttttaatgtgttgttgaatttatttttaaaaaatatttttttgaggatttttgcatcagtgtttatcagaaatattggcctgtggttttctttcttttcttttttttctttctttctttctttctttttttttttttttttcatgtttccttgcctggttttggtattagggtaatactagcctcactgaacaagtttggaagtatttcatttttctctattttttggaatagtttgagtaggattggtattagttctttaaaagtttggtgtaattcagctgtgaagttatatgatcccaagtttttccttggtgggagactttttattacagccttgatctcattatttgttattcatcttctcaggttttgaatatcttcatggttcaatcttggtaggttgtatgtatgtagaatttggccatttcttctaggttttcaaattaactggcatatagttgctcatagtagtctgtaatgattatttgaatttctgtggcattagttgtaatatctcctttttcctgtctgattttatttacttcagtcttctcctttttttgttagtctggctaagcttttgtttattttgcttatcttttcaagaagaaacttcatttcattgatattttgtattttttgttcgaatttatttctgctctgatttatattttctctactaattttgggaatagtttgcttttgcttttttagttatttaagatgcatcattaggttgtttatttgaagtttatcttcttttttgacataagcacttatagctaaaacataaactttcctcttagtactaccttagctgtatctcacaggtattggtgtgttgtgttttcattttcatttaagacactttaaaaatttttcttcttaatttcttcattggctcactggtcttttagaagcatattgttcaattaccatgcgtttgtatagtttctgaagttcctcttgttactgatttgtagttttattcccttgtgattagatacttgatgtgatttccattttttcgaatgttttaatgctcgttttgtggccaaatatgttatatccttaagaattttacatgtgctgaggacaatgtgtattctgcagccattgaatgacatgttatatagacatctattaggtccatttggtcaatactgcagaataagtcttaggtttctttgttgattatctgtctaggtgatctgttcaatgatgaaaatggggtgttgaattctccagctattattgtgttgaggtctctctctttggctctaataatatttgctttatattggccaggtgcgttgctcacgcctgtaatcccagcacttttggaggccaaggcgggcggatcacgaggtcaagagaatggcatgaacctgggaggcagagcttacagtgagccgacacagcgccactgcactccagcctgggtgacagagcgagactctgtctcaaaaaaaaaaaagaacaaaaaacaaatatttgctttatgtttataattactatatcctcttgatgaattgacccctttatcaatatttaatgacatttttgtctccttttttgtttgttgtcttgaaatttattttatttgctataaatatagctgctcctgctttgtggcttctatttgcatgaagtatctttttctattctttcatttttagtctttgtgtgtctctataggtgaagtatatttcttgtaggcagcagattgttgggattgcatttcatccatttacatactctatgtcttttgattgggtagtttcatccatttacatttgaggttattatcgataagcaaggatttactcctgccattttttttttctggtggttttgtggtttcttttccttcctttcttccttccttcttataaaatttattttttatagtgctatattttaatttcttgatttttattttttgtgtatctgttgtagtttttaaaatttgagaggactatgaagcttgcaaattacttcttataacccatcattttaaactgatggtgacactgattgcaaaaacaaacaataaaacatgcaaagtgaaaactaataaaaactctacactttaacttcatctttccactttttgacttttgtttctttttgtgtcttattatactgtttatatcttgaaaagttgtcacagttattatttttgatcatttcatctttaagtctttctactcaagatatgagaagtttagataccacaattacggtgttataatattcatatttttctttgtgcttactattcccagtgagctttttgcatttaaaagatttcttattgcttattaacatctgtttctttcatattgaatagctctctttagcatttcctgcagaacaggtctcctgtttataaaatccttcaccttttgttcgtctgggaaagtctttatctctccttcatgtttgaaggatatttttctggaacaattgattctaagagaaaatattttttccttcagcatttaaaatatgtcatgccactctcctaacctgtaaggtttctattgataagtctgttgtcagatattttggaacttctttgtatgtatttgtttcttttgtcacttttaggattctttctttatccttggcctttgggagcttgattactaaatgttttgaggtagttttatttgggttaaatctgcatggtatttaataaccttcttgtacttggatattgatatctttctctaggtttgagaagttctctgttattatctctttgaataaactttctactccaatctctctacttccactgtaaggccaataacttagatttgcccttttgaggctacttcctacattcgtaggcatgttgaattcttttatattctttttttgtctcctccgactgtctttaagctcactatttctttcttctgttaaaaaaaaaatctgctattgagagactctgatgcattcttcagtatagcaattaaatttttcagctccagaatttggttgattttttaaaagtatttaaatctttctgttaaatttatctcatataattaattcctaatctgtggtatcttgaattttgtttaactttcttaaaacagctattttaacttatctgcctgaaaggtcacatatttctgacactccaggattagtcactggtgccttacttggtttgttttgtgaggtcatgattttctggatgatcttgatgcttgtgggtgttcatcaatgtgtgggcattgacgacttatgtatttgttgtcctcatcacagtctgggcttgtttgtacacgtgtttctttagaagactttccaaatattcaaagggaattgtgtgttgtgatctaagtttggtctctgcagccacatctgcattagagggtgccccaagcccagtaacactgtgactcttattgacttgtagagatacttccctggtcatcttggctactatcctggagaattacccagattatcattcagagtctcttgtcctcttcccttaccttttcctaaactaactgagtctctttctccatgctatcctgcctggagtttggggaggagtgaaacaggagtccctgtgtccaccacactgggaccatgctgggccagacttgacgtcagcacagtactgagtctcacccaaagcctgtgttgactattgcttagctaccattgagatttattcaaggtccaagggctctttagatagcagatggtaaagccagccagggttgtgtctttctctgcagggcaacaggttcctttctggcccagggttggtctagaaatgctgtctgatagctagggcctgaagtcaggaacattaggaatttacttggtgctttagtttgctgcagctgaacttatacccaaattgaaagactaagtcctttttactcttctgtttcctttcatcaagcagagtgagtcttgccccatgttcacgcccaccccaggccaatggtgggtactgcctgaatcctgataatgcatattcaagacccaagaaagaactgggtcctttctttcaaggcaatgggctccctcctggctcaaggtgtgtctagaaatgttgtccaagagctaagcctacaatgggggtttcaggactctgcttggtgctttattttactgtagctaagctgttatccaagttgtatgacaaagacttctttactcctctccttcctctgctcaagtggaagaaaatagtctctcctggaaatgttagctgcactgcctggggttagggaaagggtgatgcaagcactctcctggctgccctggctggtgtctcactaggtcatgtgccctgtgaacagaggacagcaccaagacttgcccaggaattgcattccttgtgatctagaatgccttttgtgtttatttaggacaccagagtgctttagcctgtggtaatgaggctaactggaactcaggttctgacaagtgagatggggagtcaccctctggctagtgctggcctgaatgctccctctgtgggtattggtctgaaatgggggccttaaaactctgcctggtaccctactctactgtggctgagctagtatccaagttgaaaggtaatgtcctccttattctcccctatcttttcctcaagtggaaggaaagagtctcttcctaaactgtgagctgcactatctagggttggggatggggtaacataagcactcccttggctgccccagttggtgtctcactgggttgtgtgaaccccaagtccactgactgcaagcccagcatggcaccaggacttgcctaggaattgcattccttgtggcttagacattctttcaaatttacgtaggaccccagcgcactttagcccatgttgacggggctagccataacttatgttctgacttctgggatggacaattcctctctggctagggctagtctaaatgctgccaccatgagtgcaggccaaattatgccttgtgttgcttgcgctataatagagcagcactgagttccaatgcaatgtcccacggtccctgcagtctcccttccccaagcacacagattatttcttcgtgccatgcagacacttctgcggaatgggggaggggtggtctccacaattcaagactgtctttcttcagtggctctttccttgatatcatgttaaaaccaggtactgtgattgctcaccttgttttcaattcttatgaagttattttttgtgaggatagttgctcaatttgctattcctataggggttaaaaatcactaaaggattctatttagccatcttgttttgcctactcccttaaagttctattgatcgggttgctggctataaggatgtgtttacttcatgaaaactcactgatcttatgatttgttcccttattgtgtataatttatgttgtaataaaatatgcactttaaaaaatttgtgtgctaagagcaacatcctaagagaccctttatataccagtttattctctattttgaaccagaccaatagaatgctttaatatttcaacctgtaatctttctgaattgacaactaattgaaatggaaactgcagcaaattaacattgagcagatgacatttaattcaaacagtatcaaataggaaattaccctttctttaaagtgctattacaaagaggtatgctacctaatcatagatattaaatcactaatttttattcattctgttttcaagaagcatagtattgtggatataatttatgcgtctaaaattgagatgccatgtaaaagacacttagagatatgttaaagcacttattccgaagactaagctaatttgaatttgaccttttcagcaatcaaaattctgctaatacagcatattttcctgttcataaaaagatatgtgacaatagaaaaatttagttcaatatatatcaaaacatggagagggaagactaacacagttgtagctactgtccttgataatcccatgataataaaaaccccattaatatttccctcttgctgttgaccaacactcttgagggaatgtgttttctaattaattatcagaagcacaattttgaaattacataaaagaagaacaattaagttcactttttcttgatgaccttgtacaaaataaacttgcccattactccagagaactcaaaaaggagctgagtttcttctctccattactgtaacagtaggtagtatagagctgtgcaatggttatggaaaattattattctctggaaattattagaattgaatggaatgtttttattgctgattcatatactctgatttgagcgccaatcatctgcttctgcacaggattgtactttggttacatctagagttactttgcccatttcttaggggaagatattttttcaaaaacatatatgagtgcattgcatgtctactctgcaccagaaaatttgttaaattctagcaagatactggaatgaatgcattatctgtgttttcaataaatttatactaaagacaaggcataaatgcaaggaagaaattaagaaattgatacaggttatatgtaaagaataaaatacaatgggggctcatgtctggtaaaaattagttttggcaaaagtgaccggagaaggctaataagttgagcctttcatgttggctaaaatataaacatgtggcaataggaggatagcattcctggaagaagagttagaacaaggtgcagtggagaaaaaaaatgggtattaatagtaataatgagtcataaaccttgacaggaacataagctatgtatgggagcaccctgaggaacagaccaaaaagtgtaccgaagccagatcctggagaaattaaacatttgtatgttgttcattagataagtgacctaaatggtattcattttatggtaattatatttaaattaaactagagagtaaaaaaaaagatcctaaaaacgccaaagaagtaatcgaatttggtctgttcatctatgcaggagaaaagtaaggataaatactgatattaaaaagtctgcaaaaatcattttcttttaaaaattatttgttctttctctcagggagaaatgctgtagatttctttccaatgtgcctaaacatttttccccttagcttcaaatactgcattcctaagtacatccacaagttcaggtagagcaaatcttagatgtgtataaaaagttgaatgattttaattttcaaataataccttcttttatggcacaatggctgtgacaagattagccagaatcacagcactcattttatgaagaaaaatatgaagtcagtgacagtcattttatttatgcgtctgtctgcacattcacgtctaaatccttctggcatttgaatatacagcttccaaattcaggatcttgtcgggaggcatgagtcattcagaatccagcagaaatgacaagcgctggaaaatctttttgtgggtccttaatttcagtcttttatagagttagcctttttataagctgatgtcactgtggaaccaagcaaacaccagtaaacaggcaaacagcttcttggctctctaacatgcaaaggctggtctggtctaagattagacatatggaggccggctccaaattaaatcagaatagaatgatggaatcatttagtttgtgatgtaaggagcccttagagatggcctacttgagcattgacactgtgcagacatgttgtggagtactatggacaaacttatggagtggtaggactgcaatctcacacacacatattttaatcaaagcaatgtcctctgatctgatctaatttaaatacatttctagattttcatctgatgaataattcagaaatctgcaaaccaagtccagcagcttatggaatccaggttctagattcatcttatagattatgcaacagttagaaaaagaataaatggcatgtgtaggatcacaggttatttcccctcagccttctcttagagaagaaaaaatggttaacaatgtagtctgtagtatttatgatagcgtaagttaactttaaatgtcagttctttctcttgttaagttctttatcagtttcgtgttcatgtgatttcatgctttctatttattaataataatttagtgcatatgtttctcttttatttaaggaatactcataattctctccctttactacagaaatggatttgatcactgatttctgttgtttctatcactctgtgttatctttatgcaagttattctatccaccttttatcatttttaggaagtgactcaagttactctagagagctatatttggaacaacccacaagttatgtatgaacttagataccaatttaatatccatattataattaacatatttgccaaaactaattgaaatgtacattttgacaaaaacgtgtatattcctatgggcaactagacagaatatttgactgttccagaaaatctgggagaaaattttaatatatttatgtggatttaacagtgacttggcttagacaggtcttaagtcaacagtgacttagctaatgacttagactgacaagtattgatcaatgataagtatccattattgaattatggactctaagggatacaaaataagtagcagaaagaatcttctcaattttacaaaataatgagcaaaataaagcatatttaaagatagcaattagagaatgatacacaaatgtaattacagcttaccatatatgtgaacagatcgatttcagaaagtgaaagagagtttgggacaaggagtccattaaacacatggctgaagctataaacttgatttggactttgaaggaaaaatgtagtttggatatagtacctaacacagaagtcttacgcatagaagatacaaaatatttcttgaagtaaacattcttccagagaagcaggaaaagcatggagtgaccatgaagtttcactgttcctataaaacagtgggaacagagagaacacccctgtgccatagtaactctgaaccttttctgtgtaccttagacttacccatttataaaacagttagtccagtaaatagtgaaagtgagagaaagttcgtcttcaagtctcaaagtaagctactaaaacgacgtattgaaaagacaggatctggtcgggcgcggtggctcatgcttgtaatccccgcactttgaaaggacgaggcaggtggatcaactgaggttgggagttagagacaagcctggccaacatggtgaaaacctgtcttactaaaaatacacaaattagccagatgtggtggcttctgcctgtaatcccagctacttgggaagctgaagcatgaaaatcgcgtgaatcctggagacggaggttgcagtgagccaaaatcacaccactgcactccagcctcagactactgactgcattccagcaacagactgagaccctgtctcaataagaaaaaaagaaaaaaaaaagacacaattttaaaaagttagtccttatataagacttagtgcatccaaaactgtggaagtcatgtagaataatacgttcttatattaaaatctattatggctgcacacagatattgacaggaaaaactgaccatttgaagttgatacttatatagtgaaaagttaactcttaggaagaaaaatatgaaaaattaacaatcagaaagaatatgtacatattatcaattttattagtgataaaataattttgtaaatagaaattataagaacaccatttatgcacaaataaaaagaaagtatttataaaacaaattatccctaacacaaatgagactatcttagaaatattatacacagtatagctaaaagactaattcctattctatctaaaaaaataaaataaaatggatgcatttttaaaagcaagtttgctctgacctacctaaaagttaggctttgggtgaataagaagatataacaccttttttattttgtatagaaaaagtctttgcttgtttgatatagtaagatttatatgatagtattttataagaactagccccatattagcagaaaaaaaggtgaaaacagaaagaaataaagcaatttctgtcatgtggccaaatgcatgtagccaaaactaaacacttaagtatgaatactttcagattttattttcccctgtatttgcattgcttttaagtgttactttttttttttacaatcttcttttgtatataaaagggcaaacaactttgttcgtgtctgaggaatagttcctggtaaaccctctttcagccacctggttttgaaataaatgactttcactccttctgcaatagtaatctgttcttgattttaaaaagatgtttagaaaaagaaaacaaaatacttgttcacctacatgagcctggagtaatatgatatagcagttgtgttgcatttttggggaactgagaaaatcatttttcttctgctcactttgaaaataataagagccctttgcaatgtaatctccctgaggaaacaacacggggacctccacaggcaaaccacttttctagcccctgcctttctaatctaaatctttccatcaatatctgatatattctgtcaaccttgatgactgtcttggaatgtaattccaaatttactctcagcattttatttgcaagagcacaaatatcagagtcctttgatttttttagagattggcttaatctttaacactagacttggaatgttgctatgtggggctctacatttgaaagcaaaacacttggcagggaattaactttagcccttagtggttggaattgaccccctcagtttccaaatctttttcttttgtttctaacatagaaactcatttaaatgaaagagaatatattttcttttgtacaaattttgatggatcatattctttctcaccagtcgattgcaaatgggaaagtacatcagtaaaatcattacattttagtcacttatcttgaatgagtagaaactaagggagctccaaacaaacaaaccatgcagaaaaccaaaataaagtaaaaacagtctgaacaagtggttttcacacattcaaactataattgtaaatcagatgtcttttggcacaaattattagattaaagaaatgtgggagatattaatgtgagacataaaatttactgtaatctcttcttgtgtcttggactttgtctgcagtggcaaagtttggagaagcaagtgagtattcattttttctactgagtaaatcattgtggaaactagtgagcctgaatattcagattcctttccctcgaattcttgtctcactttcatattttattgtcaaaaatattatattaactgacttctttttctcctcaaacataactttgacatgtaaggatcttgttccaaagtaacaaaagttaatgacactgtgttagagttcaaaagaaacttgtcaattaaccaaacccctcttttagaggtaggaaaattgtgaatgaaggaagtcatcacttctagctggtagtaaggccagatatagaccagaagtctccttgatctcctacctgaaaacaggacttataccacatttgcttgtgtgggttgggaaagtcatttgattgtgtttcattttactgtgtttctcagatactgcattttttttctttttttttacaaattgacaaattgaaggtttgtggcaatgccgcatcaaacaagtctacatgtgccattctcccgacagcctgtgctcacttcttgtctctgtgttacacttcggtaattcttacaatatttcaaaccctttcattattattctatttgttatgctgatccatgatcagtgatctttgatgtttatattgtaattgtttggaggcaccaagaaccatgttcatatagaactgtgaacttaaccaataaatgttgtaagtgttctgactgcttcactgagcagcagttcccctatctctctccttctccttggccctccctattccctgagacacaataatattgaaattacgtcgatttttaatcctgcaatgacctctaagtgtttaagaaataggaaagtcatagttctctcacttcaaagcaaaagctagaaattattaagcttagtcaggaaggcatggcaaaagctgagatatgctgaaagcgtggccacttgaatcaaacagttagcaaagttctgaatgcaaaggaaaagttttcaaagaaaattaacagtgctactccagtgaacacacgaatgatgaaaaagcaaaacagctttattgctaatatggagaaagtttgagtggactaaagagaagatcaaatcagtcacaacattcccttaagcaaaagcctaatccagagcaaggccttaactctctttaattctgtgaaagctaggagaggtgaggaagctgtagaagaaaagattgaagctaggagagggtagttcatgaggtttaaagaaagaagccatctctataacattaaagttacaaggtgatgatgtagaaactgcagcaagtgatccagaatatctagctaagatcactgatgaaggtggctataccaggcaaccggttttcaatggcagatgaaagaggcttctattggaagaagataccatatacaactttcatagctaaagagaagaattcctaacaggggataatgtggctggtgactttaagttgaagccagcattcatttaccattcagaaaatcccagactcttgataattatgctaaatctattctgactgtgctctataaatgcaacaacaaagcatggaagacaacacaacattttacatcatggcttactgaatactttaagcccactgttgagccctattactcagaaaaaaaaagattaatttcaaagtgtttctgcccattgacaatgtacctattcacccaagagctctgatgaagatgtataaggagactgttgacctaaaagaagaagccaaggcacaaaatataattttaggtagtttacttgaaccaagatgaggcagctgctcggaagcctcgatccaagtaaccttgtggtatgagccccatttggcctttgttacaagcaggtttttagaggcaaaaaagacaatgagcgggctgatacaaagttattttttaggaatcctcatcggtttacagaaatgacaatgattagtgattatctatacattgtgaactagagtgtatgggccacagtgtccagcatgtggcattcttaggttaatttacagctatttgtggtgacagtctagagtgcatacagcaagcagcttcaagcggggaagcagattgtgactgctgcctcattcccatttctctctgggactgataattccaaatggttggaattcctcagataaatttttttctttcttaaaattaatgtttttatgcttgctaacacaacatccactctgtagcctatgtaatttcaactatcaagccctactatttaatgaaatacatttcataaatttataatgccatagatagtgatttctttgatggatccgggaaaggtaaattgaacaccttctccaaagaattaattattctagatgccattaagaatattcatgtttcatagaaagaggttgaaatatcaatattaacagaagtttaaataagttgtttccagccctcataaacgactttgaggggttcaaaacttcagtggaggaaatcactgcagatatggttttaatagcaagaaaacagccaggcgcggtgacgaaaccctatctttactaaaaatacaaaaattagccgggcatagtggcgcacacctgtaatcccagctactcagtaggctgaggcaggataatcacttgaacctgggaagcagaggctgcagtgagccgagatcgtgccatttcactccagcctgggcaacaagagcaaaactccgtcttaaaaaaaaaaaaaaagcaagaaaactagaattaaaataggggcctgaagatatgactgaattattgtgatttcttaataaaattttaacagacaaggagttgcttcttatgaatgagcaaagaaagtggtttcttgacatgcctgaaatgaatctacttctggtgaaggtgctatgaacattgttcaaatgacaacaaataatttagaatattacataaacttagttgataacgcagctgcaggttttgagaggtttcactccaaattcgaaagaagttctactgtgggcaaactgctatcaaacagcactgcatgctccagaggaacttttcatgaaaggaagagtaaatcaaaattgtcaactgtattattatctaattttaagaaattgccacagataccccaacctttggcaatcaccaccctgatcagtcagcagaaatcaacatcaaggcaagaagaccctccctcagcaaaaagatttttactcgctgaaggctcagatgattgttagcattttttagcaataaaatattttaaaattatgccaggtaccttgctttatggaagtaatgctattgcacacataatagactataggatactgtaaatagaacttttatgtgcacaggaaaccaacaaatacatgtgacttgcttcattgcaatgtttgctttattttcagtgatctgcaactgaaccaatgatatctccgagttctgcctgtgttgcattttcttcatacgaatgaatttttaaagttatacattcgatttaggaaataaaaatgtttcctaaacagagaatctaaaacaaatacccaaactaaatagaaacaagtcttcaagaacaacataaattaaaaactagctatgtaaagtattcatataaaagacaaaattatcacatatatttaagaaaagtaaattttgaaattataaaataaatatttgtcaatatatttaatttccagcattcattatgaatctatgaaatatgcaaacaaggacaatatgattaatttcaatatgattgttgattagctcagcagcaactgataagtggccataaggtgcaagaaattatctttaataacacaaaattgccatctgaatgcttttaaggcctcataaaccctgatagagtgtaagaaatagcccacaaattattgagtttgctatcaactaaattctgaataactcatcaacttttaaggttatgactagagggtatcgattaactgtcttacccactgaagcagttgttataactttagcaatattttaatctctctgtaatgaatcatgaaatctatattttaaaaaagtatttgaatgacattcagtggtatttgcatcatgaaattaaacattcattaccaccaccataaagcaaaaataaaatttaccaccaggacaaacagcctgtatgaaaacggagaaaattaattgcctgaggacattatgtagaaagcagaaatgtcaaagtgtgataggtggcagagagagaaatgtaaactggatgttttagcagttcatcccgtaagaatagcttacatgttaaattatactttgcttacagaaaggtataatttacaaaaactatgaatataattttcattttttgaatgaaataagaaataattataaactctaaaaaaaattgatcctgttatgtatgagataatatctgtctagaacttttctaaaaatgggagcttaaggattcttattaggaggatgaaaaataaattagacttatcattaactgttaacagtttgttgagatataatacactacacatatttaaagtgcacagtttaaccagttgtgacaaatgtatgcatccatgcatcactaaaatcaagatagtttaatgtatctatcacccttgagagttatctaatgcctttttaaaattccttccttctctcttttcaccccctttacccctgtaccgcttctttcccttccacccctccctgagttcaaagtaccactgaaaacaagctaattacccatccacaggggaatggataaaaaacggtggtatgtccatacaatagaatgccattcaacaatggaaatgaagaactgatatgcacaaaatggattaaactaaaaaaaaaagctaagtgaagtcagacaaatatagtgcatgttctatgattccatttatataaaatcttatgaaatgcaaagtaacctatagcgacttattgtttttgaaactaccagatgtatattaccattaccatttatactgaaactattccagaaaattgggaaggaaggactcctacccaattcattctatgaggccatcatcattctgacaccatacctagcagggacacaacaaaaaaagaaaacttcaagccagtgtccatgatgaatatcaatgcaaacatcctcaacaaaatactagaaaaccaaatccagcagcacatcaaaaagcctatccaccatgatcaaatagtatttatcccaggatgcaaggttagttcaacattcataaataaataaacatgattaatcacataaacagaactacaaactaaccacatgattatctcaatagatgcagaaatggccttcaaaaaaattcaacatcctttcatgttaaaaactcaataaactaggtattgaaggaacatgccttaaaataataagagccatacatggcaaacccacagccaatatcatactgaatgggcaaaagctgggaacattcaccttgaaaactggcaaaagacagggatgccctctttcaccactcctattcagcatagtattggaagtcctggacagggaaatcaggcaagagaaagaaataaagggcttctaaacaggaagagaggaagtcaaaccatctttgtttgcaaataacatgatcctatatctagaaaaccctatcatctcagcccaaaagcttcgttttttttttttatagtctactttctatctttatttttttttattcgtattattatactttaagttttagggtacgtgtgcacaatgtgcaggttagttacacatgtatacatgtgccatgctggtgtgctgcacccattaactcgtcatttagcattaggtatacatcctaatgctatccctcacccctccccccaccccacaacagtccccagagtgtgatgttccccttcatgtgtccatttgttctcattgttcaattcccacctatgagtgataacatgttgtgtttggttttttgtccttgtgatagtttgctgagaatgatggtttccagcttcatccatgttcctacaaaggacatgaactcatcattttttatggctgcatagtattccatggtgtatatgtgccacgttttcttaatccagtctatcactgttggacatttgggttgattccaagtctttgctattgtgaatagtgccacaataaacatacgtgtgcatgtgtctttatagcagcatgatttatagtcctttgggtatatgcccagtaacgggatggctgggtcaaatggtatttctagttctagatccctgaggaatcgccacactgacttccacaatggttgaactagtttacagtcccaccaacagtgtaaaagagttcctttttctccacatcctctccagcacctgttgtttcctgactttttaatgattgccattctaactagtgtgagatggtatctcattgtggttttgatttgcatttctctgatggccagtgatggtgagcattttttcatatgttttttggctgcataaatgtcttcttttcagaagtgtctgttcttgtcctttgcccactttttgatggggttgtttgtttttttcttgtaaatttgtttgagttcattgtagattctggatattagccctttgtcggataagtaggttgcgaaaattttctcccattttgtaggttgcctgttcactctgatggtatttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatgattttagatctaacatttaagtctttaatccatcttgaattaatttttgtataaggtgtaaggaagggatccagtttcagctttctatatatggctagccagttttcccagcatcatttattaaataaggaatcctttccccattgcttgtttttctcaggtttgtcaaagatcagatagttgtagatatgcggtgttatttctgagggctctgtcctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttgcttccatatgaactttaaagtagttttttccaattctgtgaagaaagtcattggttgcttgatggggatggcattgaatctataaattaccttgggcagtatggccattttcatgatattgattcttcctacccatgagcatggaatgttcttccatttgtttgtatcctcttttatttccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaaccttcatgctaaaaactctcaataaattaggtattgatgggacatatctcaaaataataagagctatctatgacaaacccacagccaatatcatactgaatgggcaaaaactggaagcattccctttgaaaactggcacaagacagggatgccctctctcaccattcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaggggatgtgaaggacctcttcaaggagaactacaaaccaaaagcttcttaagctgataagaaacttcagcaaatcttaggatgcaaaatcaatgtgcaaaaatttctagcatttctatacacctacagtaggcaagcagagagccaaatcatgaaagaactcccattcacaattgcttaaaaaaaagaagaaaatacctagaaatataatttacaagagaagtgaaggacctcttgaaagagaactataaaccactgctcaaaaaatcagagaggacacaggcaaatggaaaattattccatgctcatgaataagaagaatcaacatcatgaaaatggccatactgcccaaagtaatttatagatttgaagctattcccattaaactaccatcgacattcttcacagaattagaaaaaactatcttagaattcatatggaaccaaaaaaagagcctgaatagccaatacaatcctaagtgtaaagaacaaagctggaggcaccacaccacctgacttcaaactatacttcaagactacaataaccaaaagagcatgataccagtattaaaacagacccataggccaatgaaatagaatagaaactttggaaataaggccacacacttaaaaccatctgatctttgacaacacgtagaccaatggaacagaatagagaattcggaaataagaccacacacctacaaccatgagatctttgacaaacctgacagtgataagcaatagggaaaggactcctatttaataaatggtgctgggaaagctggctagccatatgcagaaaattgtatctggaccccctccttacaccttatacaaaaattaactcgagatggattaaagacttaaatgtaaaacccaaaaccataaaaacccaggagaaaatctaggcaataacatctgacataggcagaggcaaagatttcatgagagagatgccaaaagcaattgcaacaaaagcaaaaattgacaaatgggatctaattaaactaaagagcttctgtatagcaaaagaaactatcatcagagtgaacagacaacctacaaaatgggagaacatttttgcaatctatccatccaaaaaagggtaatatccagcatctacaaggaacttaaacaaaataacaggaaaaaaaccctattaaaaaatgggcaaaggacatgaatagacacttctcaaaataagacatatgtacgatcaacaaacatatgaaaaaaagctcaacatcactgatcattataaaaatgcagatcaaatctacaatgagagagcatctcacgccaatcagaatggctattagtaaaaagtcaaaaaacaacagatgctggcaagtttgcagagaaataggaatgcttttacactgttggtgggagtgtaaattagttcaaccattatgggagactgtggtgattcctcaaagagctagtggcagaaatactatttgacccagcaatcttaatacctaggtgatgggatgatttgtgcagcaaaccactgtgtcacacatttacctatgtaacaatcctgcacatcctgcagagatagccctgaacttaaaataaaagctgaagaaaaaaaattatctttatatctttcaactactaacacctaaaacaaaacaaaacggaacagaacaaaaaggcctcagtgcctgactgcagcagttttaaaagtttttccagggacaatatgcgttgccacaaaaatctgacaggaagaaaataaaaagcagatgcaaaatatgtgaaaataaaagtgacactaccagctctgcctttgttgatggcttccttttgcaaattgtcttccactaagtaatgtagtctgcataaaaatcctttcatttttcttcctcttttcttccattggctgtttgattataatattttgtatatactataagagttttcatattatctacttttttgtaactgctacatgaaaataaaaagagaagcacttttgaaattttaattatgagaaaaccaggaatcttagatcttgattcaatctatgtcactcggttactcattagaatttatatttttctcttaacagcacgcttagattcttgatttttccttttcttgttataatagtatatgcacaggttagtggatttagatttagtttcgttatatagagttaaagatatctttagttaaagatagttgacatttttgtacactttagttttgaatactgaagaaatacctcatttctatgtgaataaattattcttcaattgagtagcaaattggatgcttagacattactaaaagttatttaaataatgacaccttattagtatgtttccacatacagatctggccattaaatattgatgagtagaacactgaccttagaatgtccaagttttcatgaaaatattcactaaatgaacaataggattagcaaacaaacggattattaaacctttgcaaatagattattaaatctttgcaaatacatatttttattgcaatactagcttgatcaactaatgatatgatttaaggcatataggttaaaatggggatagtttatggaaatgctactcacacatatggagtcatatgtaatttttaaagcttttaactattaaacaggcaaaataattggtgtgaatctagacattcttttagttagaaatgttataaattgatacctttcattttactatttatagtaaatgcataaagcccaaagtaatttctaatcaccttgcatgttcatgctcactatttatgtttacaataatattaatagcgtttgtaagactacatattttcttctaatgaaagcattatagaatcaattagatcacattgcaattagtgaaaaacactataagctagtgtgttttatactaaataaaaaataatgtgaccttgaggttacctgtcactactcaaggaatattttcactgtaaatgcaataaaagttaatacatgtaattacagagtgattaaacattatttattgttcatctttgagtagatttatctgttataaattgataaaattttaaataactgcttttttataaagtagtaagaatacaatagaaaatatataaagctttctatcaataacaaaaacaagtacagaaaaacaaaaaacctagtccatgtgtactccagccaaaggcagaaatccaaaagacacagtagcaaaaggtcatgtcaggatgctagctcaccatctgtagcagaaagcagagcctgttttcagtaaggaaaatgtatgtttaatgcaaagaacattatttctaacaagtaacttatcgggaatatggagccataaggagtttagaagtaaaaaagtcagcaataaagggcactggtgtccctaaaaggccatgattaagtgtctggctgaggcttctgcttgcacaggattttttcttccctctcttagtttgcagcacaaagactggccccactggaagaaaaacttgttatccatatagtgtatcactcagttgggtacagataactacatctcttccttgtgggaagaaatcctttttattaggctttgtgggcccattctttacttacattgtttgggtgccagttatgggaggccaggctttccctttcccactggagtcagcattcttcagggcaatcctcaaaactcctgcaagactccattcccaaaccagactcttctactctaacctgccaatttttaaaaaattattacagtacagcacattcaaatctaatgtcatgtttttatattgctgttaaaatctgaaaaagacaaaataacccaaaacaaaacttaggaaatatgaacaaattaacagcataatagaaatataaggcttttactatactaagtatttacttgaattgtttctataatcaatatattggcctgatgtgttagttacacttacacattcatttaacagatgacaaaacagatcaaattgctgagtgccccacacccatgagaaaccgaagctctgatttaaactcaggctgactccagaacgatactcctaaccacaaggatgtactgccttttcatttttaataactagtttcaaaactcagatgttcctagatattattcctactggcatctttctatttttgtcacttcctcagaatttatgacattttatatacatatacacacatacatatacatataaacatccatatatgtgtgtgtgtatatataatatatgtatacattatatatgtagtatattatataatatatgtataatatataggtatatgtgtatattatacaatatgtgtgtatatgttatatatacacatatatagatataaatacatctataatatacatatatatatttaaaaatgtatttgttcacctttgtgtggtgctcagaactgtgccttgtgcttttcatgtttgaacttatttaatcattagaaccattctgtgagagtgatattgttatcctcattttatagaggttaagtgatgcactgaagatcattgagtttgcatatggttgagcttggattaaaagacttttgtcccaatctctgtacaacccaaatgctctttactcttaattagatgtaacatgcttccttcgtttctcaagttttatctctattagttaactatacattatttaatatagggacaataccttccaagtcatatacaattcctatagcccctaacacagtaagagtttaatacatagttggtgaatttatttccacccttaggattcctgtcctggtttgtagaatctccagctgagatcataaatctcctcttaaatttactacaaatacttagactcctgaaaaatgtctcatgacgacaaacttcttaccaaggagcactgatgattttgatcagacccagagaatgtcaaggtgaagattgatacaacaaaatattgatgcccatagatgtaaatattgttgaccttcctatactttcaagtttctaccaataaatttcaaatcatgaacaatcttagaagaaatatgtcccccactcccacacaaatagcctttggctaaaaaattatctaggactgaggaaatcatttatggtttctttcttctgtccaccgccaacatatgatttttaaattgtactttacagcaccgcaaccctgattctttcctccattcattttcttttttaccctttggtcacaagggaaatctggattcttttgcccacctgaggcatctgttttctctttctatctccatgttttcatcatacttctcatgtatgttttacttccccttttttctttcacttggcattcctccctacatgggcattccagtgtgaaaccatagtgatattcaggcatgcaactaatgaagaggcagattcttatctgagcttttgctgacactcttagggaaagcttcatcgtatttatttagattttttaagatatagttgtttcttatcaatgaaagttatttttttcattttatattacagaagagacattttctactaaaaagagtgtaaatgttccctgccatcactgcagtttcacagaatagagatttgctgataaatataaccactaatgaggacacagattccaacccagagtagtaacagagcatgtaagctgacaaattccagaattaggattttttatagcataatggacagaagcaaaagattctatagaaatcaatttttaaaatcacttacttgtgctttgaccaattcgaagtgaactcaggacatacaaaatggaataacagacactggagactccaaaagtgtcagcattggaaggagagtgagggatgaaatattacctattagatatattgtacactacttggttgattggtccaccaaaagccgagacttccaagaagcagaaagtccaagaaagaagtgctgggaaaataatcaaaaggagcatgtagtggaataatatgaaaaggatcataactactacctaagctactggtcagaaatagtgaccagctgtaataaaagagaaaatgggagatagtaataatatactctctaaagtttgtatgacttcctctttattaatacatggagtaaaatctgtatcattctcattaccaaatgtaggtttattatttctcaggaatactttggtcaccttcttaagccccagaattaaaaatctcatcaagtgtcattcatttcttatatatctaagagtcaaattcaagcctattaatttagacccattataaaattgtaacttaatgaggcttattctgcttaggtatgtacctgtgttccagagcagcatgactatttcctttctctaaatacacacagtactttaaatgcctaacatacgattttgtaccctttatgttgtcctttgtatcttatgaattaatcctatccttgcaggtggtctgtgagtttcttgaaaatagggattgtgtattattatcatgcacagtaaaatggcacagtaactcatccaagcattcatatcataactaaatccctaccctaaaccaggctctttcaagagcaccatagaaatgtgaagacaattttaaaaataattttaggtgtgaattcttttatcttttgatttgatgttttcctttcatgttagacatccctcctatatcagagaaaggtgtagcttcctcctttctaaaaccagtttttagaactggctaagttcagtgctgaatttattatagctacaactagtgatctatggactagcaaaactctaaatgcattttttaaagcttagggggataaaggaaagaggaggtctctattggggatgattctgtcttctctaggagatggcttgaaacagaaaacttttatctatggcatcccaagaatatgaatgttatttctaaatatgttgttaaatagactttgattttgattacatggtttgaagaaagaaaaaaattctacatctacattttaaagattccagagatccatgtatatgtcttgagttttagagacacaaaaattctattccttagaccaacctcattttccagatgaggaaatagaccctcctgaattaattgctctgccattggtctcaaagacaggagtcaggacttgaattctcattccagatctgctatttatcatcttgcataaacgtttgacaagccaaagaacttttcctggattaattttcttaaaagattgtggagattgcttccaattacctacctgtgtgattattctaactttctattttacttttttacaatgggcccacaacttctattcgtattgtagctacaatagacgtattgtagctagacgtattctagacgtattgtagctacaatacgtctctttttagactagttctctacacagcacacacacacacatacacacacatgtacatactcacacaaatgcacatacagaatagattggagcccaactcagtatggcttgttgagttgacaccagtggtaacagtaagtatggattctccaagagctgaagcagctgtgacaatcttggacaaatgtaggctgtttgccacagtatgggtgggctacaccatcagcgctgccattagaatacagataaacattggccccagtttccagataattaggctttctgactccagctcacaagcatttttagttagttctcataaatgcaggtatatgtgcataaactgatgtacagaacttctttttgaggttttctgacgtcacttatccaagttttgcagttgtatgcgaagactatttaatagacaagcataagtagtttatagcggctcttttggcccttgtaaatatctttctctcaaagtaaactagcattttttaaatttttttctcactttggcacattttctcagcttaaagttagtattttagatttaagacatagagcttctgtaaagcataatttttttcacaatttctagtattctctaagtttgaaattaaattacccactagaatttcaacagatagaagcctggagccgccagtttgaaataatggtgtgcctttgtgaacacaatcactttttaaacatctctggtacagaacaagtaaaccaagcagcagacttattattagacataatagcagacgttcaggagaatagagagatgtccttggtgttttgtaattcatctgacttgctttttcttaaaagcaaagccattggctttatactattttaatatgtcatcttaggagtttgcaggcctgtgtttagcacatgtagaacataaacacagcagagattaataccagaacaatttaagaagttcagaggaggaaatcttacttgaaattcactgaatctatttgaagggaacatatttgcaatcaattcccaaggaaaggtgaagcagtggctagatcagcattgtttaatggtcatttctctcatagatgactctcacaaattttaaattaaaagaaaaatggtttgtaactgagcaggtatcactagcaactttccagaaaacttagttgtccaacgtttttcattgacttttcttatattagaaaatgaaatgtcagatgctattaattgcatttttacaataagtagctacatcaggagtaatggctaaacgaaagtacttcctgtctaatgcacaatagatatattcatttaaatgtattcaatttagatgaatgcaatatgtctatattcattacagttatacctacctgtgggctgaattgatgaggtggtaattactacctttataaatggaacagcattgtgagtctggaggaagaaaactcattttcttatcatgtttcacacacccacacagtagacacattccaaaatctttcttccaatcataaagattttacccttgaatttccagtggacctaatgattgtaaacatgatcactcagtaggtcctgcttttccggagggttgcaaagggttggtctcatgggatatgatggaggggaactgagagtctcaaaatctcttcatgcaaagtaagtctcatgtttgttattctgcatgcctgcagtgcagctgtagtcatcatgtggcatggatttgattattcttataccatacattgttttctgagttcaatgaaggtaggactattaaaatgtgactttgttgaatacttttatttttagaacactgttctaaaaatatagtctgctaattagaaaaagcaagtacacatagttcctatacactctgcccaaccctaaatagtttctcttattattatttggcattgtgtggtgagttagtgtattagactgttcttatgctgctaacaaagacatacccaagactggatgatttataaaggaaagaggcttaattgactcacaggtccacatggctggggagacctcacaatcatgacgaaaggcgaatgaggagcaaggtcatgtcttacatggcagcaggcaagagcgcatgtgcaggagaactcccatttataaaaccatctgatctcataatttatattcactatcacgagaacagcacaggaaaaacctaccctccatgattcaatcacctcccaccaggtccctccaatgacacatggggattattataattcaaggtgagatttgggtggggacacagagccaaactatatcattctgcccctggttcctcccaaatctcatgtcctcacatttcaaaaccaattatgccttccactgcccctcaaagtcttaactcattccagcattaacccaaaagttcaaatccaaagtctcatctgagaaaaggcaagtccctttcacctatgatcctgtaaaatcaaaagcaacttagttacttcctagatacaaagtgggtacaggcaatggttaaatacattcattccaaatgggagaaattggagaaaacaaagggggtttaggccccatgcaagtccaaaatccagtggggctgtcaaatcttaaagctccaaaatgatctcctttgacctcatgtctcacatccaggtcacagtgatgccaaaggtgggttcccatgatcttgggcagctccttccctgtgactttgcagggtacattccccctcctggctgttttcatgggcagacattgagtgtctgcagcttttccaggcacacagtgcaagctgttggtggatctactattctggggtctggaggatggtggccctcttctcacagctccactaggcagtttcccagtggggattctatgtggggggctcaaatcccacatttcccttcttcattgccctagcagaggttctccacaaggccccacccctgcagcaaacttctacctggacatacaggcatttccatacatcctctgaaatctaggcggaggttcccaaatctcaattcttgacttctgtgcatctgcaggcttaataccacgtggaagctgccaaggcttggggcttacaccctctaaagccatgacctgagctgtactttgtccacttttagccatggctggagcagctgggacacaagacaccaagtcccaagactgcacactggaagaggggcttgggcccggcccataaaaccatttttccctcctaggtctttgggcctgtgatgagaggggctgccatgaaggtatctgacatgccctggagaggtttttcccatggcttggcgattaacattttgcatctcattacttatgcaaatttctgcagccagcttgaatttcttcccagaaaatggggttttattttctattgaattatcaggctgcaaattttctgaacttttatgctttgcttcccttgtaaacataagctccatttccaaactatgtatttgtgaatacataaaactgaatgctggccaggcacggtggctcatgcctgtaatcccaacgctttgggaggccgaggagagtggatcacctgaggtcaggagttcgagaccagcctggccaatgtggtgaaaccctgtctctactaaaaatacaaaaattagtcaggcatggtggctggtgcctgtgatcctagctactcaggaggctgaggcaggagaattgcttgaacccaggaggtggaagttgcagtgagctgagatcacgccattgcactccagcctgggtcacaagaacaaaactccatctcaaaaaacaaaacaaaaaacaaacaaacccacaaaaatgaatacttttaacagcacccaagtcagcttttgaatgggttgctgcttagaaatttcttctgccagatgccctaaatcatctctctcaagttcaaagtttcacaaatccctatggcaggagcaaagtgctgccagtctctttgctaaaacataacaagagtcaccattgctccagttcccaatgagttcctcatctccatctgagaccctcagcctgggctttattgtccatgttgctgtcagcattttggtcaaagccattcaacaagtctctagaaagttccatactttcccatattttcctgttttcttctgagccctccaaattatttgaacttctgcctgttacccagttccaaagtggcctccacatttttgggtatctttacagcagcaccccactctactagtaccagtttactgtattagtctgctatcatgctgctaataaagacatacctaagactgggtaatttacagaggaaagcagtttaattgactcacagttccacatggctggggaggcctcacaatcatgacaggaggttaatgaggagcaaggtcacatctcacatgcctgcaggcaagagggcatgttcaggggaactcccttttataaaaccatcagatctcatgagacttattcactatcatgagaacagcacaggaaaaaacccacccccagtgacttgattacttcccactgagtccctcccatgatacatggggattattacaattcaaggtgagatttgggtggggacatagagccaaacaatatcagttagtatattgtagttgatgaacccgtatttatacattattattagcaaaatctacagtttacattaagactcagtctttgtgttttacagttatatgagtttttataccaccatatatatttcaggaattccagttctctcccctttagcatattaaataactggataaaaataaatcaatcaatcagtcaaatgtattcgttctttcagtcactacatttattaattcatgtattctttaatagacatttggtaaacataaactctaggtcaagaattcactgtaatttaattgcttcaagcgttttcccgactcaggcttaatatgcatattttttagtcactctttttccttcctcactcaaggatattgtctgattttactggtgagcgctgatatgttctgtattagagaaactgatagtctttccattttggtgggctaatactgcgttgtgtcagcaaaagttcattggtttatgtgtgttatatttactattttattgggtttttttttttttttttgagacagagtctctctctgtcgtccaggctggagtgcagtggcacaatctcggctcactgcaagctctgcctcccaggttcatgccgttctcctgcctcagcctcccgagtagctgggactacaggtgccagccaccacgcctggctaatttttttgtatttttaatagagacggtgtttcaccatgttagccaggatggtctcaatctcctgacctcgtgatccacccgccttggcctcccagagtgctgggattacaggcatgagccaccgcgcctagccctgttttattggttgttaagcaactctgcaaaacaatctacagcctttataaacttgtgcaatgtagcatctgtatctgatcattaagaaatctggaaattatatcttccctctttttccttccattagacagataagcatgattaagcgattaagcaataaagcagtagctgctgttatgattatctttggattcacctgcacttccttatttcctttctaacttgtttttctggtggaggaactgtatattaattcatgctgaggaagatgaaattggtggtggccaacgttgataactgtggtcctaacagaaatgcatgtgttcctaaaaaataatccctgtttagactgggcacggtggctcacgcctgtaatcccagcactttgagaggccgaggtgggtggatcacaaggtcaggagatcgagaccatcctggctaacacggtgaaaccccgtctgtactgaaaatacaaaaaattagccgggcgagctggcaggcccgtgtagtaccagctattcgggaggctgaggcaggagaatcacttgaacctgggaggcggagcttgcagtgagctgagatcgcgccactgcactccagcctgggcgacagagtgagactctttctcaaaaaaataaaataataataataataataatccctgttcaattgcagtcagttaagaaacatctccaaaataggcaattatttaagcaaactttaaatatttaattgtttcttcatgtacagaaatgtagtcaacagtctggcatcctgcctgtaagtcagaaatttgtcattctttccaaattagaaacaatgctgagttgtccctagggaacgccaccgagagacaatttcacatgtttaatgtgcttttatttatcttttaatgtgggcatctttgatgaatcattaataggaggagaaaaaaatccctttcaaaactagttagtggctgacatcacaccttacctgggcattgatggaaaagtcaaattttgtttatgtctcattccaagtctggctaatggatagttggttcacactgaactataagaaaaacaattgattatggtaaaatgggaacagcattggaaaacaagaatctgcagttctgattatggatttgtgtgcaattgccactctccattactttaggaaaactcttcaatatgcaacatagatctcagaatctacataaaaaagattgttctaaaagtctaaaactaccatgtgtttggaattatacttacctacctactctaacattattccaacagtctaattctccgtgatatgaattgtgttgccagggtaggccatactgtctatgtgtgtaagagaaaagcattctctgcctttttattattattattaatttcacttttcaataaatagttactgagtttttctaagtaataagtaccatgttagatgttgtggaatgcaaagactatcctttttacaaaagaagtcaatcagcccagcacggtggctcacacctgtaatctcaacactttgggaggctgaggcaggtggatcacctgaggtcaggagttctagaacagcctggtcaacatggtgaaaccccatctctactaaaaatacaaaaattagctgagcgtggtggcatgcacctgtagtcccagctactcaggaggctgaggcaggagaatcgcttgaaccgggaagcagaggttttagtgagctgagatcatgccactgtaccccagcctgggtgagagtgagacttcatatcaaaaaaaaaaaaagaaagaaatcaatcataactttggagaaatcaacattagtaatattaatgttaattaagtacatattatgctctcttgactatgtttggaattcttaaataggtaaaagtaaaaaaaacagagattaaaaactcctgaaaaccctaattatgcaaagaaaattaaatttgctagctttatttttatttttattttacgttcctgggtacatgcgcaggatgtgcaggtttgttacataggtaaacgtgtgccatggtggtttgctgcacctattaacccatcacctaggtattaagcccagcatacatcagctgtttatcctaatgcactcccatcccccacccaacccctggagaagccccagtatgtgttgctctcctccctgtgtccatgtgttctcatcattcagctcccacttataagtaagaacatgtgacatttggttttctgttcctgcattagtttgctgaggataatggcttccactccatccatgtccctgcaaaggacatgatctcattcattttcatggctgcatagtattccatggtgtctatgtaccacattttctttatccagtctatcactgatgggcatttgagttgattccatgtctttgcgattgtgaatagtgctgcaatgaacatggtatgcgtgtatttctgtaatagaatgacttatattcctttgggtatatacccagtaatgggattgctggatcaaatggtatttctagttctagatctttgatgaattactacactgttttccacaatggttgctaatttacattcccaccaacagtgtaaaagtattcctatttctctgcaaccttgacagcaactgttgtttcttgactttttaagcatctccattctgactggtgagagatggtatttcattgtggttttgacttgcatttctctaatgatcagtgatgttgagctttcattcatatgtttattggccacatgaatgtcttcttttgaggagtgtctgttcatgccctttgcccactttttaatagggttgtttgtttttttcttgttaattcgtttaagttatttgtagattctggatattagacttttgtcagatggatagattgcaaaaattttctcccactctttaggctgcctgttttctctgatgatagtgggttttttgttgttgttgttgtttgtttgtttgctgtgcagaagctctctgattagatcccatttgtcaatttttgcttttgttgcaattgtttttggcaatttcatcatgaaatctttgcctgtgcctgtgtcttgaatgctattgcctagattttcttctaggatttttgttgttttgggttttatatataagtccttaatccatattgagttaatttttgtataaggtgaaaggaaggggtccagtttcaattttctgcatatggctggccagttctcccagtcctttcccaattacttgtttttgtcaggttcattgaagatcagatggttgtagatttgtggtcttatttctgagttctctattctgttccatgggtctatgtgcctgtttttataccagtaccatactgttttggttactgtagccttgtagtatactttgaagtccagtagcatgatgactccagctttgttcttttagcttaggattgtcattgctacacaagctcttttttgaatctatatgaattttacaatagtttcttctaattctgtgaagaatgtccatggtagtttaatgggaacagcactgaatttgtaaattactttgagcagtatggccattttcatgacattgatttttcctatccatgagcatggaatgtttttccatttgtttgtgtcctctctgagttacttgaccagtggtttgtagtcctccttgaagaggtccctcacttcccttgttagctgtattcctaggtattttattctctttgtaaatttgctagctttgtatgagatagtggactaaaggtgataaaaattcctctcacctgcccaaatttccatcaggaatttgctttgtagactcaggggaaaatagtattttgtgaaaaataattttatagtgtcacatgcattcagtgatacacacacacacacacacacacacacacacacacacaaacagactgcagaacatccaaacattgagtacctatataggggaagaaaaataattttcttcttctcaagcgttctgctgtgacttcctgtaacaaaagacaaattaacaagataagaaacagaagtttgataacatgtatacctcttgtgcacatgggagataacctggagaaataaataaacttatagactaaatttcaaacaattgtcttagacttcaggcttaaatatcatcattctccaaaacaaagaagtacgcagtgaaaggtaaggtaagtacgcagtgaaaggtcaggttaagacccatgaaaagtgctactacaaaacaggaaagtgtttgttatgcagatttaaatctatgccttttccattgattaagagtctctagtaatttagagctagccctctcttaggttgtcttaggtgtcttaggagacacctttacaagtaaagatttcctttataggtgtaaatttatctagaaaagggtaggtaacttttcaaaccttctcctgtgtctataatttcttaaaataactagttcacaattatccttatgctaaggaggcatactggagtggcatagttaggtttcctacagtcatattttggggtggcatattctgagccccatcacctatatttgccatgtggtatacttagtacttccctaaaaattatccaattttttcttcacaacaatcttgtaagctacttattattatcccccttaatctattctgagataactgaaacctgtagagtttgaacttctgtaagacagaggctgacattcaagctagtcaggtctcaaagacaaagatttttttttcctattataaaaacagaataaataagtaaatgaaacctccaaagcaagttttctgttatccaagctgttacagagatgcagaaagatgatggatgccaaaagagtgttctgactcagcagcagccacttgattggaagaggggaaaattcactctctttgaagtaggatttcatttggggctaatataatagaacgagttagagaatattagaattcttaaagcaatctcttacacataacagtgaagggtcaaatgtgggctttcatgcaaagaatatgaattcaattctcacagctctgtgctggtattacccataaggagctatgaagaacagcaattgatttcttccctttcttttccataatcagagcacatattcacaaccaatgcaacaagactactaccttgcattttcctagtacccatctctcagcttcaagagcattatgcatttttaaaattataattagttctctcactcttcctgggagttaactgctccatatcatcccaaacccacaaatgagttagcggagacagcctggagttatatggcatctggataaatgcttagcaattggaacagccttgagtatggtgaatcacgcctctgaagtcaggcagatctgagctttaatccagtgaatgaatttctaaacatgtttgtgccttattttccatatctttaaatgagataataatagaacatacttcatagggttattgtgaagattaagtgggtgaacaagtgtgaagtgcttggcacatttctagtttacaatgtagttcatgaggagttaatgtgtaataattacaataatagtaacaatttgatagcaaacattcatatttctaagtgcattactctagtcaacactagccactttaaaaaacatacgtgttttacgcattaatgtaaaatttttggtgtgaaaaagtacatattctctccttgtacccaaaacattaattataaaaagtaattaaatactacagaattcatactgaatgacaacaaaaaatgcccattggcattaccgaatgttttaaaaatgactcttgttaagataactgtcatattcaatattcaatttgtaatttattttcaacctttaatgaatcattgagagtgattaacaagaagctttcttttatgtcatacattttttttctgtcagataagctttcaaaacctcttcctctaggcaaactgtaagaagggaaatttaaataactggcaaatgaatgaattcattatatatcaaatcttgtatctataattctttctttattttaaaactttactgatactgagaataggtcatcattttttactcctttcatatatgacacttcatctctaaatatatttaaagattgtgtaattatttcagagagtaaatcgtcttatttaccttcaggcctattttttcagtaaaagtatcctgtcattcaacaaaaagccaagaaatagtgtgtgctaataatgtgtatataatgctatgtgagagagacattaacttctaattattcttaagtagtctgatctaggtaacccttaatagcaatttgtgattatcactctatcacaacttatagtttttacctctttacatgtaattctttcccattaaactgtaaactaatgagtgtaagacccagtaagaaattgacatttagaagttgctaaataagagattcttgaatatatgaatacttaataaacagttgaatgaatggatggttacatgtgtggatagatcgttggatggatgaggtagcatggagacagtgaaaagcatgcccccctttaccattacctagccattagattttatacaaaacatgaaattactaaatatcagttgcctcttttgaaaaataatagagatttctatccttataattcagtctatgtttgtatgttttgtggtagaatttatactcctcctgttcactctttctctcttaataaagaggccagaatatgccctggagattgtcattagcaccttagaggtaagaaagataagaatatctgcataatttcctggcaagaataatgaagcaagaaatgtgatatgtagtttagtctaacgaccttgtaaaatataagtgttcagaaaaagatggtattaaacttaaattttggtgaagctgtcttaaaattgtaaaattttgaattaagaatcatcaatatgatacttaaagaacgttttagaaatatagaatgtttagatgaaggtaaacattcactcttgaccattgaactactgtcataaaatcacctacataatctgaaagaatataaaaatacatttttagcctcaaatctatcctgaattttcagttgttcccctacaccagctcatgaggctaaggtatttttgagcactaaggcagtgttgaccaatgtctaagaacattgtcagttttctaaggctgctgtcataaggaagaaagaagaactatgattaggccgggggcggtggctcgcgcctgtaatcctagcactttgggaagccgaggcgggcgcatcacgaggtccggagatcaagaccatcctggctaacacggtgaaatcccgcctctactaaaaatacaaaaaattagccgggcgtggcagcgggctcctgtagtgcaagctactgcgggaggctgaggcaggagaatggcgtgaaaacgggaggtggagcttacagtcagccgagatcacgccactgcactccagcctgggcaacagagagagactccgtctctaaataaataaataaataaataaataaataaataaataaataaataagaactatgattaaaacaaaggaatccctagtttcaatccagtccctgtgattatactaagaaaggacatgaaaaataaataaataaataccggctgggcgtagtggctcacgcctataatgccagtgctttgggaggccgcggcaggtggatcatctgaggtgaggagtttgagaccagcctagctaacatggtgaaaccccgtctctactaaaaatacaaaaaaacgtagctgggcgcggtggcgcgcgcctataatcccagctgctggaggggctgagacgggagaatcgcttgaactccgggagggggaggtcgcggtgagccgagatcgcgccattgcactccagcctgcacgacagagtgaaactccatctcaaaaaaagaaaaataacttagtgagaaagagtggagaaataatggtttcccttgattctaagtctactaaatcaagggatttagcaccatctcaatgctgtattcccgtctcacttctcaatagtgattgtatcagctggcaattttcctagttctttcaacaactgggttttgaccttgaaatcagtctccattctcattactggctacagcctgtccactaattttttatatcctccattattctagaatgtaaccaaattcttactttaactctcttaggtaggcaatccatatacttggtctagttgtgctgttagttaatggtatcattcccttctttctttttgccatgtgttttaccctcttatatttgggcttaaatcattatgttacacacgtctaaattaattgtcccattacttcaccccattctgaaaatatgcgtaaattatttctgcttactttcttttctggtcagctatttgcctatgatgtacacttatgacccgatttctttctattgagggtagtcgttttggagaaacaaagataaaatccattctttagtttgttcattcattctttatacatatttacttggtattctcaaagtgccagtcactcttttatttggtattgggataatagagcagaagttatagaatggtatgaggcataaatatataaaccatgattatccattaatttgcgtagtgcatattaagtagcacatattctgggctagacaacatgttgtttagtattgtgtaacaaaaatgaataaaatagcttcttccctcaaaaaattggtggaataaatagacatgaaaacagataatttaatgctatgtgacatatctggtaatagaattaaagaggaaaatatagaagcagggtttgataaaatatgatacaggcaaggtaagaagtttttctggtatattgagaaggttggctttaaaggaatatagcaaatcacagctgtttactaacaaaggagccaggcataggttgtttgaattcaaattccttctccgcttgttaacttggagcccatgagtgtgtaatctctctaagcactggttgatgcatctataatgcagactaaaatagaaccttactcatagggttgttgtgaggaatgatgagataattcatacaccttgtgcatagtttatactcagtaaacatttgccactattattctataatcaaagagattctataatcaaaagaggattttaagcaggagaattatgtagccaaaactgttttaagtggagcatactacaaattttcaggagaatattttgaagaacatggacataaacccattggtaatgtgcagcaggaactgatgcttgtggaggaggctttggcaatgttgaacataatggatacatcaggctctatctatagtgtgaatggggacacccatgggagagcatatgaaatggataaatcatttggctgaagatagaattgcataggacactaaaatttaagggataatatcagaaaaacagagggctatggaggatataaagaagaatggccagtgatgtgcttggtaataggcacaatcacaacctagaaatgggtggcaagaagaaggatgaggaaaaaccaagctccagaccagggctactttagaaatcatgatatgtcagttgataagttagggatgatgcaaaactaaaagttattctcacagtgtcatgaattcccagaaaacaatgtgctccgtcatatttctttaagttaaataccaccttgattaatacgagatctggttatgctattagagagaagtctaaccaacatttatgtattttttcttaaaggattttgcagaaaagaagtccacagcaaaggccctggaagatgtaaaggcaaacttttactgtgaattatgtgacaagcagtatcacaaacaccaggagtttgacaatcatattaattcttatgaccatgctcataagcaggtaaggcaaagtgggaaaagtccttcatattcctgtatttataccttcagaacagaactgtatgaatttgaccttatttactgccatataagactgtgaggtaagaacattttatgtcttttttcccccctggaaaggttgtgttttgtgtttaaatgttatccaaagtcattttttcctagaactactataaagctggaggtaaacttagagataatctgagagtagactgacatatttattttagaattatattcagttaacccttaaacaacacagtggttaggaatgtcagtcaaaaatccacatataacttttgcagttaaaaatctgcatatgatttttaattccctcagaaatttactaatagcctactgttgaccaggaagaagtttactgtaacataaacaatccattaatgcatgttttatatatgttacatgtattatatactatattattacaataaagtaagccagagaaaagaaaatgttattaagaaaataaggaatagaaaatattgttactattcattaagtggaagtggatcatcataaaggtcttcatcttcattgtcttcatgatgagtaggctggggaggaagagaaagaggaggagttggtcttgctgtctcaggggtggcagaggtcaaagaaaatccacatgtaagtggacccattcagttcaaaggtcaactgtatgtagggaaaccaggacccaggaaaaataatgtcttattcaaagttacttaactagttagtgacagatttagaatcctggactagtactaggacagaatctattattatagtctacatctttgttcaagggtcaactgtatgtagggaaaccaggacccaggaaaaataatgtcttattcaaagttacttaactagttagtgacagatttagaatcctggactagtattaggacagaatctattacagaatctattatagtctacatctttcaaggattctaagttataggaaatattaggtctttgggaaagcaattctcaataaaagattacattttcctaagcatactctcttaagaaagtcaaagttgttatttaataaatgaaacattgaaaacaggcaaacaaaaaatccaaaagggaaaagcctaggggtaatcacaggtgaaaacatttcagtttatttacttgaaagatcatatgggcatctatattattagtgtggatatactacatatggctgcctaaattacctactctccaaatgtgaaggaagaggctattgttctcatctggttagatgttatccttgctgattgaggtatggcgatactggcaatttaggaatgttaaataccaccgactgagaaaaaaaatttcatgtggccaaagattattgctaacagctgtaacaaggtacacattcctgataccaaatggacctggcatgttggaatgtgtgggtaagtcttgtatactctatctcaaatatttattcagattaaacaaaaataaatctttcgtcagacatcactagcattatattgagtgtatactaaatatatatgtatatatatgtatatatgtgtgtatatgtagtatatgtgtgtatatatgtatatatgtgtgtgcatatatatgtatatacatatatgtgtgcatatatatgtatatacatatatgtgtgcatatatatgtatatacatatgtgtgcatatatgtatatgcacatatatgtgtgtatacatatatatacgcacatatatgtgcatatatacatatatacgcacatatatgtgtatatacatatatatacgcacatatatatgtgtgtatatacatatatatacgcacacatatatgtgtgtatatacatatatatatacgcacatatatatgtgtgtatatatatatatccttgggaaatgccagcctgacgaagacacagcttttatccctaaacgtaagatatatgtatatagttggcttcgtttctctgacaagggcaagataatgagataaactgttttaggattgtaattcccaaatcctagtgtgcataacaatgacctcagaatatgttaattgttcagattcacagaatcttcctcagatattctagttcaataattctgagataggatctagcaatctatattttaaaatgaattgaaaatgaaaaatttcaaacgtatataaatgtgaactaatggctatcacccaacttcaatgataatcaatcttgcttgatttataccatcatcgctcaccacacctccaccattgttacattattttgaagcaagtgccagatggtatatcattttatctaaaagtatttcaagatatatggtcatgctttaaaattgatgctttgattattatctaacctaaaaatcaacagtaaatttttaaataccagttagtgctcttgttaccttagtggtcttataaatgatttgtaaatttgagttcattgaaattaggatccctaaatatccacacttttggttggcatgtcttgaagtttattttggtatattttaatctataggtttttccatctcttttaaaattgtacattttgcagttccttttcacatttgggattatgcaaaattctactcactgttatctttcaacattttccttggtttccttttcactggtttttatggatagagatttggccaaattcagacatatttttttcatggcaagaatatattagagggtattttgtgtccttccataaggaggcatataatgtctggttgtctctctttttataatcttaagtttgatgagtgagttgaggtactatcagattattgatccatttatcattaagtttccactggcttttttctcactaatgatttcgtagacatcaatgatcatttgctcaaatatctttatttgtatttataaaatgatgattcaaattcttttacccctgctacatatattagatagattacgtctgtaaagagaaacttcttataagcaccaccgcctgtgggattttatgcaggtggctttcaggctgaatattaagaaaaatttattcagggatttggagaaataaaagaccaggaaaggtctcatgcaacagtggaatttgatttgtgccttacacacgtataaatggatgttaaaatagaggatcaaggtgagatggcattcttgtcagtgggaatagaagctaaggtgagaaaatcgaagagcatgaggcatcttttgagaactgtaggaagtattgaactacctggggtgaatcttccatatcaggtctgcatgccacagcatcccgtgtactctggaatcctgcctaatcaatttgtttttttatcattttcttcaatcttatttctattagctatctaacatgttgataaacaaccttcctcaatatttctattctattctattctattctattctattctattctattctattctattctattctatctatatgcacacttccatctttcatttatttgcttgtttcatttgtttattgactttctgtcattctaactttcctgggtattctccttcattaaacaatgattcggtttctactgtgtgctactgtgtccattgtgaaaaagcgacacatttggcttccaccttcagggagctggtaatctaaatgaggagaagacaaatcagtagatcttgtgatacattaatttaagtgttgtaaaaattttatacgtaggacacttaaaagagagcacacaaaactgattccagaaagaagagaagataaatgagctggatttcttaaagactgaatagaagctaactgtgtactcaagaataataggtcctatatggtagaaaacctattatcaaggcatgggggcagttaaaaagcgtaatctatgaagaagcaaatgattcactatggctgcttaaggccatcatcactatcttggggatcactttagaaatctttgaaactgcatcctatttacctctgctttttgcagtgcatcttgtcctcatttttcattttgcattctcatttccaccatcataattaatctcacttctaaattattgctgaggtcttcaaactggactccccacctccagtatttttcctgttccacaccaatccatccacttatgaccagataagtcttttcaaactatcccatttatatgatcactcttttcctaggaaatctttagtgcttgatgactgattttggaaagggtctgaactgcttatcatgctattcaaatccacaatctggctcttgactccgtttccagatttatcttctgcaaatccagaatttccttacagtttcttcaaacatgtcttatgctttcccacatgctcatcttggatcattatcttctctctccctgaagtgccctcttgtcttgtgtctctttttcaacacatacttctgcatatttaatgcagaaattgacaacttatatgggatattaaaatagctgagatttcatggtaaactaatttaacacagaattttaaaaataccttttgcttgaaatctattaatattattgagaatttttgtatacgcttcccactttaaaaaacattggaataattaaatttgctataaactttgttagactgctttcttggataatattgaaatacttccatttaaagatttattttagcccaaaatattttgaaaattacctcaattttggatgaagctgagttacactgaagtaaatcatgcaaaagtatatattttttcaaatttcaaagctaaatctgtccatttggttctttcttctttaagagctcttcttgattatgataatgattataatggtggtggtggaaatttggctattttttggcctgagtaacgtgaacagttgccataattttactttccatgtagattcagatgaactagctggcttcttctgttgaccttccaaaaatatgctctttttggtacacttagaagtaaatccaaatgctcatgaaatccattctattactcatcaatagaacatcttagatctgataacgaaataatctatgaatactcttctctgcttttccttcattcatgtataattactcaggatcccaccgcttaataagtaatttctgaagcatttgttattatcgtctgtcagcatcatgtgtttattttatcacaaagattatattttcatggttatattgtaattctagacgagtaagtcaacacacaacttcaagaaataaagtaaaagagtatgtgatacatatatttaaatgaattccattggagctttaaaaatatttttctataatttgaataaaaattaagattatttatttatttatttatttatttatttttgcctcatggcactccactatgggcaacacagtgagacctgtctccaaaaaaaaaattaagatattttcttaagtattatttgtagagaaaggcagctcatcaataacacacctgattttttaaatttcttcagtgaggaaaaataatgaatttctagctttgacaagccactctatatatagctcacgtttttggaaacaactcaatatcttagctattgccttgaacttcttaaaattctgtgtaaatgttgagtattattcctaatgcagtttgaatgtgtatacaaattataatcacttagataaagacagaactgtaactattaatataggtaacatgtcaataacagctaattccttgtgagactacctagaagtcataatccctttctcaagattgttagctgcaaatgtattactgggatgaataatacacatcctcacatgcagcagaactctctcctgccccagggacattctgactcatctcaattttgaaaaaacaaatgagccagatccctgtacaattaacccataaaaaatatctttaataataaaaaacaaatccactttgaaaccctccacatgtgacgcttcatccttctaatctccatttgcttcacaataggatttatttttacccagaaggagctgttcacttgtcaagccctggatttgaactccaacggattcattgtttaaaatactgttttggattcaccccatctctacttgctctggataacatatcaaaacagaactaccattgtcatcttgaccttaagaggaaaataccccaaaattgctaaaagaatttaatctaattccctttttttgtttctgcaatttgatttatattttccccaaatactgcccaagtgatatatagtatgtttaagttattagtcctctaaaagtgctaacaaaatgtcaaagtgtagatgagtggtagggtcagcaacattgaagaaataaagactggagtgcctggaatgaataccttcagtaccataaaataatactctctcctgttccattttgcattctgtaaaccaatatttctggcaaagtatgtgtgtgtgtgtgtgtgtgtgtgtgtgtgtgtgtgtgtatgagtgtgtgtgtgtgtgtatcctggaatcacccagcagtagttgcaacctttattagcagagaagtataagacaaaagaaccaaaggtgatcttagcttcctgctcctatttaactctcccaaattactgtctgtatcttagccaagaggctttttgctctcaaggttctccttactgaaaaatatattaaaaattctgcattctggctccttctgacttccagatatatcaagtagtttccttctaccttatgacactggctatagctgactgttccctctgtctggaaaattcttctatctgaccttcagtgttctcgttctcttcatttgtgtctcagcttagatgtcacctcttcagtaggacatttcccttttaccttaagtagtcagttaccaattttccagttctaatgtcctgttgccactatcagtgggggtgtaccttgtaatggccagagccagctgttcaatattcaagaactttgtgagctggttgtttaactattggtagattgaaatcagccataataggatatctacaaacactacaagtcagggctttctgtgttttgtttggttttttgaaagagttgatagaccagcagaaaactgcttattattctttaaaaagaaaaaaaattactttttaaattttgtcctcatactccactcccagctattaaccttataaagggaagggcatggttctattagccactgtgtctctagaacttagagcaatttctggcacatagtaacattcagtagattttttttaaatgaaaaagtagctgaataacttggtttttagagtagaccatttcactctgtcctatgtcaatacattgacctatcattgactaatcatttcttaagtgaacagagtaaatactgtggtaaacatatggggtgcctaatctcaagttatttatgattattgaacaaaaggtgtcatgaaatgacatttttataatttaagaaaatatttgatcccatattattgttgacaaggtgtgccaccccagtatgttcagacttgactttgtggaaaattgctaatcttcaaggacttttaagcaagcaaatgatatgactagatttgtgatttagaaaaataatcctaaaagcagtttatgttggtacacaagaaggagagcttggctctgtgatgagataagcgttcaagagttcaagagagacaataggagtctttataacaatgacaatgagggaagagaaagggatagattctaaaaattgtcaatggattacaaaatgtgaacacatgttttgcataactagtaatcaactaatacaaatttgaagagattttaaaaggtaaatatgtcaagcgtgaaaaaaagaatcataccacccggtgttgacaaggtgtgagaaaacattgcttatgagagtataaattgtcttaattcttcagcgttccacttttgattattatgaaaaggcttaaatttaaatttttcttactaacagttccatttggtaagtatcctaggaaaataatcagatgaatttcaaatatttatgtataaggatatttaaactagaaaaatactagaaacaatctaaacatacaatgaagagagagtggctaaattatggtggacttaaactggaataatatgctagaattaaacttaatgttttgggtctactaaaaatagatgatgtaaaatgtaattcttaaaagttattattagataatttatgttaaaaatcaagaaatacagaagtgtagaaaaatatttaaaattatttaataataatttggttcacatcttttcagataagtctctaaatgtttactatccaatcacaaactatgatgtaacaacataaaatgtggttatgctatacataatagtcttcatatattttcacttaatgttatatctcataagtccatagagatctatattttattgtgttgttaaataaatactcggaatttacattattgtgacttgtaaatatttttccaactgagcttcataacatactatgatgactttatgagtatatcttcttcctggagttagaaattgcttgactcttatatttcatcaattttgcatcactgcctattactcattctttcctgaattatataccatatataagaacaaagtttcattaaaaacatcacataagtcagataatcaattagtcctttctccctcttcccttacacatatatagtaaaggcctccgtctttctgctccaatcctgacaatttgttcatcaggtcagatgcatagctattgttctaggacttattttcaccattattttgtaaatgcttttgcttctatcctggattacacttcttgtttccttgatcccatggctatgttttctttatttcctgattttggtggaacctatcctctagggcttcctaacaaaggatacatatgagataaaatttggggatccttgtctatcagtaaatgtgtttattctaccctcgcagttgatttattttcaaactgagttgtaactttcagttttattgttgagaagctatatgccatcttgtatcctaattgttcctttcaggaaacctttaaacttttcatcatctcttcctacaacaaaaattggtctagtgccttctgtatgcccagcaccattccaaatgctggagattcattatggagtgaaccagacaatcatctccatcctcatggagctaacattatagagagtgtataaaaaagaaagtgaacatataaaatatgaaaaaatatataggatatcagatgttctacatgctatggagaaaaataaaggattgaagtgtacagagaatacagtggggtaaatagcattttcattaggggttttagtaaagaccttaattaaacagcaattatgaacaagggcctaaaggatatgaaggagcaacccatagagccatctctctgagagagagagagtgttccacacagagggaatgccaaatggaaagtttgggaaatagggccatttagtgttccaaatactcctaacacattaacagtctagaacaacttgcctttggatggctttccagttattgtgcagggcattccatgagatctctcaacagggaaaaaaatatgtcatttgttttagaaaagtggtattttaatattatttctttgataatatcttcctctacaatctatttctctgttttctttcaaaatctgaatacacaattaaaagacaaagactgtcatagtgtgtccagaattggcgggttcttggtctcactgacttcaagaatgaagctgcagaccctcgcggtgagtgttacagctcttaaggtggcacgtctggagtttgttccttctgatgttcggatgtgtttggagtttcttccttctggtgggtacgtggtctctctggctcaggagtgaagctgcagaccttcgcagtgagtgttacagctcataaaggcagtgtgtacccaaagagtgagcagcagcaggatttattgcaaagagcgcaagaacaaagcttccacagtgtggaaggggaccccagcaggttgccactgctggctcaggcagcctgcttttattctcttatctggccccacccacatcctgctgattggtagagccgagtggtctgttttagcagggcgctgattggtgtgtttacaatccctgagctagacacataggttctccacctccccaccagagtagctagatacagagtgtccacacaaaggttctccaagtccctaccagagtagctagatacagagtgtcgattggtgcattcacaaaccctgagctagacacagggtgctgattggtgtgtttacaaaccttgagctagttacagagtgctgattggtgtatttacaatccctgagctagacataaagattcttcatgtccccaccagactcaggagcccagctggcttcacccagtggatcccacaccggggtgcaggtggagctgcctgccagtcctgcaccatgcgcccacactcctcagcccttgggtggtcgatgggactgggcgctatggagcagggggtggcactcgttggggaggctccggcggcacaggggcgcacggagcaggtagggggaggctcaggcatggcagactgcaggtccggagccctgccccgcgggaaggcagctaaggccgggggagaaattgagcacagcagctgctggcccaggtgctaggcccctcactgcccagtgccggcggggccggccggctgctccgagtgtggggcccgcggagcccacgcccacctggaactcgcgctggcacgcaagcaccacgcacagacccggttcccgcccgcgcctctccctccacacctccccgcaagctgagggacccagctccggccttggccagcccaggaaggggctctcactgtgcagcggcgggctgaagggctcctcaagtgccgccaaagtggaagcccaggcagaggaggcgctgagagtgagcgagggctgtgaggactgccagcacgctgtcacctctcaatagttcacaaaaaagactcaactctgagatgtctacaagaaacccacttcaaatataaagaccgattaaaagaaaactaatagagaaacatgcaccgtgaatactagctggaagagcagcattaatttcaggcaaagctgagttgagcaagaagcaaaattttcagagataaagaggaacattgcataatgataaaggaattatgtctccaagaagacataatcttttatgtgtatgtattcaactcacaacagagcatgaaaatatgtgatgcaaaacctgatagaaatgcaaagagaaacagatgaatccactattttacttggagataccaatacctgtttgtcagtaactgacacatctagcaggcataaaatcagtaagaacatagttgaactgaacagttacatcaatcaattggatctaacttatatctatagaatacttcatccaacagcataagagtatacattcgtctccaactcacgtaaaacattcaccaagaaagactaaattatgattaaaaaatacacattaaaagtttttaaataaaaaatcatacaaaatatgctctcaaatcacaatgtaattaaactagacacctgtaataaatatttggaaactcacaaaacccttggagattaaaaacacacgaattaaataaatatcaaaaaagtacaaatatttcaagccaaatgaaaatgaaaatatgtcttagtaaaatttgtggaatgcggcaaagagtgcttagaaaaaattatagtgttgaatgttatattgaaaaaagaaatatcaaaaattgataatctaagatcttaccaaaaaaactgcaaaaagaacagcaaattaaattcaaagtaaacagaagagataaaaattagagcagaaatcaataacactaaaaataagaaccaatggtgaaaatcaatgaaactaaaagctgactctcttaaaaagatacagttaatgtatctttaatcaggttaactaaggagagagatagacatggggagggggagagagagagagagagaatgagcgagttaggataataaagaaatagtataagtgactctgtccccccaaatttgataactttgatgaaatgttaatttcttaaaagacacaatctatccaaactcatacaagaagaaaacagattatctgaatattaaaggagaaaactaaagttggtgagctaacacgatccagtttcaaaaagtactataaaactaagtatgtaaataagtaaataagacggtatggtatcgtcaagagaatagatcaatagatcaacagagcagagtagaaatcccagaaatagacatgcactaatatagtcaactcttgctctttgacaaagaagtaaaggtaattccatggagaagatattctgttgaacaaatggtgctgaaacacctggacatccacatacatctgattttctaaaagaagctacaggccttttcctaactgtacattattcaatcattatagtatgtgtgtagtggtatctcactgtgatttgttttgattcctccaaaaactaataatatgcaacatattttcatttgcttatttaacatttacatatcttctttggtgaagtttctattcacaaattgtgctaatttttctaacttggttgcttgccttattgtttaagaatttttacagttcttcatatattttgaatgcaaatcctttatgagatacaaggtgtataaatattttctcccagaattgcaaagtatttttatatttctctgaatattttataattttagtttcctaatataggtctatgatctaattttgagtattaatttttgtgcatgatgtgaggcaagggcccaagttcaatttttttcttatagatatccagttgttccaacataacttgaggaaaatgctatttgtgtctcatggatttactttggaagcactgtttgaagattattattcataaatgtataagtttatttctagattctctatttcattactttgacttatatgtttatgcttatgccattaccacgctatcttatttgctgtaactttatagcaagttttgaaattagatagtatgagttctccaaatttgctcttgtttttaacaattgtcatagcgattctaagtcatttgaattttgatataacttttggattctgtttgcaatttctaaagcaaacctatttggattttgataggaattgcactaaatttagattaatttgatggaattttaatccttaaccatattgagtctcccaatttatacatatatgtctctgtttacttaaattgcctttaatttattgcagaaatcttgtgtagtttttattttacacattttttcttgttaaatatgacacatattttagtgatttttatgctatttgaaagggaattttaatttgactttctgtttgttgccactacatgaatatccaatagattttttatattaatattactattttatatcgatcctgtaattttgttcaacttggttgttagttctagcatcttttttgttagacttttaggattttatgtatataagaacatgtcatctacaaataaagccagtcttacttctttctttttgagctatatgcctgcacttatgttctttcttgcacagaattccaatgtggtgttgaataaaagatgcagaaatggccacttttgtgttctgaatcgtaggtagagataattcttttgacattgagtatgatgttagttataagtttttaatagaaaccctttatgagaatgaaagcattttttttactcctagtttattgagagggtgttttatttattttgaaattataaacgggcttccgtttagccagatgcttttttttgcatctactgagatgaatgcgtggtgcttgctctttattctgttaatgtggtataagatattaattgaatttttggatattaattcaaccttgcatttctggagtaaatctcactcatggtggataacatcttttttataatttataggatttaaaattgatgatgatttgttaaggatttttgtgtttctgttcttgagagaaatatagttcactttcttgagatatgtgtgtggctctggtatcgaatactagaattagaaatgagtgggaaatgtttcttgctcttccaattcctgagtttctgtagagttattattcattctttaaatgtttaatagaatttaccagtgaagctacttttaggtactcttttctttacttactgaaaatttattgagatcattctatttcttcttggctcgattttggcaatttctgtctttgtgtaggtattgtccagttcatgtatgttgtcaaaaacttgttggcataaaattatatgcaatattttatcataatacttttaatataccctatctaatatcccctacattatttgctttggtgacgcctgtcttctctatttttctcagtaagtctagctaaaggtttatgaacattagtaatctttacaaacaaaatctgttttcatttattttctttttaaaaatctacttgccattgatttctgatttctcttttgatatgtataatatactttctccttattttgtgtgtaatttatttatttttattaatttatttttgagatggagtctcgctctgtcgcccaggctggagtgcagtggcgcgatctccactcactgcaagctccgcctcccgggttcacgccattttcctgcctcagcctcccgagtagctgggactacaggcgcccgccaccacgcctggctaatttttttttttgtatttttagtagagacggggtttccccgtgttagccaggatggtctccatctcctgacctcgtgatccatccgcctcggcctcccagagtgctgggattacaggcgtgagccaccgtgcctggccaatttattcttttttaaaggtttatttgcttttaaccaaacctgaacccttagagtaactgttaatataataatgagtttcttaaagtaattctatggggaaccaataaaattgtgccagagcacacagacatgtggttgtctgacttagaaagtaactctgaacagaaaaataaatatataatgtattttttatgaaatcctcttttgataaatattttacaatcatgaatttgatattttcttgagaagtattgattatagccattttgtttgcattttaaaggtgtacttacatggtttggccatattatgaaataaatgaaggccaaataagcctacctcaatgtgggggtgggcttcagtttgaggggtaggctggaggaacactgaaaaagagagctaactttttttcttctctttttttttttgagatggactttcactcttgttgcccaggccggagtgcaatggtgtgatcttggctcactgcaccctctgcctcctgggttcaagtgattctcctgcctcagcctcctgagtagctgggattacaggcacatgccaccatgcccagctaattttgtatttttagtagagacagggtttctccatgttggtcaggctgacttcaggtgatccgcctgcctcggcctcccaaagtgctgggatcacatgtgtggccattgctccctgccagttttttcttaagaagtagttttgtgtctactccagtgcatagagtaaaagccttagcattttccacaatggagtgtgaatctattaattttagacataatgtcatacctgtttgcaaaagggagctaattcttcaacttagccaaaaagccatgtaagtaagtaatcattaggagttttaactcaatataattttttgacttataatccaagataagcctagctaatataatgagcttgtttttaagtagaggtattaaagatatggcaattaattgttgaggtgtatatatgttaaatgatctgtttcttttgaattatacttctgtgatattcccttttctttttttttttattgtggtcaacccccttttctttcataatagctagctaaatgggaggaagtgtattaaattgactactactccatacccagagtctttacccactcttaatatcaaactagattctaactttaggtataatctacttaacctctttgaatagtaaatgatacctactatataagatttccatgaaattaaataccacctgtgatggttaatattaagtgtcagtatgactggctagagggatgccaagatggctggtgaagcattgtttttgggtatgtcagtgagggcatttccagaggaaattggtgtgtcatacaggaccaatagaaacaagcagatgaaagcgaggggtttctgtctgtttctctttctgtttcctcgtctctccccactcccatttctctctccccattccataaggaaacacctttctcctcctttccttggacatcagactccaggttctttggctcttgaattatgtgacttgaattagcagcctcctggggtctctcgggtgttcagcctcagactgggagatgcactgttgtctttcctgattctaaagctttcagactaggactgatccatgccactggcttctctggttctccaccttgcagatggcctctcatgaaatttccctgactctgtgagttcatttccctaataaaccctctctcttatttcttattggttctctctctctggagaatttggactattacaccatcataaactctctcaatgcagtgcttaatccaataaatacttctatagtaaaaatatattttttatttttatttttaatctgcatgtaattgtctccttatctttttattctctatgagagcatcagttttccagtttatccaatatcataaaatgacaaaacaaaaaagtaaaaatataatcaaacctttcctcactcaactagaaatttctgtttattttttccagagaaatatagaaatatctgaatcttaaagaaccttataaaaccattaggtattagcagatgcaggtgtatattgcactttcacatattaaattattgtcaagtcttctccataaagtcaaaagctaaatggaagtaaacgaaaagagaacttcacacgaagtaatggtgggacacaatggtccatggtggtacacatggactaaatccatatcaaaaatctgagttaccctccacttaaaataattccatatgtttcaaacacaattaaggaaactggaatacatttgagattcaattttgaataactaatgtgtgttaaatttgagcagtataaaagctgccctttgcaaaaacatcctggatccagatatatatttgaaaaaaagaacttaattggctataataatagcagtgatggtcacctattctttaggacagttttttaaaaaactgtttgaggctgaaatatatttgccttctgtgggcaaaacctgatgaccatattaatttaggccccaattttttttttttctgaggaatgtaacaattgactaaactgaaatgaaatactcttatttgaatgcttcccacaatgtctttgtactcagaacaaatatttagaaataggtagtaaataaatgtgtatcaaaagaataaagtctattaacattaaaataagataaaaagaaaattttaaacaaattttgtatcaaaaccacattctttatgtatgttttgtgggggaaaccatatatctgttttcaaagttggctcccaaatttttgtagcttctcaaatacacatcaagttataatgcttagtaggtgtaataatatttgtcaatgacctcagcaggtaaatttttatcattacttggcctccatatttgattaaattcaatcaacatttatttagctcctaccatttgcaaagatctgcctaatgtgatttgaggagaaaactgaagtaagacatgtctctagtctttaggaagcttccatatgcacggtaactagatatccagatttcatttggaaaccagtagactcttgagcatatgtaatgattcctagagcggtgaggtgagaagaggagagcatgtaagataagtatacatgtaaatctaacatattgagccaactgttatgaaaattacaaaattccccatggtgattaaaataagagaaaataagatcaatatgaaaatcattaatggacagcaaagttccattcatacatatatagagaaaagaaataattctcaaggcaattaaaattagaactttccaatttatctgatgcacatgtgacattcacctggtcatttagtgtaattagaaattcacattagtcatattaaattcatggtaaaatacaaagagttcagaatcccaaaccatagtgagatttaaaattatgtttatgtttgagagaataaattgagattagcatacataatttaagttttatgaaatcattctcttagatttaatagatggtgcttttatataaggaaatgaacatggctcatctcgctgtattctttttgcaattccataaaaatattctgacaagtaattttagaatctggaagtcttgtttttggggttagactattgttttctaattaatataattttaaagtttaaatttatttttcagattttacatgtgaaacattaggaaagattaatacattgctaatgacatgaaggtagtatggaaaagtaggcagaatagcaacccaaagtctaaagctatgactccaccattaataaacacttagaatttagtaatgtcacattgtgtttcttagttttaatattcatgtgaaaattacgataataacacatatctcacccagaagaaaaaaaaattgtgaagaaacttagaagttctaaaaatataaggtataatgtaaacatgaataacaataacatttatagcttgatgttttttcaggccttgtaattttcaaaatatgtgtatatagttagctgattagaagaaaatatggttgactcattactgtggaaatagcctgatacagtgaaaaggccatgttttcagttagaagacttagatttgagccctagtccaatcactttttagttttctggtttctgtcacatcattcatccttactgaataccttcagtttccttaggtgtgatctatctgaggctcatagatctgtcccatccacttgaaaatgttgatgtgatgatgatgatgagttcagatgaagcatgttaaagtacttcataagttcctaaacaaatataactttatttttcttatcttgattttctaaacaaattcatttgtgtagtatgttagctctaggcagaaggtgcaggaataagtacagttcagagaagctgtagtggggtagtcaatggcttccaagcctgagtcagaactgtcaatcttaggttcacagctgggtgtgctccagagaaactggaccataggaactgcctgtcatgaagttttataactattccaactattcggtgcaaggtgattgctgccagcacttctctatatgctatgggaaaattacacaccaaagatctgtcatatacaattgctttattccagatactcacaatccagacagagagataataaacacaaaagtactctaataagaataaagagtttaaaaccatttaccaagtttcacaaagaagaaactgttaattgacaaatgacaagttaagaaaataattgcccctctcacaaatactagagatctgagcatatctgtctgcagatgggaagaatcaagtaaggcaaaaaagattcaaaatgcacgaatgaatgcaggtaaggagagggaggataatagagcaaggggttttcagtaggcaaagtggaattagatcaaagcacaagtaaagcagacatggaaaggaggaggggcagaactctgagaacaagggcattaatgagggaatgtttatagaaatgtatattttgaaatggagagaggaagatgagaaaactgatgtctgatgttgattttatgaatcatctgatgaacataatccctaaatttatgaaactacatctgatgaacatcatccctaaattcatgaaactactagttttctaaactaagggttgtgatctgtgagtgggtcatgactcattatggagtcattgaatcattttagtgggttgcaactagtaatgttcaaaaataaaataggctgaaacagacaatattacatcccactgcattttgtaagagcaaatttgttttgtgaaattttgttgcagttaaatttatatgtatgtgtatcctgggtcatgaaataaaaaggatattttctgtggggtgcagttaaaaaatcccaaaaaccactcaactagagaatctctataaactgaacagaaatattgccaaggggcaaataaagcttgtacgtatcatgctggtttagatttgtgttgagtagttaatacaatgtctgccttattccagtggttctcagaaggccagaagcacacattaaggaactagtgatgttgatcaaaggttagaaattagacccagtggagttagggctgttagggaaatgaagatgccctgggtgttgttgaggctaggtcaaggtggcagacctgactttccagactattgcaggaggatcctcaattattaaagcttcagttgttggaaaatatcttttccattgagcttcaagtctaccttcttgtaatatctactcttaatatctatgattttgtcttctggtgccacacaccataaatctaatcacttctctacaacaaggagttttatgtttttaaaaatagctattgtcatttgggttcacttgggtctaaatgtaatgctagttcagggagccctagaggcctggaatcttataagagtgagtacaaaaatttagttgaaactgtaggcatgataagggactggtttgtgcaggacagagtctgtcaaatctgaggatgcccaaactgaatgggacaggtgtgtgggtcagcagagggcacacacatatgcagaactgccaatcaggaaatgagatggcaaccacaacatcatttctgaactcttctccctctctttgaattggcaatatgccttgagagagggcctgataccccagagttcaagtcgctcttaaatcttcattcctgctttttcttcagctttttctcatgggttttcagcccttcatatgtcctcagaacagcacagcccttcaacttttctaaatccagctatttagaataccttaaatgtatatcactggccagtttactgtgcttctgaacatgtaaggaacttatcaattgaatataaaattaagctacttaaaaatatttggataaatcagctgtttttgaatgactgattctgtgtttggtcacatcgatagacccatttatctatgagggttcccatatgtagattagtttatttatatctacagatacattgagtggggaatagaagtttcgcctataattttactcacttttaacaatgtggactttctgtctatattatgtcatttttctttatatatatatataaaatttaatagattgacatttttattacattagttttgaaactttcattgaaaaatctagtgtttcattgaaataactgtattatatatggtctcttataattcaactgagtgtttaatattgggcaaatacattcttatgtcattaatggtatctaacttctcaattaaaataaattctctattcttgtgagttatgtattgcacattaaattaggataaaataataattaattaattgtaaatattttgaataaaatgtcttgatttctagttactactagtatttttaaaagagaagcatgatttatttttcagacaataacttacaaataatcatattcaaattgtcattttataagtaggaaactgagttctacagatatttaataattttcaaagtcattttgctagtcagtagtaacagaacctagcctgtatttctagcttgaataagtactttagcttcctcaaactcttgtgggttaggtctgatactgcaatagaaaggctatgtctatcagattcccttttggttatgtgagctttgcgtgggtttgttcatgtaaatcccatgctgaggtgaaagtttttttttctctctttctcttttttttctgtaaaatgagcgttttgtactgctaacataattcttatatattctaagtgaaaaatcattacatagttgtcaatgtatctcacctctccctaaataacctctactatttatgatttagaaatgaattccctccttacttgacctcttgcttgatttataatcgacatagttcctatattttctgcttatattcttcattttatatttagtgcatctcaattgatttttcttctttaccttgcatttttttccacttttatcttcatcttccttggctctctacactgagtataaatactagaccatagtttcaacccatgggagcagagcataatttcttgctgagtacttaaaattttcctatttcattctattttataattgctttacccactggttttcagaagataggccttcattattccaaagtatgcttggtttattgtttaaaagacacaataggctcaccccactttagtccatttctagccatgctttattctttgtttaacttttaattgctattccaaactctacagtgtctgtagcagatgctggcactgccgtgtctgtattactcaagcctttcaagtgtcctctaactttctcccaactgtcagtacctacatctctgtctctgtgtctgaggcattcgtttttgtttttactgttgttttacttcctaaaaccactgaaggccattctgctcttacgtagaagagatatgaggctggacttaatacaactttactcccccaaatccctaacaaataaccctactgaatataaacattccattccctttataaacaggagaattctgaagcataggttttatcccaagttccagtacttttccatgagatgaagcttcaattattcactccaggtagctgatttcataacaacctttgttggtgcttttttccttctctgaaccactacctctactccctgccagtgtttcctggccccctgaaatacactatttaccctcaaatctttgtttcagagtctgtctcactaatttccttgaagctatagctctctgatttatgaagtagtgacaacacttgagttttggcagaattaaataaatgtgcagaacctgattcataataggtactctaatactattgtacctagttaaaataaatgctgtctttaacctctgagtactttctcccaaatataattttgctccctctatatctcaatagaatgagctattttttactgcatggacagagccatgccagtggtcaccaatgtgataaatctgagggttgcatatgaagagttcacacatttttcttttatgcctgcaactccattgctagtcacacattttcacgcagtgagaatagtctttttttttttttctgcagtcctattttaatcactacaaacactacagggtaatgttcaatgaatggttattggaagagtctacctttttcttttttttttttttctcttaaaggaacaatatgctatgatctttcacactttccaccaacttctcttctccaggcttttcctacttatcctgtaaaacttaatttacaggtcttctacaaagcttgacctcatcctccaaagcttttagttacttttactctaagttgccatagcttttaatatttatttcaatcaaagtgcataatctcctgaactgttaacttatttatctcattagcaagatccttaattgatgaggctgggttatttattattgcaactcaacacctagaacaatgtttatgcatactgacactcaactgttagatgaatggattaaatttataaatactgttggaaagaagtaagctattgttaggccttaaagtggctttaattgaatctaaattttaattgaataaattggtacatctcaattgattttgcttttttaccttgcttttttcccctatatattaaaattacttttaattgcaaaaattgtaattacttttgtaccaacctaataaatagttatggaatatgtattattccactgcctcaaatagacacagctgactatttctcatttaccacccctacttttatgttatcatgtaattaaccatattctcctgtttctaatgtgtggacaacatttaacttgctaatggttgatctgtgaatattttttactttagacacaaagaagcctttaggtcatattatacattgaaaaaaaaagataacttaaaataatacagtattaggatttgactcaatttctgcttaagtaaaagcaaagaaactagatatcaaaatgcatactttttccaaagcatatgtaatataaaattacatttatttcattttgttatatttgtcataatttatcacctaatttataatgtattgatcttctaaatgttggaatacaaagcatattagtttaataaaaggttgaataatgtgttttacttaccaattaaatcactatatagtatagcagtgctgtaggaggaaaactagtcttccaaaaatcaaaattttcatatatgttggaagagttggctatcacaatgttacataggagtagattcttgttttctttttaatggatgctgacaagaatgcctgagaatcctatctgctggcattggaagattttacaaaatacaatctgatagtattttccctacttaacattaatcttcttatataatcacttggtcttctataaaattatttgttaattaaaagaagtcctatcattactcttgatactgcaaaaaaatggcctttatgagtaaacataaatatgtaactaaaacataaatgaaatcaggcagttacaaataagaaaattagtcatttggggcaagctgaagagttaagaaaacacgaggatataatttactggcacttcagataaaatagaaagaaataatggggcttctctctaggtatacatattataaaattatagtattttggcatatttgtagtgttgctatttttatcagaccagaatgcaccattctcagctgtatttgagttgagaagaaccaaatagtttttaatattgagtgttcaaaatattgcatgggatatacttatactcaaaaataatcattattcatctgaaattcatatgtgactgggcctcctttatctggtaaccctacctagtaggaaagaatgttgtgtacatttttaaaatactgattaacctagtaatatgattatttaaggaaacataaacaaaggactatttctgaaatattttccagcgaagtttggaaagcagtcttatctattgtgttaagataaagaagggggaaagtcatattttgttttgttttgtttttttttattaacttcaatttcttatcacttttgaacatacaatatgtatttacttaggagtcaaaagttcatgtggtaaataaacactataaatgtaaaccaaggatcaatgcttcaaaagcaaatttattcagtataaaatgtcagagcagcttttatatttccaaatacataagatgtaaattggaaagtgtttgcattttaactagctttaacacatccattatataataacatgagaggaaaaaggattacagcttctattttactacccctttaaaattccttcattttcatttttgtataatgtggtttagaggagaaaaatcagaactgacaatattatttaatgaaacttttaattatgtagataatgtaaatctaacaccaagtctgcacatttataatgctgttttcaacattgtaaaattgtggtattcaacagttgggaaatctggagtaatgtttgtttatctctcagaatttgctatacagcttatgacaaagaattcaatgtgaaccacttctgaattatgatgattatatatagatgaaatgtttcaaaacttactacatgtgaagcactttgcctcatgctttgcaaacattgtatactttaatattacgagttttaaaatattagtatatttgaaaaatcacataaacacttccttttcagatatgttttgctagataaccctctaaagataacactgaataaagtaaaaatccattgctgaaattgcacaaaaataaaaggtatgcaaaatcgaaaataataaaaaagctgtaactctgagtgaaaagtgaggattgaagatggctatcacttaaagaattttgtattatcctagaaaacttcatcttttaaaaaacagcttcatagcacctggagacaaaagataaatactggggaatgcccaagctatagagtctaagaagataaaccccggacataaggtttacatcctcagcttcaaaggagatggtgcaaaactaaggtgtgacaaagtatggatcaaaacattacaaagaaccttgtccatcatccatagtgctaagggaatgtgaaaaaacaatcaatctgagaattaagttctcagcagagttttagtataattcacaatctttatgatgtgaacaatctcaaatttacttattttaaaattgtgtcaggcaacttacactggcaagaggcaaatgtttcctagaggaatgacaaattaaactatgacatcacataatactcaagttaaagttctaagaaaaataaaaatctcatggacaaaattcacaaagtgcaacaggaataaggtgtgattaataagagattaatacaaacatcaaaatcgtacccacaaagatgttaacatactgaaaatattacaaccaaaattacaaacataactatgactaggagattttaataaatgagaagcttgaaaatacaagcaagtaaataaaaactcagaaatatttagaaaacaaaaaataaacttctaggattgaaaaatataaattaaaatgagaaagaaacatcaatgaataataagctgtggcctaaaaaatagacttgaagaaatttcacagaatttctcacagagactttggttggaaaaatatgaaaaaggaataatagacatactgctcttaactagctaagggaaaataataaaatgtaaaaattatagccgtttaaatagcagaagagtttcaagtggccagtatttgaacacaatgaaattaaatcagaaaccaataagttttaagtaggaaattttacatacttggaaattgtaagaattacacctaaaatttcatgaatcaaagaaaatatcaaaaataatgatggaaattaagatattttatttttccaagatggtggattagaggcttttagcatgcttcagctgctttgaaataggaacagtgcataaatattaactctgtgaggtttgattcaagaaagacaatgggaatccaccagaataatgaaggacaccctaaatcctgggaaggagaacatgagcaaaaagcccctgtgacagcatccagctgttaaaagtgagtgaaaccctagcacacgagaaaggcagacagcctccttctgtgactcaactttccactgaggatctaagtaacccagggagagggagagccctttgtttcactcaagccatggagctaacttggggagaggcttggaggtgctgtgaggaataaacactgggaaaagctgcagacattttcccagacctgagaccgagagcaggatgtcattataacctgggtgcacacaaagtcagccattttgtggtgactccgcaatgtggccacttgggcattttagtcttggggcagagatagaagtacctgctgtggaccagggtacagacctccacaactagaacaatagaaagtgtctcagcagcaggtgctggaattgtgctccccactgtgggacaagaggagatatatgacagctgcagtttctcctgaacaataagacttgcagccaggagcagtttgtcaacctggaactgtcatttttcagtgccccagctgctaccctgagatcatggtgcagcaggcctctttcttttccatcacaaggcagaagtctaggcatttggaacacctgcttgcctggaccagcagcttaagcctcctcacacttcatggacatagactgtggtgcagcagggccctctcagatttccaggcatttgaagcagctactcatctggattagcagcctgacctgccccacatttcctgtgcagagatcctggtgtaaggagctcctctgtgttttatacccagtgagatctccaggcatttgagcacctgctcacttggttcagcagcctgagccatttcattcttcctggcaatagatcatgatgcagtagggtcctctctgctgcccacccaggcagatctccagacattctgagcaaccactcacctggataagcagcctgaactgtcccaccctttatgggcatagattgtggtgcaataggaccctctctactccatacttaggcatatctccagatattaaaagcatatacttgagcagattggcaacctgagctgccccacccttcctgtgcagagatctgtatgcatgggtgccatctctgcttcatgtccaggcaaatctccaggaattcagaccacctgcttgcctggttcagcagcctgagttgccccaccattcctgtgaggagatcttggtgcagggggctcctctccactacatgcctgcacagatctccagacatctggagcacccactctcctggattaggagtttaggcttccctcctacctgtgcagagaactcagggctgaggagatttcctagttccacacacctaggcacacctctgggcacttggtggctgcccagtggattctcctttgacactgatgtctgtgcctgacatcaggagaacagaaactggacctgcctggtctagccttgtttatcagggcccccacccctccagggatgagtagggtgttcaggccattgtgcactccacaaatcaggccattgcctgaggcaacagagggcttctgccattaaacaaggatcaggtgtataccgagctgtgttggtcgcagctagctcttaactataagcaccatctactggctggtaggtccaaccacagagcccaatattcaactgctgacagaagcgcataaggctatagaagtaaaaccaaaacaacctacccaacattgtctacaatcacataaccagggatgggtaaagggaaagggaaataaaaaaataataataatattacagagaaataaagaaaaagaaaaaaaatctacccacaggaatataattacaaaaattagaagtcctagtctccagatgacaaggaaccagtgcaaaaattaaggcaccatgaaatatctgaatgtagcaacaccaaaggatcacaatagctcttcagccacatccctaaccaaaatgaaaactcagaaatgacacaaggaattcaaagcatggattacaaggaagctcaacaagatccaagacaaggttgaaaagcaacacaaaggaatttctaatgcaattcaggaaaggaaagaagagataagcatattaaagaaaaattaatcagatcttctggaattgaaaaactcacttaaaggaatttcaaaatacaatggaaagctttatcaatagactgaaccaagccaaagtaagaatttcagagcttgcagactggtcttttggagtaagccagttaaaccaaaataaagaaaaaaaaagttttaaaaacaatgaacaaagtcttcaagaaatatgggatgatgtaaagcaaccaaatctatgaattcctggcattcctgaaagagatagagaaaagatgaacaacctagaaaacatacataagggaatacttcaagagaatttttcctaatcttgctacacagtagacagcaagatacaagaaatccagagaacatctgtgagatactatacaaaacgaacaacaccaaggcatgtagtcaccagtctgttcacggtgaatgctaaagaaaaaatcttaaaagtagttagagaaaaaggtcaaattatgtacaaagggaacactatcaggctaacagtgagagttctcagcagaagccttacaaaccaggagagtttggaggcctattttcagcattctttgaaaaaaaaagaaaaaagaaagaaagaaggaattaatgaaattccagccaagaatttcatatcctcccaaactaagcttcttaagcaaaggagaaataaaatctttttcagaaaagcaagaagtaaggcaatttataatcactagattattcttacaagtaatacataagggagttctaaatagagaaacaaaagtacaatacctgctaccacaaaaatacacttaagtacctagcccacagcccctataaagcaaacacacaattgaaactacaaagcaaccaactaaaaactcacgacaggatcaacctcacgtatcaatattaatcttgaatgtaggctaaatgccccccttgaaagtcatagagtggtaagctgaatttaaaaaaagcacacagaagatccatgtatctgctctcttcaagacaaccacctcacagtagcagcacctatactgtcaaagtaaaggattggaaaaagaagcatcataagaacagaacacacaaaaaaaggcagggtagctattcttatatgaaacaaatcagattttaaaccaataacagtaaaaaaaaaaaaaaaaggacaaagaagggcattacataataaagtgtttgacacaacaagaagacttaactatcctaaatatatactcacctaacattggaacacccagattcataaaacaagtacttctagacctatggaaagatgtagatagccacacaataacagtgggggacttgaacactccgctgacagcattaggcaaggaactaacaaattctcagtttaaatttaacaattggccagttggacctaatatatatgtacagaacactctacacatcaaccacagaatatacattattctcacctgcacatagatcatacaccaaggttgaccacatgttcagccatatagcagttttaacaaattgttcaaaaaatcaaaatcataccaaacatactcttgaaccaaaggggaataaaaacagaaatcaataacaggaagatctctcaaaactacaaaattacatggaaattaaacaccttgctactcaatgacttttgggtaaataacaaaactaaggcagaaattaaaaaaaattatttgaaataaatgaaaacacagatacaatatactaaaaatctctgggatgcagcaaaagcagtattaagagggaaatttacagtgctaaatgcctaccacaaaaaagttagaaatacctcaaattaacaatcaaacatcgcacctacaggaaataaaaaacaagaacaaactaactcctaaggtagctgaagaaaaaaaataactaaaatcacaccagaagtgaatgaaattgagaccccaaaatctacccaaataatttatgaaaccaaaagttgggtctctgaagaataagtaggattgatagactgctaactagactaacataggtaggccagctgtggtggttcacaccagtaatcccagcactttgggaggccgaggctggtgaatcacaagttgaggagttcaagaccagccaggccaagatggtgaaaccctatctctactgaaaatacaaaaaaattagccaggtgtgttggcgggtgcctgtaatcccagctactcaggaggctgagggagagaactgcttgaacccaggaggcagaggttgcattgagctgagatcacgccactgcactccagcctgggtgacagagcaagattttgtttcattaaaaaaaaatataggtaaaaagagagaagatccaaataagcacaatcggaaatgacaaacgtgatgttacaattgattccacagataccaaagaccctcagatattgttatgaacactcccatacacacaaattaggaaatctagagaaaatgaataaattcttggaatcacacaatctccctagattgaatcaggaagaaattgaaacccttaacaaaccaatatcatgttctgaaatggaatcagaaataaaaagaaaaaatctaccaactaaaaaaagccctggatcagatggattcacagcagaattctaccagacatacaaataagagctggtactaatcttcctgaaactattccagaaaatcaaggaggagggactcctccctaactcattctacaaaaccagcatcccccgataccaaaacttggcaaagacacagcaagaaaacaaaactacagaccaatatccctgatgaacacagacacaaaaatttctcaacaaaatactagcacagtgaatccagcagcacatcaaaatgttaattcagcatgatcaaataggcttcattcctaagattcactgctggttcaacatatgcaaatcaataaatgtgattcaccacataaacagaatgaaaaacaaaaaatatgatcatctcaatagacgtgagaaaaagcttttgacaaaatctaacatgtcttcatgttaaaaacattcaaggaactaggcatcaaaagattgtacctcaaaataataagagccatctatgacaaacccatagccaacatcatagtgaatgggcaaaaactagaggcattcccccttgagaactggaacaaggcaagaatgcccactctcaccactcttattcaacatagtactggaagtccttcccagaataatcaggcaagataaagaaataaaaggcatccaaagaagtaaagaagaagtcaaaccatctctttttgctgataatatgattctatagctacaaaactctaaagactctacaaaaaggttcttggaacacataaatgacagcagcaaagtttcaggatacaaaatgaatgtacataaattaacagcacttctatacaccaataatattcaaggtgagacccaaatcaaaaacacaatttcatttacaatagccacaaaacaaaaaacaaattaaaaaacaactaggaatacatctaaccaaggaagtgaaagaaacaagacatctacaaaatactgctgaaagaaagcataggtaatacaaacaaatagaaaatcattccatgctcatagactggaagtaccaatatcattaaaaatccatactgcccaaagcaatgtacagattcaatgctatttctatcaagctaccaatgttatttttcacagagctagaaaaaaactattctaaaattcatatggaaccataaaaagccaaaatagctcttcaaaccataccataaggctacagtaaccaaaacggtatggtattggttactgtactttctattacaaaaatagaaagaccaatggaacacaatggagaacccagaaatgaagctgcacacctataaccatctgatctttgacaaggtcaacaaaaacaagcaatggggaaaggactctctagtcaataaatggtggtgggatacgtggccagccatatgtagaggaatgaaactggacccctaccttttaccatacaaaaattaagtcaagatgtattaaagatttaaatgtaagacctcaaactataaaaatcctagaagagaacctaagaaatggcattctggatgccggccttcagaaataatctatgactaagtcctaaaatcaattgcaacaaaaacaacatttgacaaatgggatctatttaactcaagagcttctgcacagcaaaagaacctatcaataagagtacacagacaacatacagaatgagagaaagtattcgcaaactgtgcatccaacaaaggtctaatgtcgagaatctataaaaaacttaaataactgaaaaaacataaacaaataacccccttaaaaagtgtgcaaaagacatgaacagacaattcccaaaagaagatttataagcagccagcaaacatatgaaaaaatatcaaaaccacaatgagataccatctcacatcagtcagaatggctattattaaaagtaaaaagcaaacaaacagaaaacagtagatgcttgagaggctgtggaaaaaagggaatgcatatacagtgttggaacataaattagttcaactacagtggaaagaagtttggacatttccctagaacttaaaacaggactaccatttgatccagcaatcccattagtgggtggatgtcccaaagaaaagaaatcattctaccaaatagacacatgcacccatttgttcatcacagcactattcacaatagagaagacatggaatcaatctagatgttcatcaatggtggattgggtaaagacaatgtagtacatatacaccatagaatactatgcagccatataaaagaatgaaatcttgttctttgcagcaacatgaatgcagctggagaccattatcctaaacgaattagcacagaagcagaaaatcagatgcctcgtgtttgcacttacaattgggagctaaatactagttacacatggacataaagatggcaaccatagacactggaaatactggggaaggagggggacaatttttcaaaaactattggttactatgctcagtaactgggtgacgggaatctatcgatcccaaacctcatgtgtcagatattcccaggtaacaaacctgcatgtgtacccactatatctaagatgaaagttgacattattaaaaagaaaaagttaacataaataaggacagaaaaaaatctataattaaataaatatgaaaatgctgcttttcaaaacttctgggatatagctaaggtaatacttataggtattctagttttaagagcttgctttagaacagaaataatgctaaaagttaaagctaagtatccaacttaaaatttaagtatttttataaacaagagagtaatttaagcataaaaaactaaaatgtaaaaactaataaaaattgaaacagaagatcaatggagtcaaaagaaggcaatttttataaactaaaaacatgccttgttaaattaataaagaggcatcagccaaaagtacattaatatgaaagacaatataggtataagtagagatgctattgatgttatgcagctaataaaagagtattaggaaaaactttattcatgtaaacatatatatgaaatgaatacattctcataaaaattgatttcaccgaaactgattccagaagaaatagtaaaccttaatggttcagtcagaatcaaaataactgaaatttcttttaaaatcctctcattgtgtaaacaccagttccagatggtttcaaggtaagattttcaggtaattctaatattacacaaaattctgcagaccattttaaaaagaaagacgacagaaacagaagattataaaaaataaaaaatgtatattacaggcccacctagtcattaacagatacaaaaatagtaaatacgttatttgcatctcaatccatcaatttaaaaaataaaaatatataggtataatctaagctgaatttctccaaagaatgcaaaccccgtttatactagaaaatggatgaatgtagttcacctcattattcctactttagatggaggggaaaaattaatattcaatatccattcagaatgaaaaccttaggaaactaaaaaagaagggaactcccctagcatagtaaatgatttctactaaaatacaatgaatatgttattaatggcacatgttgaaaccttcttttaaaattgtgaacaagaaacaagtcagtggaaagtttctgttatcacaatttctatttaacattgcattgacggttctagctagtgcggtgagataggattaaaatgtttaataatcagaaaggaagaaacaatgctgtcactatatctacaaaacataaacttactgattattagaattaataatttagtcatgttactagataaatattaatattcagaagaaaaccgcatttttagataacagtaaaaatcacttgcagaatataattgtattaaaagaaaattacaataacatcaaaaatatgaaatgcctaataattaaactaccataagatgagtaaatcctttaggaagaagactacatacaattttatggaaggatattaaagaatacctaaattaaaaaaaaaacccacaacacattcttagaaaatttcagtaatataaatgcatggatagtcccttaacttaaaatactccttcaaataaaaatcccaccaggatttcctgtggaatgtggaaaatttactccatataaaggatgaaaacagccaggacactatttatttttatttttatttttattattttttttttttgagtcagaatctcactctggggcccaggctggagtgtggtggcacaatcttggctcattgcagcctccgcctcccaggttcaagcaattctcctgcctcagcgtccccagtagctgggattacaggcgcccgccaccacacccaactaatttttgtatttttagtagagacggggtttcaccatgttggccaagctggttgggaactcctgaccccaggcaatccacccaccttggcctcccaaagtgctgggattacaggcatgagccaccacgctcagccaggactgttaaagaagaaaaataaagaggggactttttgtttgaagtattgtaatatattaatctgttctcacactgctatgaagaaataactgagactggctactttataaaggagacagatttaattgactcacagttccacattgctgggaggcctcaggaaacttacagtcatggaggaaggaagaggagaagtaggcgccttcttcacaggggtggcagaacagagtgagtgcaagcaggggaaatgccagacgcttacaaaaccctcagatttcataagactcactcgctattatgagaacagcacgggagaaactgcccccgtgatccagtcacctcccctggtcctgcccttgacacatggggattatggggattacaattcgaggtgagattttgttgggcacacacagcaaaaccatattatagtgattaaaacagaacagtggtgaggaagagatagacaagtaaaaaaatgggacaaaatagcagccttgaaactattccattcatggatgcaaattggatttacagcccagtgggcgttgctggttagtgtgggaaaagagagcccatttcattaataatactggaaaacatagtcatctatttgaacaataaaataaaattggactcctacatcatactgtacacaaataaatatcatgtagattaaagacttatctgcaagagtataggaaaatatctttataattgtagtggaggaaataattttttaataaaatcataaaaagcagatagcctaaggaaaacgataatttaaatgatacaaaaaaaccaaaaactttacagagagggaaatataagtaataatctgtaaaaaagtgtttctaatatttacaactgtcagagaactagtattcagaccataaatcagtaaaaaaagattcataaaagtgagtaaaagataaaaataggcattttgcagagggggtaatataaattgctcataatttttttaatgcttaagcttaatactaattagcaaactgcaaattaaaaccaaaacccaattccaaaacataatgacctgattgcaaaaagtattaaaagcacattagtatttgttcaatactagtgtgctgggatgattttaatgataagaaacactttatttttcttaaaataatttagcatgggtctgctttgtgaccaagcaaattcataatcatgtacgtagactatagtaacactttcacatttgtaccaagagacttttacaatattctattcttatcaaaactgtttataatagtaaaaaattggaaaccactcaaataagccattaaaagggtctggctgctgggcacagtggctcaagcctgtaatcccagcactttggaaggctgaggcgaaaggattgcttaagcccaggaattgaagaccagcctgggaaaaatagcaaggtgctaaatatatatatgcaagctgggcatgctggtatgtgcctgtggtcccagctacatgggagactggggtagaaggattgcttcagcccagaagattgaggctgcagtgagctgtgtttgggccgctgtatgccagcctaggcaacagagcaagactgtcaaaaaaaaaaaaaagtggactagttatacattcaaatactgtaaagcacttaaaataaacattctatcactatcacatccaaatagatgaagcttaaaaacataatactcagcaaacaagccaactcaaggatgcataggatattatttcatttgcataaatatccaaaacatatgaaacaacacatctaggcttgctcataggtggaaaaattacatgaaagttaagtgagtgttttccatactcttcagaattataatttcctctggaggaggaggatggtgcagctggctacaacagaggcctttatggcactagcagctggtgacattcactttcataacatctggtggcgattattcaggtgtgtttacaattattctctaaactacatatgtttaatacttttcatttatgatagatataagaattaaaacttttttaaaaaagagaacatgtatatgaaacttaaaatgccattgtgagccaggtgattgagttagacaagttactgctgctcctagtgtgttactaccctgtaaaatggctcattaaagaacaaattttgggattttttttctcatcatctgtgctgagtttaattaaaaacacacttattatactgaactataggatggagtttctcctgtagctggagaagtgtccctcagttttgtagtgactaaatactggagtcaatttctgaaggaaattagagattatccttccacgaattttttaaaatatgctttgaatatagcatattatatgtaaagttctgcatggttgttccttcataaaatactatattttataatgcactagaaagaatactgtgatagaaatcacaaaatttcagttcttgttttgcttttatttcttataagcttaatctctgagtcctaatttaatgcattatctatccaatgcccagatcatgttgtattacataatgtttacatgaaattatgctaatagtaatgtcctttacatataaaaggagtcactactctttgtatttaatcactcttttaaatgaataattggcatatatttataattgtatatatatatttttaacttttattttaggttaagggatacatgtgcaggtttgttatagaagtaaattgcatgttgtagggctttggtttgcagattatttcactactcaggtaatgagcatagtacctaataggtagttgttttattctcaccttcctccaactctccatcaagttggctctggtttctgttattcccttcttgtgttcctatgtactctatgtttagctcccacttatatgtgagaacatgtgacatttggttttctgttcctgtaatcactcttttttttccagtgagaagttttacatgttttcaggtgcattatacagatattgatatctcataaagtcaccccatccaaatttgccaaccttgtataatatgtcatcaaaatatgattggcccttcatattcattggttccacatctgtggattcaacaaactgaagactgaacatatttggaaaaaaatacaataaaaataatgcaacaataaaaataatataaataaaatatagtataacaactatttatataaactttacattttattaggtattataaatatctggagatgatttaaagtatactagaggatgtgtataggctatctgaaaatactacaccaatttaagtaaggaacttgagcatctgcagattttggtaaccatagggatcctggaactaatcctctgaagataccaggagcaactgtgtatatttttcacccccttaattgctcagaatcctgctctgctagtctaatgaataatgaaaatttaactgtgtcagtgtggctatgtgtaataatagcatggcagcttaattttggttacatagttgaattataacaaaataatttaggaaaagccatatagttgaataaatggttattccataagctgcaatgctctgtaattgtagaatcaaaaacaggtgaagatggtagcaatagatatacaatttacccttgaacaaatgggggttagggaaaccaacctctcttccagtcagacatccatgtataacttttaactcctcaaaaacttagccattaaaagtctactgttgaccacaagccttaacaataacataaacagttaacacatattttgtaaatgtattatgtactgtattcttacaataaagtaagctagagagacaatattttattaaaatcataggaaagaaaaaatatattgactattaagtcaaattggatcattataaaggttttcatcttcctcatcttcacattgagtaggctgagaaggaaataggatgaaatagtgaaggaggtggaagaggaggcaggagaggcaaacatactcactgtaattttacaaaaatacatcataatttctgtctgattttttttttgctttttcatttctaaaaaaatgtttctacagttaccaatcctttctccaaaatttgcccatatcatagaagggttcatgtcataagataagtcaaaagtagtcttaaataatcagaacccttctaccagattgtctaacgtcagttttgttttctggcactgcttatttgatgtcttcttcctcatcatctagctgtggttcagaagccttaatttccctcatcatcttttgttaattcctttagtgtggtgtctattggctctactttttctaagatccatatcttgtaaccttgcaccccaactgttttattgttgtggttgatttagttttgtttttggtttttgccacatccacaatctcttttatgatttccttgattggctctgttgtaaatcctgtgatgtcacgcataatacctgggtacagttttctccagcagtaatttattgtttcagacttgatgactttcacagctttttctataacaatgatggcatcttcaatggtataatccttccagactttcatgatgtattctctatcagggttctcttctattgcattgacaagactttccatagaatgccatgtgtaatgagccttaagcgtcctaatgaccccctgatttagcaagtagactaagtcattgccttcaatgttgagctcatgaagttctgggtgctaggggcattgtccaatagcaaaagaatgttagaaaggcagtcctgtattggatcccagcactttgggaggtcgaggcaggcagatcacctgaagtcaggaattcaagaccatggtcaacatggtgaaaccctgtctctaataaaaatacaaaaattagccaggcatggtggcagatgcctgtaatcccagctactcgggagcctgagacaggagaattgcttgaatgcaacccaggaggtggagattgtagtgacctgagatcacaccactgcattccaacctgggcgacaaagcgaaactccgtcaaaaaaataaaaagagagagagagagggagagagggagagagggagagaaagaaagaaaggaaggaaaggaagaaaagcaagaaaggcagccccttactggggcttgtgtcttcatggacaaagcatcagtgaaattaatccagaattctcattgtccaggctttcttgtggtacaacgaagactgccagctggtgcttatttttttcctttcatcgttctggggttagcagctttataggtaagggcagtcctaataataaacccaagtgcatttacagtaaacagtaaagttagcctatcccttcttgtcttaaatactaatgctcacttctcttccttactaataaatgtcctttgtggcacttttttttttgaataaggtacttttttccttgttaaaaacctatttaggtagatatactttcccctcaatgattttcttaatgggatctgggaattttgctgctgcttggtctgcaaaagttgtttcccctgctgtcttgacattttgtaaagcctaaagctatttctataatcatcaaaccatcctttgctttatatccttcactgtccttttgatttaagttttcacataatgacttcattttttctcaaatcacattagaatttataggcatgcttttcttataccaatcctgaagccacataaaagctatgttttcagtaaacggtaaaacaagtatttcacaaaaacagtaagattttgtgtctgttggtataactgcaatgacaacttcatgaatttcttattctgtctttaccatggttcttatgttggattcatttatcttgtaaaagtaggcagctacagctgtatcgtatcaagcaattcaactttttcttgcaatgtcatgagttttctctgcttcttgggaacacttccagcatcactagtggcacttcatatgggttcgatgttgttcttcaaggtttatggcatttgcactaagcacaataaaaatatgagaaaaccatgatagtttaccttttactgctatatgcaatttactgtagacaggaactgctcaattgaaatgagtactgttacaagggcattttaagcagataaaacacttcagctcaaggcaatagcaacaggaggtgactataaaattattacagcaatagagtaagtactatagttaattttatgcagttatgctttactattgcatctgtatcttcatttgcatttctctgaactgtaatagagccatgaataatccatttgtatgtataagttttgataaattttaactttttgtaatagacttgtgatatttttagtggtaaatgataaagcagactagtatatacatgtattttgtgcaacatgacatacctttttcttaatttttgatattttttgacctatattttatatatatttgtcttcaagttttttcaaattgtccaaagtctccccaaatgtttcttatatagttattgaaaaaatactgtgcataagtgacctgtgcagtccaaatctgtgttgttcaagggtcaatagtacacatacagtcatgcatctttttaaagacatgcatatgttctgagaaatgtgttgttaggcagtttcatcattgtgggaacaccaaaaactgcacttaaaaaacctagatggtatagcctactacacacctaatctatatggtatagcctgttatccctaggctaaaaacctgtaccacatgtcattgcactgaatattgcaggcaattgtaacacaatggtaagtatttgtgtatctaaacatatctaaatgttgattatctaaacatagagaaggtatagtaaagtacagtattatgggaccattgttgtacatgcagtgtgcatcaactgaaacattgttatgcagtgcctgactttattttccatgaggtgtgttattatatagcttagtcatttgaatccgcttttcatcagaatccttctcactttctgggtttattataatgcttgtatttgtttttatgttgattaattagaaatatttttggaaagtacaactctagaacttacgtactctaccttaatgaactctaattttaaagagggagctttagaaagtcttttaaggaaatgaaaataccttgtgaacttccaaaacactcatatttccccctttttcaacttcgttgattgacctggaacccttaaaggagaaaaagaatctatcaagtagagctggatcaagtgtaattttggtttgttttattttttaatagttttttctctcagggaagtttcatgtctttcgtcagtcatgggagtttctctactatcatttattcaatttcaattatgcctctggcccatgctcattattttcttgctctggcagtttagcataatggttaagagcatgccctcttgagcctcaggtccaattcctggcttctctatttattagctatatgaccatgggtaagttaattactttctcttcctcaaaggcttgctgcgatgagtaagtaaatgaatatatgtaaagtgctcagacagtgctcagtatattttaagtattatgtaagtgcttgctcttattataatgattacttttatatagaggtgtaaatctttttatctttttttccattcctctttcatactttctgtctgtataacatttggaattgcattatgagctactaggcttggtgctccagaatatttgtgtgcccaatagctgtgtccacctttcttttttagtctatataattagagtttgcttagttttttgttacaatctcaatcattatacttttatatttcaaaaatctctaataatttcttattgtacaattgcttagtcttatataggtataatatcttcctaatctctctccagatatttggacatattttggacattttacgaaacacactttttgctaactctttcaacacctgtaagtgtctctgtcatggttctgatatttgctgctttcttgtgcactttgtagcttagttgtcctgtacgactatctcctcttttcattcagggagatgggtgtgagctgaaatgtggcttggatacttcgttagtgactgtgagaaagtggcatcccttggcagctgtttttctgagtatgggcacttgcaaccaaatgttgtgagccattcgggacacattatgcctccgtcttcctgacctccttcagttaatattcctacctcgggacttttccattgttgtttgccaaggttaacttacctgactactccagctgtgagaccatgctaataattctggtcgttgatccttagcatcttattcactggttccacgccctaccagcacagaccagttaatgttttattttaaagttgtgctttgatatggcttttttccgctgcttgttgtttctcaggattctctagactctgtagcgcatctagagtgactttttgtttttagtggagctatgacttatttttatatatgacaaaataatgtctatgaatttgatgcagaaggagaaaattgcctaatgtattcaagtctgctatgttgaaatagaattcaatagtgaccttcaaaaagatatgttctaaccacacgaacctgtgaatgtgaccttttttttttttaaggtgacttatgcaggtgtcattaagtttagaatctggaaatcaggtcatcctcgattatctgggtggaccctaaagttagtgataaatgtcctcacctgaaacacacagggagaaggaacagaagatcatgtaaagatagaggcaaagatgggagttatgtggtcacaagccaaggaactccattaaccactggagctggaagaggcagggagggattcaactttaagattttagaggaagtgtagccctgctgacattttgattttggacttctggctgccgggctatgaaataataaatttctcttgtttcaattaaccaagtttgtggtaatttttaatggaagtcctaggaaattaataaaggtatcttcttctattaatacacaattttagcagaaaatattgtctctcatttcacagaaaatattaagacagtacataaaaccttccttaatttcctccttgtcacttacaaacatgtttatatccacaaccatacctaccttccacatcccacctactgttcaaagttacatttgtgttagggaacctctgccatttctgcctctgctttaccaacaaacgtctttgtaatctggtagacattttccttttacatgtgaacagagccaagcctctttgaaataaaaaatcctgcaggtttaacaaatcacccttcaacttctgctctggattctgtcttcattttacagccaatcgttgagggagagcagccagcacacaccgtcctgtctgtatcacatatctcaaactaatacagtctttctcttgaggctaatatgccactgaaagctaacagtaccaaggtccttcacattgccaaagcctgtacacatttcctttgcttatatcaattgccctcactttgatatttgactccggccattgcacaccacccttcaatctctgtttaccctcttcttctgtttcttctgattgactgtttcttcccaatctcacacataggtttctttctctccccagtgcctgttaaatatcaggagtataatccaaggttctgcctttgtccctcacttcttgctacattgtgtgatctcaaggtgaccacattcatactcatgattttatctttatttgatatactggagactctcaaatatattctcataatttagaactcactttgggcttcaatattgaacatccaactctcactggcacatctccattaggatgtcccaaggacactttaatctttatttttgacatcttctcatcctgacttcagacttgttactctgtattaccttttttagtcaacagattcttcattcaaacaactgaaacagaatattgttattatctagaagtcctttttgtgttctcttatatcatatctttgtatgtgatttaagcaatcattttattctgctgtatatcatgtaaaattggatctagaatgataaatagtttttatctcaatcaccatgtgccattgatttgtaggggctgccaagagtacaaagttgagaaagatagtgtgatcacctctagagtgagaggaaagacttccacaattgatgatagatgaaatggcaagggtgaagaaaagtgaagcatctagctctgaatgtgttatccatgatcttagattataaagttcacaggttaagtcagtgtgtgtgtgtgtgtgtgtgtgtgtgtgcgcgtgcgcgcgcgcacacatgcacgtgcacaggcacacacttgatttgggatattttagtaaataaacagataagcacaaaaaggatgctttaggcaggaagaacaaagtcagagaggagtcaagtggaacttaggggatactaatagaactccataatttaatttgcatagagggaagtttgtagttgatgagagaaatttagattggactcaaattagttaaagccatttgtgccaagttaaataatctttatctaagataatacagaaggatagtaaaatctcattctttctggcattgtggaactttacaaattccatttaaatttatttttaaacacttcccttacagggtaatctcaaaataaaatgacgcagtttaaaacaataacaattattcaaaaaaatagaaacatgttgtgaaaatacagattatttctctattttaattaagaatggtagtaacagcagtaatatatcttctgcctgcagtgtcacccaccatctgtgtgtttcttgacccctggcaatagtcccaggcatggatagaaatcatccctgcagtgggtgcagccacattaattttcactagggcttcatagtaagtttccatattgcagttcttttagggagagacctctggtcactcgacttcatggcagacagctcagctaattgaagaagtgatagtattctctacaaccatgagtacaattaatgaaagtattctgctattgcctaggcttagattttttttcttcacataatttatcagagaatttgaggtttgcaaatagatttttaagatgtcatttgggactttcactgacctccagaacagggccatttccattcttcttctgagcagcttgcctatttgactttaacaagccaccagaacagctgccctaacacccctgctgttgctatttctgatattactagtctagcaccaaggtttacttattttttctcttttctcatcatcagccagctatgaaaaaagaaccattcttcatgataaaggtcatatttgcatttcaaaattttgagtgactgtactgcctgatattaatatatattataaataatatggactcaaatttccaagtagcagcattgactataaataaatatatctaggtaggaactataggaggctcacctatcaatgattgtttccagttttaaagatatacttttaataaactataatatgatttcctgtaagatacagtttttcatataaaaaccaaagtggcaagtacagttcaagtaattccaaagttcctcttgcatgaatagccttctcacatatgttatcctaacattgatctttcatttaacttcaaagtatgctctatttccctctgtgaaatcggactttgtacttcattggtcattttatccacatatgctttctctttatgtttctttatttggttccaaaaatattggcattgtaataagtagagattttatcaggtatatcataaaaataattatttatccttttcaggaaatcaaaaaagtgaggaaatggctccaaaaacttagtactaatgtttgtgtgtctgtgtttgtgtgtgtgtgtgtctttgggagtgttggcaatggaaagaagttaaactgaaattgcatacactaagttgtaccaatattttgtgaatcaatttagataattctgtgctactaaattgggaacattatttattagaaaaaggacttccctgagaattgaggagttcactgtttggagtgatttgaccaactggttattttatcattctgcagaccttgatttaaaccacattttatgtccttatattccctccttttcatttgttgatattgatcctttgtttcacctttttaacccattccctcaaaatatgaaatgcttctttcttctttccaaggctatatttcccacctgctagtgactggattccctctctcctttgtgaacttgctctatccattgtaatttctctgttttgtatattctacaccttttatagtagctatttgatatcagcctatgttatcaggattctggtggttgcaagtgacaaatcaaatttgtaagtgtggaaatttattggttcacaaatttgaaaagaccaaagcaataattagttttaaacatgactgcatccatgggctcagatgataacatttttttctttcatctcttcactctacttccctctatgtgttgatcaaacttatttccaccaaatatggtctagttatatatgggacctggagtgaccatagatgtcttcagaccttatcctacaagccaggcattgcagaagacaggacttctggttgtccacagtcagttaatggttcttaagttcttgaactactgctgaaatcggtagcaaggaaggagtcattttctaatagaaggatgtttttgctttttcatttgaataagagaagaaatgctgaatagtgaagcaataggtgtcctctaaatatatttgtttcttaacatagaaagtaccttgggtaggatagaaacataaaagaggaagagaatttggagagattaaaaatctgatttgtgacatattgtggggtttctgtatgtctggtgataggtagctgaaaatacagattgcactttaggataatgaaattcactgtcttcaatatattactctctatttaattatatcttttctggaaataatctctctttggtaatctaaaggctgcccacatttcactttgctcttcctacacatgttgctgtgatgaaccttttggaccaaaagtctaatgagtatctttctcctatgtttattaaaaacagcattcttactaaaagtaatgactacttttctttcttcatagtacttgattacattgtctttgacattattcaatgctgtatttccaactccctatcaacagacacacacaaatcacaatatctcacaaatccaatttttaataatcacttccagattcctcctctttctatgtttttatcatattcaacgattttaacaattcttttttaaaacatctagggaagtcagtcaatattggctttcctctttctcatgtgtacattcagcatcccaacaaatcccacctatgttagacttctttagagtctcttctctgctttccaacaacattgcaaacatttcatgacgagatctttcttaaactattccaacagctttttaacagtctgcagtcttcattcttttctattccaggcagcaaggcacaaagctatttgatttatttttctttttttttcaagtagacattttctttttaataaaacagagcgcaaatttaagagtcttgtaatgggattcaacatttttccttcacgcagctcgggtgtgagtacctggctttaaagcaaatccagtatgtgaaaatggggatgtgtacccatcagatctggggcaagagattcacttcacagagtgaatgcttcttttctttaccagaggaattttcatagtattctctggaagggataagctttcctcatacatataaacacttagtaaatttttaatttaagtacactctttagacaagtgctgtataaagagaagactcagatcaggcagatggtgcctattatttttcaagcaattaccttaattcaaatgaaatccaaatgttttgtcaacatctggttggcattcagtgccttgcctagattgttcttttttattttttattttttggtaatagaaaaatttattttttcaaattaacatgttttcttctttgtttattatactttaagttctagggtacatgtgcacaacatgcaggtttgttatatatgtatacatgtgccatgttggtgtactgcacccattaactcgtcatttacattaggtacatctcctaatactatccctcccccttccccctaccccacaacaggctctggtgtgtgatgttccccttcctgtgtccatgtgttctcattgttcaattcccacctatgagtgagaacatgttgtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctgtcattggtggacatttgggttagttccaagtctttgctgttgtgaatagtgccacagtaaacatatatgtgcatgtgtctttatagcagcatgatttataatcctttgggtatatacccagtaatgggatggctgggtcaaatggtatttctagttctaggtccatgaggaatcgccacactgacttccacaatggttgaactagtttacagtcccaccaatagtgtaaaagtgttcctatttctccacatcctctccagcacctgttgtttcctgactttgtaatgatcaccattctaactggtgtgagatggtatctcattgtggttttgatttgcatttctctgatggccggtgatgatgagtaagttttcatgtgtctgttggctgcctaaatgtcttcttttgagaagtgtctgttcatatcctttgcccactttttgatggggttgtttgtttttttcttgtaaatttgtttgagttctttgtagattctggatattagccctttgtcagatgagtagattgcaaaaattttcttccattttgtgggttgcctgttcactctgatggtagtttcttttgctgtgcagaaactctttagattaattagatcccattcatcagttttggcttttgctgccattgcttttggtgttctagacatgaagtccttgcccatgcctatgtcctgaatggtattgcctaggttttcttctagggtttgtatggttttaggtctaaacatttaagtctttaatccatcttgaattaatttttgtataaggtgtaaggaagggatccactttcagcttcctacatatggctagccagtttccccagcaccatttattaaatagggaatcctttcctcatttcttgtttttgtcaggtttgtcaaagagcagatggttgtagatgggtgttattatttttgagggctctgttctgtcccattggtctatatttctgttttggtaccagtatcatgctgttttggttactgtagccttgtagtatagtttgaagtcaggtagtctgatgcctccagctttgcccttttggcttaggattgacttggcaatgagggctcctttttggttccctatgaactttaaagtagtattttccaattctgtgaagacagtcattggtagcttgatggggatggcattgaatctataaattaccttgggcaatatggccattttcatgatattgattcttcctatccatgagcatggactatttttccatttgtttgtgtcctcttttatttcgttgagcaatggtttgtagttcttcttgaagaggtccttcacctccattgtaagttggattcctagatattttagtatgtttgaagaaattgtgaatgggagttcactcatgatttggctctctgtttgtctgttattggtatataagaatgcttgtgaattttgtacattgattttgtatcctgagactttgctgaagttgcttgtcagcttaaggagattttgggctgagacaatggggttttctagatatacaatcatgtcatctgcaaacagggacaatttgacttcctcttttcctaattgaataccctttatttctttctcctgcctgattgtcctggctagaacttccaacactatgttgaacaggtgtggtgagagagagcatccctgtcttgtgccagttttcaaagggaatgcttccagtttttgcttattcagtatgatactggttgtgggtttgtcataaatagctcttattattttgagatacatcccatcagtacctaatttattgagagtttttagcatgaagggctgttgaattttgtcaaaggccttttctgcatctattgagataatcatgtggtttttgtctttggttctgtttatatgctggattacgtttattgatttgcatatgttcaaccagccttgcatcccagggatgaagcccacttgatcatggtggataagctttttgatatgttgctggattcagtttgccagtattttattgaggatttttgcatcgatgttcatcagggatattggtctaaaattcttttttttgttgttgtgtctctgccaggctttggtatgaggatgatgctggcctcataaaatgagttagggaggattccctctgttcctattgattggaatagtttcagaaggaatggtaccagctcctctttgtacctctggtagaattcggctgtgaatccgtctggtcctggactttttttggttgataagctattaattattgcctcaatttcagagcctgttactggtctattcagggattcaacttcttcctggtttagtcttgggaggctgtatgtgtccagaaatttatccatttcttctagattttctagtttatttgcgtagaggtgtttttagtattctctaatggtagtttgtatttctgtgggatcggtggtgatatcccctgtatcatatttgatttatttttctacatgaaaaaatttgtcttttaggaagttaaggattttttaaaaaccttcattgtgtctttttagcttacaacataaggttcaaaattcttagtatgaaatttttaaattattctcattttttctcaatagtcttgcaatttcacattccatatttcaaccacactgagaaatttgccattctcccaacatatcattctccttaatgcttcagtatctgcgctcatattgttctttctactagcagcacccttttttattgaatttgatctcagtcttctaagccataggaccaagaaagcacctagcacatagcaaatggtcaataaatatgtgttgcatgtatgaataaatttgatcatacttaatttatttttgttttacattttctaaattggaatcataatttatgccttgagtacttcacaggcaaattcaagaaggttttgttaaaattgattaattaaaatttatgtcttaattagcctaacgtagtgaacttgttccataaaacacagatagaacaggagccaaaaatactatgggaaaatcattagaaagttgttcttaataaatcaaaacaaaggtaattgaagtgaaatgcagggttctaaacaacagatacattctcaaaatatgactttcagtacatttcacaaaataactaagttttcccgctacccctttatgttcctgtcacttttaaaaatgatcttttgagctttatttgtagcacagcaagtctcagagagttggagaagggaaaaaatgctttaatcttcatctttttccctcttatagatttataggtggaaagttttcttaaaagaaacaatgtatacaccacctaccatcagatcaggaaaacaaaacaagcgtttaattaactgtcttagacagaacattggaaaggccaactccaattctgtctacctattccccagctttgggacaaatgttgcctttatactgccctcttgttttctcacagtgtttgtaatgcacggaaaaaaaaatactattacattgattttcaaatgctatgtagctgcagttttaaaaataaacagttgttttttgtaatcttcaaaaatgctttaactgattaaaagactacttctcacatatagataattataaaaacatgtaatcaatttttataacaaacctaagcactatgtcatcataaaaatgcacaacccttcaaaagtagttttgaggattttttactaaaaccagattctgaaacaaaaaattaacttcaaaagacagactaaagcaatgacctcatgctactcactacaaagaggcaacagtagacaatagggtcatcaaaatgaaaaccatgccaagctaaatgaaaggaagacaataagctttctttctttcaaaaaaatggtttcatcagcatttctaatgacatctcaagggttatagatgaaaggtagaccaaatagctaggtggagttgttggttaaatgttttattttgttacaattaattttcaagttaaaattacttaaagtggtcaagttctaattaaatattaaaattttattcagttatagccaacttataaatatttactgctagaagcttacaaacaacatgctcagtttaatattttccatttgcaaagtatgacacaattgaagaaacaaatgggacccaattcattatttctggagtattattttatatttatgaagcttgttttataactatcaccttgatgtctagcacatattaagagctcaaatacttaatgttttattgatgtgccattgcatggcagatctcctgagtggtagatttaaatttgctcccaaacttcaatttaattctcatttcctaggccatcagcatttccaataaacaaaacaaggctttggcatttctctaaataacgataaaatgagtttacatgtttggaaaagttatttttctgcatcaataatgttacacattaatctcaataagagatttttttctttttctcaagtcagtagccacattctgctttttctgtttcagataacagtctttcaaattcgcgtcttggccacaaagagtagacatactaaaaatccattcttaatgcactcttcccctgtgactgatgactattccacaacctctcatctctaccaaaatcggcagcactatctccctgcttcattcttttttttttctttttattttattttattttctttttctttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgcgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacattttcttactccctgcttcattcttaactggtgacatttttcctatttaagtgagaaaatacacataatgatccttagaagacatgttccccaaactcccaacaccatgtaactgacctgcttacttttgtacttatctcttttaactgcagtctaatattatgaaaaagtttgtgtatccatctagagtcttatatcaactcttccacttgcagttcttcccttctcatttacttattcaggtttcccttgtaggacatcactctaccctgactttcctccattgttgctaaccactctttttcagtctcactgtggattccttcacatctcccatcctccaaatattggaagtgttcttgggctcaagccatggtgtcctctcacttctatccttatttatccttagtaatctcttctgttctcagtgagacagagaatagaaaactctcaaatgtgtagctctgaaatgaatttgtctcctgattccagattttatgtaagtcaacagacttgcatctgtatttggacgtctaataggcatctgaaaattatctagaccttactcttgatctttcttctcaaaaacctgtttttcttcaagtctttccattccaaggaagtggaaagttcagccttccagcttctctggccaaaaactccatcttctctttttctttctcattacacatgaaatcaggaaaacatgtttctctactttaaaaatttagcaatttccaatcaccttgttaacacccagaaatactgtaatagctttataaccaatctacctgcttctgcccttgtacatctcacttttaatctattcccaaaagagtagtcaacttattcttatgattgggtcaaaaccctccagctcttttccatatcactcaaagtagaaatcaaaatggataatgatctggtgcttcctgctgctttctttgaatccagtgctggctagacacatcaaccttctagctactctgtcctccaggctcttgcacttgtagttctctttggcttgaacattctggccacagatatctacacagtttattcccctctctatttcagatctctgatccaattccatctttcttaatatagtcttttatacctattaaatttgcaatctctttctttgccatttcacatttctcatttccaaccattttaagtagattttattgtgttatgctagatattttacttatgaactttttattttctccctacaagaaagtgagctataggaggataaagacttttctttatcccacttatgaatatatccccatcgcctagaaatgttacctgcacctactaggcattctaaagtgcaaaacctcttggatttgcaaagacatggaatcaacccaaacgcccatcagtgatagactagataaaaaaatgtggtacataaacaccatggaatactatgcagccataaaaaggaatgagagcgtgttctttgcagggacacgaatggatctggaagccattatccttagcaaactaacacaggaacagaaaaccaaacaccatatattttcatgtataagtgggagatgaaaaatgagaacacatggacacagggagagaaaataacacacactgtggcctgtggcaagggtgtgagggtagggagagcatcaggaaaaataggtaatgcatgctgggcttagtacttaggtgatgggttgataggtgcaacaaaacaccatggcacgtggttacctatggaacaaacctgcacatcctgcacatgtaccctggaacttaaaataaaaattactccatgtgcagttatataggtaaaagaccccttggatatacacacatgtagtatatataagtttagtgttacactggttcagaataaaaagtctcagagactatactttgttttataaggggttcactaaaatataaacaaaaataatttcaaatgtacaatataatatgtgtttatttgggagactacagtggacttctgagataaattatgagataaattgaaaatatattttaaaatgctattttatgcatgtttcaaagggaacatttaactatgtctgtgacaatcaaaataaaatcataaaaaattcagtaaatgtaattgagttttgctttctttgaaagtatatttgttaataatcacaatacctctttaatggatatttgactacattttaaataacattaaaattaatttcctagcattaaaatgtttgtcaactatatcattttaaacttaatcatatatttgtacttagtatgactctagaggtattctgtagtctttttatcactttaatctactaaacaatgtagacagtatactgtatatcaccaagaagtgttcacaagttgttttttccctccttctgaaaaatattatgtctgtgttttagtgtatatgtttgtgtcttttgggctataggtgtacatctggaatttgctagcattagcacacagaaatgtacactcaagtgatttgaagcaactttggtctgttgtcaaatttaatagacattttcagtttattatgtatacaaatatttattatatataaatatatacaaaaatataaaatatataaacacataaatataaaatgttatatatagatacaaaattttacatacacacagaagagaaattcctcaaatgcagagctaatgcaccaataaacaaacatttgtgagtatatttagcttattagtcatatctgatgctaagatctaccatcaaaaacatctaaaggagtttttttcttttttttttcttttttttattattatactttaagttttagggtacatgtgcacaatgtgcaggttagttacatatttatacatgtgacatgctggtgcgctgcacccactaacttgtcatctagcattaggtatatctcccaatgctatccctcccccctcccccctcccccctcccccctacccccaccccacaacagtccccagagtgtgatgttccccttcctgtgtccaggtgttctcattgtttaattcccacctatgagtgagaatatgcggtgtttggttttttgttcttccgatactttactgagaatgatgatttccaatttcatccatgtccctacaaaggacatgaactcatcattttttatggctgcatagtattccatggtgtatatgtgccacattttcttaatcccatctatcatttttggacatttgtgttggttccaagtctttgctactgttaatagtgccgaaataaacatacgtgtgcatgtgtctttatagcagcatgatttataatcctttgggtatatacccagtaatgggatggctgggtcaaatggtatttctagttctaggtccatgaagagtcgccacactgacttccacaatggttgaactagtttacagtcccaccaacagtgtaaaagtgttcttatttctccacatcctctccagcacctgttgtttcctgactttgtaatgattgccattctaactggtgtaagatgatatctcattgtggttttgatttgcatttctctgatggccagtgatggtgagcattttttcatatgtttcttggctgcataaatgtcttcttttcagaagtgtctgttcatatcctttgcccactttttgatggggttgtttgtttttttcttgtaaatttgttggagttcattatagattctggatattaaccctttgtcagatgagtaggttgtgaaaaatttctcccattttgtaggttgcctgttcactctgctggtagtttcttttgctgtgcagaagctctttagtttaattagatcccatttgtcaattttggcttttgttgccattgctttcggtgttttagacatgaagtccttgcccgtgcctatgtcctgaatggtaatgcctaggttttcttctagggtttttatggttttaggtctaacgtttcagtctttaatgcatcttgaattgatttttgtataaggtgtaaggaagggatccagtttcagctttctacatatggctagctagttttcccagcaccatttattaaataaggaatcctttccccattgcttgtttttctcaggtttgtcaaagatcagatagttgtagatatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcaggctcttttttggttccatatgaactttaaagtagtattttccaattctgtgaagaaagtcattggtagcttgatggggatggcattgaatctgtaaattaccttgggcagtatggccattttcacgatattgattcttcctatccatgagcatggaatgttcttccatttgtttgtatcctctttaatttcattgagcagtggtttgtagttctccttgaagaggtccttcacatcccttgtaaggtggattcctaggtattttattctctttgaagcaattgtgaatgggagttcactcatgatttggctttctgtttgtctgttattggtgtataagaatgcttgtgatttttgcacattgattttgtatcctgagactttgctgaagttgcttatcagcttaaggagattttgggctgagacagtggggttttctagatatacaatcatgttgtctgcaaacagggacaatttgacttcctcttttcctaattgaataccctttatttccttctcctgcctaattgccctggccagaatttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagcgttgttgaattttgtcaaaggccttttctgcatctattgagataatcttgtggtttttgtcattggttctgtttatatgctggattacgtttattgattttcatatgttgaaccagccttgcatcccagggatgaagcccacttgatcatggtgggtaagctttttgatgtgctgctggattcggtttgccagtattttattgaggatttttgcatcaatgttcatcaaggatattggtctaaaattctcttttttggttgtgtctctgccaggctttggtatcagggtgatgcgggcctcataggatacccaggaattgaactcagctctgcaccaagcagacctaatagacatctacagaactctccaccccaaatcaacagaatatacatttttttcaacaccacaccacacctattccaaaattgaccacatagttggaagtaaagctgtcctcagcaaatgtaaaagaacagaaattataacaaactatctctcagaccacagtgcaatcaaactagaactcgggattaagaaactcactcaaaaccacttaaccacatggaaactgaacaacctgctcctgaaagactactgggtacataacgaaatgaaggcagaaataaagatgttctttgaaaccaatgagaacaaagacacaacataccagaatctctgggacacattcaaagcagtgtgtagagagaaatttatagcactaaatgtccacaagaggaagcaggaaagatccaaaattgacactctaacatcacaattaaaagaactagaaaagcaagagcaaacacattcaaaagctagcagtaggcaagaaataactaaaatcagagcagaactgaaggaaatagagacacaaaaaacccttcaaaaaattaatgaatccaggagctggttttttgaaaggatcaacaaaattgatagaccgctagcaagactaatgaagaaaaagagaagaatcaaatagacgcaataaaaaatgataaaggggatatcaccaccgatcccacagaaatacaaactaccatcagataattctacaaacacctctatgcaaataaactagaaaatctagaagaaatggataaattcctcgacacatacactctcccaagactaaaccaggaagaagttgaatctctgaatagaccaataacagtagctgaaattgtggcaataatcaatggcttaccaatcaaaaagagtccaggaccagatggattcacagccgaattctaccagaggtataaggaggaactggtaccattccttctgaaactattccaatcaatagaaaaagagggaatcctccctaactcattttataaaggagtttttttcaagatgtttatattttaatgtctgtaacattaagtctaatctttgttctaccatcagtgttttgtagtaaatttcaaaaatatcatgaccatctgcaccattctttcacttcatgattgatgttgaaaatttaacagcataattgtattctgaaaaggtagtcatatcatatatcctgttgttcatggatttatattgtggaatgcattactttaaggtattcttctttaagacctgtatataattatgattgctatagatgataagttggcatggttataaatttattatcaaagttgggtttaaaatattaattaataatcttttattttggctcccaggggagaaaaaaccaatagctctgtattaattattttatgagagagtcttacaaattttgaagaactgcattttcatcagcattttctcaaatgatgtgaaaacatttaaaggttactaactagtgctacattgcagtagaacccataagaaattatatgtctgatattaacatgaatttatttcaaccagaataatttaggatgatttgtaaaaattcataaaattaggagttttttagataatacaattaaaaatgtaaaataataaaaacaactatcgtttctgctctatatgatgtttataagcctagattactacacaactctctgcttgaagcatatggcaaagtcaagtataatatgaatatggataacaacaaaaagtgccatggcaagaatcaaaatgaaataaatatctctgtagactttataaacaaggtctttctgtgttgcccagactgaagtgtagtggttggatcattgtctatagactataaacaggtaagaaacccaaagtaagatatagtattaatgggctctggatctaaaagcaagcaaaagtacttccagaattgtaaagtaaaggataataaatataatccactcagacagagtccaaaagtctcagcttaacatgtggccctggggtaggctttcccacagtagaaagaagagagcctaaaacaatgtaaccttttgggaggccgaggcgggcggatcacgaggtcaggagatcgaaaccatcccggctaaaacggtgaaaccccgtctctactaaaaatacaaaaaattagccgggcgtggtggcgggcgcctgtagtcccagctacttgggaggctgaggcaggagaatggtgtgaacctgggaggcggagcttgcagtgagccgagatcccgccactgcactccagcctgggcgacagagcgagactccgtctaaaaaaaaaaaaaaaaaaaatgtaacttaaacagtggcaaagcacaaatctggttactgcttttaaccagatcccagcctatggaagctaccaaattcatgactatgaaatgacacatgtgcctatggtattgcaaatatcatcaacacagagaggctaattactacctaagacatgatttggatggaggccccaaggacaggtaatttaaaaacttattttaaaaaagttgacaaaaataacaaaacaacaacagcaaaaaaagactttccactcaacgtgaacctcaaaataaaatgccaaaacaagtaagaaatcaaataataaatgtgatgggctgaataataccccctctcctcttaaacaggaggtcctaatctctgcaatctgtatatgctatcttatttggaaaaatggtctttgctgctgtgatcaaaatgtgtgtcttgagggggtacgattaacctggattcaagggggttgtaaataaagtaaaatatgtccttataataagaggcagagggatatttgatgatacacagaagagcctcttttctggtgcgatcatggaggcagacactggagtgatgcagtcacaagccagggaatgccagcagccaccagaacctctaagaggcaagacccagagtttcccctagaccctctgaaggaagcgtggccctgccaatatcttgatttgagcccagtgaaactaattttataatcctggctgccagaactttgaaagaataaatttctgttgttttaagctaccaagtttgtagtgatatgttatatcagccataggaaattaatacaataagagatacagctaagaaaaccaatcagaacatgaaattaaataaaattaattgtctccataatgaattcatactctgaaaagacaaaaatttgaaatatgttcaggatactttaaacattcgataaattaacaacagaaggtcctgaaagtaatcccaatgttgtcataaaaattattttataaaaaaagaaaattaaaatattcaagaagaatctctaaaactgacactactgaaggaaatattaataaattaaaatgtggtattgagaagcattaaaaaaagagatgaaagttttgtaaaaaacagttaagcatcaggtggttccaatgatcacataatacttggtatcacacgtatgcttgcagtaaaaaaactataaatgtgtatgtgtattagagcccattaacactatatcttgctttgtgtttctgatgtatttatagtgtgtggactacaaatgagccactgcactccagcctgggtgacacagcaagaacctgtctatataatctgcagggctatttatttcatttgatccctgctgtgtcactttttgttgttactatttatattcacattgtactcggctttgccatgtgtttaaatcagagtgttgtgtcatgatttcagcttataatatatcatctagaccagaaattataattgtttttattattttatatttttaattttattaactaaaaattccctaatattatgaatttatacaaattatcctatatatacatacatatacagttgaccctaggtagcatagattagcattgcatggggccacttatacatagatttttttcagtaaatttattgaaacatttttggagacttttgatggtttaaaaaacttcaagtctcagacatactatgtaacttagaaatatcaaaaaggttaagaaaaagttagatatgtcataaatgcataaaatacaaggagatacttgtctattttatcatttactgccataaaatatacacaaatctgttataaaatgtaaaaatttatcaaaatgtacacacacagaccatacatagccccattcacagttgaggtaaatgtaaacaaacacaaagatgcattattaaatcataactgaataaaagtgaccgtagtacatactatattgctgtaataattttatagcaacttcctgttgctattgcagtgagcacaaatattgtaagtatccacttaaaaatgccttgtgatgctgatcatcttcatgtgggaagttcatctctccaattgcctattgcagtaaaaaacgatatctctcagttctcacatatttttattgtgttcagtgctgtaccttgagtaaccatgggacccatatgaagtagcactagtgatgccaaaagtgctctgcaaaggaaaaatcatgatattataggaaaaatttgaattgcttgacatgtaccatagattgaggtctgcagcgtggttgcccactatttgatgataaatgaacacagcataaggaccgctgtaaaaaaagaaagaaagaaaaggaaactcacaaagccatcattgcagctacctcatcagctggagaaaccttgcagtttttgtgaactaccatttttatctcctctggaaagtgcaacttttatgtgggggcaggattgctataagaaaggcacatctgtagactctaacaggatttggaaaaaaaataaagttattatatgatgacttcaagcaaaagtaaggtgaaagatctaaagctagctaatttaatgctaacaaaggatggtgtgataattttagaaacatttttgattaaaaaaaaaatcaagatatcaggacaaatggcttctggcaaccaagtggcagcagatgagttctgaggggccattaagaaaataattggaggcagggcatggcagctcatacctgtaatctcagcactttgagaggcggaggcaggaggattacttgagcccaggagagcaaggttagtctgagtaatgtagtgagaccctgtctccactaaataaaaaaatttaaatttaaatttaaaaaaaatagccaggcatggtggtgcactcctatagtcccaactatttggaaggctgaggcaggaggatagcttgagtcctggaggttgaggctgcagtgagctgtgatcatgtgactgtactcaagcttgggcaacagagcaagaccctgtcacaaaaaaataaaagaagaaaataggctgggcacggtggctcacgcctgtaatcccagcactttgggagcccgaggcgggtggatcatgaggtcaggagatcgagaccatcctgactaacacgatgaaaccccgtctctactaaaaatacaaaaaaattagctgggcatggtggcgggtgcctgtagtcctagctacttgggaggctgaggcaggagaatggcatgaacctgggaggcagagcttgcagtgagccgagatcatgccactgcactccagcctgggcgagagagcgagactctgtctcaaaaaaaaaaaaaaaaaaaaaaaaaagaagaagaagaagaagaagaagaagaagaaaataaaatgattattgaagagaagggatatctgcctgaacagatttttaattcagacaaaagtgccctattttagaaaaaaaaagccacaaaggacaattattagtaagaaagagaaatgagtaccagaatttaagataagaaggaataagtttacttttctgtgcaaatgcagttgggtttgtaatcaggacttcccttatccacaatgcttttaaacctcaagtcttgaaagaaaagatagacaccagctgccagtttttgttttacaagaaaacctggacaaagcctccacctcttttgcctctgtcaccctgagacagcaataccaatccctcttcttcttccttctcctcagcctactcaatatgggcacaatgaggatgaagatttttatgatgatccaattccacttaatgaacactttttctggattggttcaatcagtgttttctccctgaagtcaggaaggtgtttccactaagagactacatttctaaagttcttttgatgttgaaaaatgcccctggcttcccagaatcccatgaattcagcaactaaggtgttgaggtggtctgcttgtcctcaaatacagtgtctcttctgtagcctctaaatcgggactttaggactttatcattaggactttaaggctcattacacacaatcctctatggaaaggacaaagtgcaattctgtctcaaaagaaaagaagaagaagaagaaaagaaaaaagctgtcaacagtatgaaagataaacctgaaagtgagaacaacatgaaagtctgaaagaattatatcattgaagatgccatcattgttatagaaaaagctgtgaaagccaccaagcctgaaacaattaattactactggagaaaactgctgaaatattgtgcatgacttcataggatttacaacagagccagtcaagaaatgacaaaatagactgtgaatatggcaaaatacggagtcggtgaggttttcaagatatcgatcctggggaaattcaatagctaacagataccaatgagaggagttaacagaagacaacttgctgaagatgaatgcttccaagctaatgctggacaatgaggaagaagacatagaagaagcagtgccagaaaaagaatgaccttagacaatctgtctgaagggctctgattattcaagaccacttttgtgacatgggcccttctatcatatgagcattgaaactaaagaaaatggcagaaatattgatactaaataaaaatattttttagagcaattgagaaagcaaaatatagacagaaatacaatgtatttccataaatttacactaggtgttccggtctctcctgcctccccttccaccttctccacttcttttgcctctgtcacattgagatagcaatgccgacccctccttttcctccttctcagcctactcaatatggacacaatgaggatgaagatttttatggtgatccacttccacttaatgaatagtaaatatattttatttttcttataattttcttgataacagtttatttttccagctttaagaatataatacatactatatatgacatacaaaatatgtgttaatgaatgtttatattatttgtaaggcttctggtaaagagtaggctattagtagttatgtttttggggaatcagaagttatactcagcatggggttggtacccctaacccctgcatttttccatggccaactatatatatacatatgtatacatacacgtgcacacacacgtatgtatgtattcagacattagagagctcaaggctattgtctttgtgagaaaggaggtaagtgacatgaatctcaaattttctcagattttctccctgaagtcattttctgaaggttgtggtgccaaaaaataaagctaactctagcagcaacaatcttgcagggtgtcagagactaatagtaaatttctggactattaaataaactaatggttaacggataaactatttgttgggggcacctaaagaaaactctagaagactggataggatagatatttccctcaggccttggctaacttttgagttgctcacaaatgtagtgagattccatagtactagataaaacagtcagactaggaggctgagaaatgagtaaaagttacacaatgctgaggagacactaaaatttggatccagccaaagggagaaacctcagtgaacactgggcatttatgtgcaaactcagaaaaaaaatcttgaaataagatcaaatatctagcagtaagaacaatgctaaaataagctttccctaacaaagcctaaaactaagtctcaacagcatcaaagtatttcagataatttaatagattttcaggaaaaaaaaaaccacataccactttctagcaaaagataaatatccagagcctgtacagtatatcattacaatgttcagcataccatcaaaattactagatatgcaaagaatacaaccaaagatgatctagatattacagttaacagataagggcttcaaaataattatgcttaatgagttgaaaaaagaaaaatatgagtaaaatctatgtatgaaagtgtagtaatttacacagcagaaggtaagaatactgtatttaaatagaaaatgtttattgtgacgcataaagagaaaaaaatggaaagaaccgataagaatatgaaaatgtgggtagaacacagtcagaagatctaacagatatataaggagttccagaaagaaagaagagagagaaagggacagaattaatatctgaagaaatagtagctgagaatttttcaaatctgataaaatatattatctcatggattcaagcaactaagcaaaccatcaaaacaataaatacagcaaaaactacaactaagcacaaaagaacacagctgacaagatctacgaaaaagagaagaccttataagacaggttacttttaacgatgcaataatcaacaataaagcttttggcttactttctagcagtaaacataaaataatggaaacacatctttaaaatgttgaaagaacaaataattgtcaaccataatttgacactcagatgaatccttcaaaaatattgtaaaaataattacatttcaagaaaacaaaaaaataagactgaagggattttcggcagcccacatgtgcataaaaatactaaagggaatgattcaggataaaggttaattatggcatgtagatgcatgaacatgtagaaaaaagcgaagaacatcagaaagggtaaatatattggtaaatataaaagatgattgacttttgaagaaggaacaataaaatatatttttgtatctctaaagtatgataataataggtcaatgagaagaaatagagtttcattatggaaaagcaaaatattattaaaagtttcttgcattgtttttagaagtgataaaaatgctaacatatggtagaccataataagttaagagtgcatactttaatctctagtgtgaatactaaaagaataatgaaacaagacacaaattaaaagaaaatagaggaggtaaaatgtaacgataaaatgatttggttaatctattacaatggtaagaaatgaagaatgaagaaacaaaacaggtagaagaaattttaaatattagcaaagtagtagccataaactcaactgcagttgtcgttacgttaaatataatggaggaggagtgcagcaagatggccaaatagaaggctccgttgatcgtctgccccataggaacaccaaattcaacaactgtctacgcaaaaaaaaaccaacaaacaacaacaacaaaaaaccttcttaagaataaaaatcaggtgagcactcacagtatctggttttaaattaatatccctgaaagaggtactgaagaggatagaaaaggtagtcttaaattgctaatgccacccctttcccacccctagcagcagccatgtggtacagagagaatctgtgtacttgagagagggagagtgcagtcattgagagacattgcattaagctcagtgctgccctgtcatagcaaaaagcaaaacccagctgaactcagctggtgcccattcatggagggagcatttagaccagccctacacgaaggggaatcactcatctcagtggtgggaacttgagttgctgcaagccttgtcaccatgggctaaagtactctgtggcactaaataaacttaaaaagtagtctaggccacaaagactccaactcttaggcaaggcctagtgctgagctgagctcagagccagtggacttgggggacatatgacctactaagataccagacaggtggctaagaaagcatttgcaccatccctttcccaatcccaggcagcacagcttgtggatccaagagagatttcttcctttcacttgaggaagggagagagaagagtaaagaggactttgtcttgcatcttggataccaattcagccaaagtaggattggacaccggtcaggattgtgaggccacccttccagtccctaactgggatgatgacatttctagacataccctaggccagaaggaaatctgctgccttgaaagggaggaaccagtttcaggaggatctatcacttcctaactaaagagcacatgggcacggaataacaggcagcaatacccagttagtatcaaaaacctttgatgagactctgagatgtgctggcttcaggtgagacccagcacattccaagatctgatggctacagtgagagagaacttctgcttgagaaaagcagaaggaaaagcaaagggaacactgtcttgcaccttaggcaccatcccagccacaatggagtatagcaaaagtgggctcttggggtccccgatttcaagctttgactctttgatggcattttctgggccttcctggagccagagagcagcccaattcactgaaaggtgggtcccaggcctggcagtattcaccacaagctgactaaagagccctttggtcttaactgaacatcatcagtagcctggcagtactccccgggggtctgtagtggtggtagccattacacctttggtagtagaggctcctttgactgtagaaaggagaggtaaaagggggaaggactgtgtcttgtggtttgagtgccagctcagccacggtacaacagaacactagataattttctaaagtttctgaccagtccctggctcctggatggcatcacttctgagagccttgaatgaatataggtgatagttgggtagtagttacagtgagccttgggtaagacccagtgctgtgctggcttcaagtaagacctagtagagtcccagtggccacaggggtactacagtcactccaacccagctacaagtgactcaccacagagagactctgtttttttggaagaacataatggaagaaatcaagagtctctaactggtaatccagagaatttttctagattttatccaagactactgtggcagtacctctataggtctgcaagaaccacagtgttactgggcttggagtcccacctaatacagatacagcttagatcacaacacccaagtcctgtcaaatacctgaaaaatcttcccaagaagggcaggtatgaagaagtccagactgtgaagaatacaatgagtacccaacccttcaatgcccagacactgacaaatatccacaagcattgacaccatctagaaaatatcacctcaccaaacaaactaaataagacagaaaccaatcatattgaaacagtgatatgtgacttttcagacagagaatttaaaatagttgtttttagtaaactcatagacattcataacacagagaaggaattcagaattctataaggaaaatttaacaaagagattgaaataattataaagaattaagcagaaattctttagttgaaaaatgcaattaatgtactgaagaatggatcagtcttttaatatcagaattgatcaaacagaagaaagaattagtgaacttgaagacaggttatttaaaaatacacagaggacacaaaagaaaaaagaataaaaaaggatgaagcacacttacaaaatctataaaatagcctcagaggggcaagtctaaaagtgattggacttaaagaggaaagagagagagggattagggtagaaagtttattcaaatgggtaataatagagaacttcctaatcctagagaaagatattaatatcgaagtacaagaaagttatacaataccaaacaggttttacccaaagaagactatctcaaggcatttaacaatcaaactcccaaaggtcaaggataaggaaaggatcctaaaagcagcaagagaaaagaaacaagtaacatacaatggagttctaatatgattggcagaagactttttagggaaaccttacatgacgagaaagacaggcataagatatttaaagtgctgaaagaaaaacaaaatactttcatcctaaaagagtaaaaaattcctagtgaaaaaaattcttcaaaaatgaaagagaaataaggactttcccagacaaacaaaagctgagggatattaccaacaccatacctgtctgtcctacaagaaataataaaggaactttttcaaactgaaataaatggatgttaatgagcaataagaaatcatgtgaaggtataaaactcactggtaacagtaagtacacagagaaacacagactattttaacactgcaactgtggtgtataaactactctcatcttaagtagaaagacaaaaagttgaatgaatcaaaaataatagctacaacaacttttcaagacatagtacaataagatataaatagaaacaaaaaagttacaaagcaggagacaaagttaaggtgtagaatttttattagttttctttttgcttgttcatttgtttgtttatgcagtgttacatttttatcagcttaaaataatattttataatacagtatttgcaagcctcatggtaacttcaaatctacaaacatacaacaaatacacaaaaaatagaaagcaagaaattaaatcataccatgagaaaaaatcaccttcactgaaaatagacaaaaaaagaagtaaagaacgaagaccacaaaacaaccagaaaacaaattaaaaaatggcactagtgaatccttacttaccaataacatcgaatgtaaatgttatttacattctacaaattgttaaaattatcttaatgtaatgaaataattggatgaaaggtcaacataataaaaattaattgtatttttatatattagtaataaacaactggacttttttttgtaacatctgaaatagcatcaaaaaacctaaaaactcaggaacaaatttaaccaaaggtatctaggaccccacacttaaaactataaaacagtggtgagaaaaatttagagacttaaataaatggaaggatatttcatagttataattaaaagcatgagtcctgtgattatatacatctgtagttatttctactctattgtttcatgctttacatttgttacatttttctggaggtcattttttatcttctgaacttttgaatgttttaattttttttaatgatttggaagttatatatcattttttctattcattctacagttacccacagtatttagccaacatgtttaattatacacttttcttttagcttttttgaaatgtataatacgttattaataagtatggtcaaatgttctcaccacaaaaaagatgagtatttgaggtgatggatacgttaattagattgatttgataattccaccatatatacatgtatgaaaatatgacatttactccaaaagttatacaattgttatttgtcccaattaaaaataaaataaaagtaaatttttaaataaataaactgttttctttcaatgtctggaattactagatatttatatcctccatcagtaataatgcagaaatgggccaggcgtggtgtctcacacctgtaatcccagcactttgggaggtgtaggcaggcagatcacgaggtcaggagatcgagaccatcctggctaatatggtgaaaccccatctctactaaaaatacaaaaaaattagccaggcctggtggcaggcacctgtagtcccagctacttgggagggaggctgaggcaggagaatggcgtgaacccaggaggcggagcttgcagtgagccgagattgtgccactgcactccagcctgggcgacagagtgagactccgtctcaaaaaaaaagaaaaaaaaaaagaatgcagaaatggaaacatgagaagctcaattgcattttgcaatctccacctcttattttgagatcacatgcaatatttttccatttgttttaatttacacactattagttaattttaattaaaattgttttccggttttgttaaaagtttgtaccaacattcttttagctgaaattgtcctacccatttctatggcaactctgtcatcatttggtagtctgccttaagtgagtcaaggctcacattctttctcttcttggaggttcttctctctccttagattttgggttaattggttttcctgacactgcaactctttgatgcattcaagaaaagtagttacgattcagtagatcttctagccttttcttatggttggtgagcacagtgaccttatcagatttctgcattttaggtaaaaaccataaactctttaaactttaaactttaaactctgtaatgccaaatgtctttgtaaatagttatattttaccctcacatgtaaatgctaatttagccaagtacaaaatttgagattcaaaatgattttccctcagaatgatactgcttcattgtagcccagtaaccagtttcgataatgagaaatataatgacactaattcttgctctataagagatcagttgggtttgtttgttcagtgtttttttcagagagtttagaatttttctcacctatgttctgaaatctcacttgaaatatgtctaattgcttttatctcttgttactttttttttaaaaaaatgcttctctatacctgctgggtctcctcaatgcttcccttctgttctgatcaattttctcctgttaattctttgataattattttcctgtctctgttatttccttttatcactcttaattcactgatattaaaattttagggccttagtttcatgtcttaattctttatactatttttcatatatattaatgtatatgttaattttttaagttctgggagaattcctagttttactctttagctccattcattctgacattcggttctatctacattttttcctttcacacaattttcattacttattttggtttttccaattaatggggattcactttcatatatctaaggacattaattataatatttatgtgtttacttactctgtttcctcatgttctttgtgtgaggactttcatgatactagttttcctcaactgcttgccaattcttggcagtatataatttttgtatttgagaattcctgctgcctattctttgggtggtagttcaatatacctttcctgcctctgcaattatatgagcaccctgaatgtattaatgtattattatctggggattctgatagtttttattttgacagtgagggtttcttgcttcttctgagagtaattatctgggcccatttttatatttctctggtctcagtgcgtgcaccctatatttgttgtaggagaaaatatcactgctgcccactgctcagtacaagatgctatgtagtacagttgctcaaaatgcaattctgcagtgactcacctttcagattgcctcaaagctttcttgttgactcttactttgcatattccctggtaatttttctcaccatgaagaccatcttttcgtgcaaatgctttatactcctattttatgctgaatggtttttctccaaatctctttttgtttccatcagtttctcttattcctgaaatgatcaaaacaatcaatctgctaatggtactcttttgtgtttgtttttcacagttatcaataatttatattttataaattatactttgttctcattttatttgatttggggcatattgaaaaatacagattatgtacacagtctgcaaatttgaatcgatctcaaggtcctaaaaatatatttgacttatttagattaaaataggcccctttaatgtgaagtcaatctaagtacccatcaactaatgggtagataaagaaaatgtggtatatatacactttggaatactgttgagccattaaaaggaacaaaacaatgtattttgcagcaatgtggatggagctggaggacactattctaagtaaagtaacacatgagtggaaaaccacaaactgttctcacttataagtgggagctaagctttgaatacgcaaaggcatacagagtggtataatggactttagagactcggaaggagtagggtggaagagggaacggataaaaaactacacattagatacaatgtgcactacttgggtgataggtacactaaaatgtcagaattcatcactatataattcatccatgtaaccaaaaccacttgtacctaaaagctattgaaacaaaaataaatacatatgtacatacataaatacataaataaaataggctcttctaaaacactaaacttccttgttaaataaatcagttaatattgcaaaattcgattatacaggaaaaaaatctctatctattgatgattcttaatttatctagatttatagatatgtaattttaaaataaaatgtttgacctctttattttcatataatttttggtgttatgaagctttctgcttggctattagttctaaaaactaggatatatgatggatatccttatttaagttatgtcttgttagagagtctttgggaggacagaactccttctacttttgagagccacattttccctggctctaaagaataagatgactgtcgttttctcataaattgtaggtttttctacaaggctcattactgattcctttcagagctcattttcctacaaaatacataggagatctcagcgtcctaaaccagactaaacttttgaattgttgtgtgtagtagaccccaatacttgacaaattatccactccaattaactattaacgtaagttctttaatgtagagtctcagcatgtagcctgctaaatttttaaaaagagccagccacctttcctctccctaaactgtaaaacagagaacttaataggtaattctgtaacactttctgatagctttctccttaatgagctgctggcctgtgtctcagagtccacttccttaaatgagaagagcatggttttcatgtcaactattttaatattgacttcttttatactcattttgttaagaaatcaactgagtcaaatatgactacttatagtttttattgctttgcactaaccaataattatgtgtacaaaattgagcggtcaagaaatataagcttaacatagcccctcagctgtaaatgctttcatgaatactaaatcatataaaactatcttaattagtataggtagatgtgttctgcctgaccaggtcacaatttcaagtagcatgtactaaaactatgttttaattctccttttttagctcctttttaatggcttcctactaagttcaattaattggacacatgctgtcccggagtagcaaacttaaaaatatgtgtgtttttatgttgatgaaatgttttctctttagggtctaaaagttattaccagaggcaactggtcttgctgtctaaatagataagaattgcttactattaactatgctaaataataaccatcattcttaaaagttattctccaaaaatgaagcattcattttagtcatacatcagttctggagacaaacgtactggagacaaatgtacatagtccacagaagcctatgttgctatatctatgataggtaaatcgtaatatattttttgaaagagttgaggcccaaattaaatatgctgcagaactttgacatttctgagcatttatcactttatttgggggtagggtacctttccttttgatgtagtttcagatttacagaaatagtacaaagaactctcatatatccctagattcaccagttatttatattttctctatattctgtattactctctatgaagatatggatgtaatattttttctaaccatttgagaggatattggagacctttaagcctaaatattcatgtgcacttttgaagagtaaggacattattttacataaacacagagcaattccaaagttgggaaatttagatagcactatttttaatccccatattcaaattccataaactgtatcaataatattctttagagatattgtttcctgggtctaggatctaatctaggatcaggcattacatttacttaatttttttttttttttagttcctctaatctagaacactgttaacctatgcccatatgtctgcagtttctttttcttcaggtaaaatttccattcagtgaactacacatatttagagagttgacaaaggcctctatttcatataaatatatatatatatatcatatatatagtatatatatatatttcatatatatatagtgtgtatatatatctatatagtgtgtgtgtgtgtgtatatatatatatatatatatatatatatatatatatatatactttaagttctaggttacatgtgcagaacgtgcaggtttattacataggtatacacgtgccatggtggtttgctgcacccatcaacccatcatctacattaggtatttctcctaatgctctccctcccctagcccccaccccacaacaggccctggtgtgtgatgttccctctatttctataatcagcactactattaatatacaggacatctctgttctcctcaaaagtgggattacgtagtatatgctattttatgtttggcttttttagttcagcataatgactatgtgataatacatctgtgtctttgcatgtatctgttgttcataccttgtattacaaagcaataattaattatctatatatggcaaaaataacttattcctgtgttgacagctgtttagactgttacgaaaaagcttctttgtaactttttgtacaaattttattatatttggtgcatatgtattttcatatatatatttttagtaaatagaaacagaatcactatatcataaggtaaatatatgttcaattttactaaaacctggcaaaacctttttcaaagtggttgatccatattacatccctaccagctatgtgtgaaagttgccagttctaaagaacaggcaaaatggatcgatgtgaaaaaaaaaattagaaaatggattgtctcagggttgcgataatttcagagtgactaataaagtgaattttggacttaacttggagacctttatggcccatttttctcagataccacacctacttcttattaagaattccagtcagacttctcaactttcataatagatattccatccttcttttcacctctttgttttccaaagcttaagaactaccatatatatagattgctagcattttaaactcatgtgcaagattttatgagcaaactgtctgcttttcagtttttaatcacaaacttaactaagagaattgatattcaaggaagatggtctatttgaccaactattcatgtattactctaggaattctatgttatgtcctattatcaggtcacacagcccaaatgtcagttatctgtaacatgttattttgcatataaaaaatctatgttgctagattgcaattcaaaataaaagttcttattttttatttgcttgtttgacagttgaaattctattgatgtttataatgaaaatacttgcttttttctcctctctaggattctgattactatttcagttttattcatatatgccaactaaaggcatttctgaagtgaaatatcacagttttaaaccttcaaatacaagttaaaagaaaaatatccacaacaacaacaacaaaactcagctggcttattcagagtgcttttcagcaatttactcactttgggaatatctagttttctttgtggattaaacacgtctgacgtgactcactgctctaaaattcccagttttgaagtaatattttgttttatttgtcctaagagactgagggttaactgctttctcccatttagctcttaaaatgtatcagtttatttacagtatttaacatacatatattaggaccttcttattctataaaaatagaactacttgtttaattaaaccactaattgccttagccaaaggaaaacatcttactgaaataaatgatttgtcttggtaatagaagtgtcaaaagtgcaaatagatccctaattgctagataatttcccaacaattaattctgctgcttaagtattccccagctagctccatgttgcctctcattttagatcagcacatcaccatctcctgcttgattatttctttgcctccagtcttgcccactttatctacgctactacctttcatctttataaagtacagttacggccatgtcactctgctgtatgagacattccattgtcttccttctcataccactgtatagttcaaaataaagcctaacctctttatgttggcttaaaagcccttcataattcaagttatttctgtctcatctcttaccttcccctattttgcacccctactccatttataaccattttctagccttataaatgtccttctcttccatgtgaatctttgtgtatgccctcttttttttttaacctggaacactctacagcagcttttatacttcatgcacttaatgactactcttcctgtgatgtactactgagtagaggaaaaagttagagctatttttaattagtggtgaaggtaagcctctgacagcatgatattggattctgaagatgagaaaacagccttctaaggagaaatatgagtggtctagaaagggcagaagtcctgaactggggaagattatggcatatttgagtcatagaaaaaagtcagcatagctggagagcattggaatggagagagaggcagagtagagagaatgacagaagatgaaactggagaggtatatactgagtgcctaaatcatgtgtgatatcacagaccattccaaagaccttggattttagtctaagatcatttctaagccactaataagctttaatcaggcaaaaggcttaatctgaaaaaagttttgaagagattgctctgtttgtattgtaaacagtggatagaagtggaggagggtgaaattggcagctgagagatctgctagatctctctagcagtaggtggcatccaggaagaaaataatgatggcttgggtaggtgtaagcattgcacagggataaaagctactaatatataacttaggggatgagctaaacagaacttgctgaggaatagggagttgataaaaatcctcttatatttatgtagagaatttcagagattggaatttttcaagcgtgtttttttttttttttttttttttggtggtggttctctttttttccgcaacagtaacaatgcatcaacaaaaaattctgatagataccttaaacttaccacacacttattttgacagcttttcgtcttattttttagagtttagctgatctccttgataaacaagtttattcatggatggctgaaacatgcttattatttatatcaactaaataaagtggcctgcagtcgttgatcttgacaggacaatgcaatagctttcttgctgatgtgactcattattttctcttccaaactcaccctgtgaaccctatgcaccaccatcacaatttcctcaagaaccatttcaattaattttcttttctgcttaatatagtttttatagcccactatactcaggactaggtttatctttcaggcttcatttctcttttcttttcctcatgaatgcaatgtttcagctaaaaatagctagttagtattccttgaatcctccagaattttatcattattttgtctttactcttgcagtctttcacaggacatattaatatcgtatctctaaaacaaaattctactacccttagagcttggaatgagagtaatgcatagtagttaagaaaattagctttgcagttaaagaatcataggtgagaattctgcctctgtcacttaatagatgcgtgaccccagcaagttcttagcctaaggaccagtttccctttctctgagatggggaagatgagagtatctactttatgatgttgcactaaaaattaaataagatcttacctgcaacacattttataacattgtttgacataaattaagcaccgaacaaatgataggtatcaatatctttattaaggttcactttaaatgctatgactttatatgaaaaacccatggcatcagcttgaactatcaacttgaatgtgatgttatatattcccattgctgttatatatattatgagacatatatacataagcacaaacaatgtcttacatgttcattatcataaccaattgtctacatctgttgcatcattctttccacattctgctgtgcaataagattgtgtgtataccaaatatatgataattttttttgtcccatatccaattcttagataaagatttataccctcctttcacattgcttgtacctgtattagagttaagcctcagctctctgaactctacatgagagttaagcctcagctctctccaaccctgtcacagctatcggggacatggatggacccttggtgttagttgtttcaggtacattcttttcctccattacttagaaatcagagcctgagaatatgtcatcttgggcaatgttaacctagagcttggaatggccatgttcagatctaatgcattataaaatagaggaagttatgctagagagagagagagaaagagacagaagaatgatatagttgatcacagagaaggagagatgggagaccatgcagtcctttattgacagataaaataatttcaattcatagcttccttgttcctggtgtcagtccattttgcaatctagctacacttcctgccaggtcttttggtgaaatagcctatagtcttccatgaaattatcttcagttttagtagattttgttactaacacataaaccatctttgtaagaggccacatgcctatctccattcccttcaagcactgtagctgcatgaatatcttttccatcttcatctaggtcagtgcctaacacagagcagcagtaacaacctgatggcaataaattggttttaccattgctcacagtctagaatttaacacaatactattcaggcacaaaatcaagctgatttaaaagtaaatttaaattaattttctttgaaaacgttggtagtgttttataaaaatccttgagattttctctgagatcctgggctgggaattactatattaaaccaaagtgtagtaagtatcaaaactggctttacatatgagtgtgtctcatacatttggaaaaagccaagatgtttctggattgagatcttcttctagtaaataatagcttctttgaagctgtgttgtattccagacatttcacttattaaccaaggagaaggcagatatttgtatattgctggcatgaagacattctaaatttcacattctaaatctcaaatggatatttcaaagctttcatagttgtattttttgaaacttcaatttatgtagactagaaaatataactattttgaaatataatttaaaattattggtcctgtgaagatggcaatgtcgtgattccaagggagagtaatgatgtgttaaaaggtacacaaaaagttaatcagagaaaatagattgcagaggttaccagctagggctcaggagtcaagcagcttggacctcaaataaattctgtaaaattaattgctacttgtataattctgagcaagttatccaacatctcttagcctcagttttcttatcttaaacatcaggatgtagatgcaaatagtactcacagagtttgggaaaaattaaatcaagctatttaagcaaaagttttggcattatatctgacatgtgaaaatcttacaattcatgtgggctattggtggtatttcattgtagtaatcattatggacagattttcatctgattttacttttttcctggcttcaataagaattagatgaaaaagactataaaactgcatctgtgacaaaaattatatttataaattaattatgcataaacattgaaagggcaaactccaatattttaacagggatctttgttaataaagataagaaacattttcaattatttctgctggtacacatatattttccaaggctctactaaccaagacagacttaatttgccctcagcttaagtgaactttagacaggtttattccggactataggaccttgacttgacctccctttttagagcactttttaatgaaaacttttaattataaattatttatctgcctctttgaaatgtaaacattctataatccacaaatgtctttcccaaagtcctgggagtcatccctttgaaatataatcatggaaggacataggatcattgtctcccagtctctgtgggaccataggaacctaactttaataagcaacaattgacaagcacagatgacctaatctcactgatggacttctcccaaaacatcctccagtatttttccattagttcactcctgcctttaaaaattacctgccttagttcaatggggttgagttcaatttctctcccctatttcaatagtctctctcctttattgtaatagtcttgaatgaagccttccttgcttgtttaacttatctggtgcagttttgtcttttacattacaaggattatatctatggtaaaatagaagtgcagaggatgtgtgggtatgtgtgtgtatgtgtgtgtgtgtatgtgtgtgtctatctgtgtagacataagaaaatttttgttagctaaaaaagctaaagaggaactgaagttcaatgttgttaaagtgtttgtcttcaaacttatctcttaatagattacaatgattgtattttaggagaacctgctaaattcaaacagtcagctatgtcatggcagtatagtgtcagtcccagagacttagcagctaatagatttctttctaaagcacagacctcccatctaagtccaagtccccactggctactgatttatagagtagcatttggcaaaagacggtcttaatcttacctgggtctcattttcctgcttataaaagagaaaaaagaggttctgagaagaagtacaaaattcaaaattgaaaaaagaataaaatattttcacctagaaagattttctctcctttggtatgcaagacggacttgcattagagacagaatagcatggctggttagagccactctctaaagtgggctggctgcctggttatgcctttaagtgtctgtgcctccactgtgtaatgagaatgattctaacagcatttatgtcatagttttcttgtggagattaaagggattaatactaatagagaacttgcacttttaatgtgccttgtacatagtactttgaagtcatcctagctttatatgtttgctcttatatcattattattattaaatattttgatacacgttaaggagaaacagtggccaccagtcaatttgattttgaacatgaaagcagagtctgttatgattttcttttggcaaaattgtaggattttattataaccatgacaagatgagggtcacatgcacttctgagatcaagaaattactacatcatatagtttgaaagaaaaaatgtgttaacaaagtagaaaagaggctggtgtaattttgagtaggtagtgtctctgtcatagtgtccatttccaaggtaattaggtgttcttcctcaacatagtttgttgttgttgttgttgtttgtagcatgtcttttattaaatgactgcattataatttgaataacaaatttcctatagttgaaatattctggatagtttccaattttttatcattataataaatgtgataaacataaatgttatacatccacaagggaaataaaaacatataatgataaaatatcaatcttcagcagattattttgtaaattcttttttttccctatacttctggtattaatttttgaaagaggatattttttgatacacatatttatttgaagatccaatgacatttattcatccatagatttacatctatgtacattgaataaagatgtgtactttttatggtagccatttttattctgatactttgtaaagatactaaaggttagattgctttgtttaggaaaattaaaatgtatggctttctgaaattatcatttttaatagatgtaataattgtcccaattttgaattagtgtagttaatacagtttaggaattttgttttaaaatagactaaacaaaataagggatatataaagagcaccattaagtatcaccaaacagctgacttacccaaacagatttcatctccaagcacaatttgtatccaatcagcaaacaattcagagatcaaagaagatgatttttacctgaattacaaattacagttaattgcataatcatattaacgaaatatcttatcccattatcgttgtgtattcataatagttttctgagatttgaatgtgaaagcaggtcaaatacttcataaggaaggaaacagaaagaggcccatgatattttcacaaagtcaaggattccatgcatgaccgtgcctgtgtctcactctgctcttattaaaactcaacacctgcaatcattatttttgctttgacacataatattgaattttcaattttagttgcttaaaacattgtcatctcaactgatcgtgtcttttattttattttttctagaagtattgaaagctgtgaaattatgtgagtctggccttgagaagtaaaattttgggggccactgatactttagcactgagtttgatgaattctgctctatactcaaatatttccgaaggcaacaaaaacagcaaaagttatgtagttgactttctttgttaacttaagctaattttaggactgggtgtagggaagatacataaaaatgaatgaagaaaatacagtttatagaaatggttataacttgtatatcattccccaaaagaagcaatcacaggcaacttcagtagcggtttagaacacagatttaggaattatacagacattttgcccccaaacttagttccatcactattacaaggaacagccattgttcagatgtgtaatgataggtgagagatgcatttttagatgtggaactgcagaatgaggatgatgatacatatagaaatgtaattgctattgccaaattaccctctaaaaggactgcatgcatctgtttacactcccaagagtaaatgaatgtgcttgtttcttcatacactcaatgatactaggttgtataaaaacattatgacttagtttaatgagagaaaaacatgaagcctctaatgtttccattaaatttctttataagtaacattattttatttttaaaagtcagaataaatctaaggaaactttcttagtgcctctgcatttcaaactaaaagttttacataataaatatttgaagatataaagcacacaatgaaccatgcatagaatattagaaaaagtatagacataatccaaaatgtccttttaaaataatattttaaagtggttaattgcattcatgaaattattaagtcagttaaacactatccaagttttatataaacattctaaatttgcataaatgcacacatgtttatattctccttgaatttcatactttactggaaaatctgagaatggccaatattggaacaatgcagctcttcccacgtatttatgaaatatattgccacttaaattataaatttgattctagtggcaattcattcatttagagtatcttttcaagagattttgcattaactaaaagaaacagtatataaaatcttatttttgagcagtaagagctatatatgtaaagttttattcaaataattttaattttaaaaacaatacatttccagtcacgttatttgcctttacatgaggcactaattattgagaaaataactaatataaacttatagaaacatttgtttttatagttcagaaaatgagaaatttaaaaagaaattccactctgaaaatacaacccagtttatttaggaacacagataactcaagagttgatttaaaggaaaagatgcttgcacagccttgcctaataaccttttttcctcaagtatatactcagctaaaaccttagattcccaggttcttgcaattagtagggaggcatatgacaatagtttcccaaatgtgcttaataaatagagttgtacttttgaaaaacaaacacagaataaaagtatttttaaaagacttctgatcagtttcacttgcaagaaaaaaagtgagtcttctgagtatttttcaaatacaatgctccttactcttggaatatttgaacgctcttgacagaactatattttccttatttgtttgttctgcagtaccttcatgcaaaaataggtaaggcattagaaaagacgatgaatctctcaactgcctcatgctgttttctgtgagcaatactagtgaaatgcatgaaataagagatggttcattattttgagttctgaaaattagttgtgcatttaatagttctgtgagatcctattcagtgagaatattcagggcttgttttgataacaaagtcaaatttgattcagttagactcctgaaggaagttgggaatataaaggctaagtcaacatcctaataggaattcccagttattccctatatgcactggtatttttgcattctagagactcaaatatattactaacagttaaataatactgatatttttctgcaaatataattacctctttcttttaccaccatctgctcttctagttttccattcacatggatatcactcagggaaattctcccataaggtatacaaatgtggaactaaccacctccctcatcctgaactaacaagaacagggtgtttctctacccattgttggcaaacatcttggaaaggctcagatagtaaatattttcagttttgcagctcatacagttcctgtggcaaggattcaactctgccaatacagtctgaaagtagccttatgtaaaaaagtagaagtggctgtttttatatttatttacaaaaggaggctgaaggccagatttggcccatgggtcttagtttgctgactcctacctgtaacacaacatgcctaagaagaaactaatcctaaaacttcttttgagagaattagtaattttatttatttatttaacttttattttagaatcagggggtacatgtgcaggtttgctacataagtatattgcctgatactgaggtttaggtttctaatgatcccatcatccaagtagtgaacatagtacctgataggtagttatttaacccttgcccccttcccttccttccccactttgaaatcccagtgtctattgttcccatctctgtgtccatgtgtacccaatgtttagctcctgcttataagtgaaaacagaacatgtggtatttggctttctgtttctgcgttaattcacttaggatgagggcctccagctgcatccatgttgctgcaaagggcgtgatttcattcatttttatggctgtgtagtgagaattagtaatttttaactaaggatgtagagtaaaatgatctagaaacttatctgtattttatttggcagttcagtgacttaaactatgtggagaggagttttagattttaaagaagcaatatgcagaggccaggcatggtggctcatgcctgtaatcccagcactttgggaagccaaagcaggcagatcacaatgtcaggagttggagactagcctggccaatatggtaaaaccccatctctactaaaaatacaaaaattagtcgggtgtggtggcacacacctgtagtcccagctacttgggaggctgaggcagaagaatcgcttgaaccatgcaggcggaggttacaatgagccgagattgtgccactgcactccagcctgggctacagagtgagaccctgtctcaaaaaaaaaaaaaaaaaaaaaaaaaaaaaaaaaaaaaagaagcagtatgcttggttgaacactaacaactgtaacccttccttctggcatcatttaataattttagtagggcagacaatgctggtcacttaatcaatgtccattccactctctctcctcacggacaaaacacatatttattttgagggatggccatatagctggctaaaaacctggatgtctcacatttcttacttaaatatcaatagcaagtgaagttcttctaacaagtcgtgtgagagtggaagtctactcaggttgacttccaaagctgttgtttttaaggcaaaaaaaaaaaaaaagagtcagcttttgctctgagcccttcttcctgccttcatggaatgcagttctgatgcttgacatttctcaggcatattgtgaccttgaggataaagccacatgtttaagttggaggaaactgaaaactgggagaagactgagctgtggactcccttgaggaggtgtaagtatcatggtgtgattgaatatagattcttggttaggagtaaaagaaaccttatttgattaagccactgaagccaagattctgatatgtatagctcaactcaatactatctttagatttaaaatagtgtctctattttatataagatgaacatgatctaaaattcaattttacaccagagtctaatttcattaatttcatgtttctcttcctgcttctattttaatagttattttttcaaagagagttctatttcagaagatttaggtaggaaattaaggaaattgcaaaaaccctttcactgtgctaaggtgctcttactttgcaggtatgttcaaactaaatacttctgtctgcaatattctcagcagcaggcatcgctgaccctaaactagagtataaaagagtgggaggatgaaacagaaattgaaaaagctcttaaaaatcaataaaatgttaggttgtacaagatattgaaatacaagacattgctcttaagaaaacagctagatagctaggtcagagtgcagtaggtcaagtcctttttatgaactgagcagggaggttgtgaccatgaaggagctgcacagcagggaaagattgctgcagagcaggtaacagcctgccaaataaagacggcttcatgtcaggaaccacacaatcttctgggagagcagaggtttgctaaaggattctcttaagatttttttttttttaatttttggggcctagtgcaaatgcatttctttcccacaagaagcatgactaattctcctgatctttacaaataaataaataaagattcccttaagaccttggtcttgtccacacgtgacttgaagcaatagaggtagaaatgaacctcacacacaaaaaaatccttactgattctcttaactctacattataatgcttggaagtatttctgacagtcagagatttgagaaatttatttgagtactttgttttaaaataacgaatacttttcaaatattaactgtaaggaatttaaaaggtagattatatactagactatagagaatatacgtaacattcaaacactctccacttcgtctcaaagaaatggtgataattttgaaatgctgctgcatgagaaagtgtctgaatttttctgttctggaatctttcctttttttttctcacattgaatttattctccatggtatagactgtgatggaatgccaaattatttcttctgaagccttattagtaaatattagtctaatcaaatatttagtcaagacataatcttccattactgaatttttatttgttcattacagaagtgctggatatttccaaacctgaacacactctctgtagatacttcatgggaattaatattattgcactatcacatgtatgttcttatcatgctatgaacatggcaattaaaagccctgtgactactactactaactcagttggaaaagcaattatccacttactcatcaccaaggcacttcttaggaatgcatttcagaacaataatcaatagagatatttatgttgatatagtattggttatattcatgtctgatataatatgggttacaatgacactacaaagtttaactttggatatgccatgggtagaaattaaataaaccttgtaattaaaaccagataaaagttcatgctttgtaccacagctgacttggatcttggccacaatagctaaaagatgaaaggatctcggtaatgcctcagaggtagtgggaaactagagctacccatttgccatttaagaatttctcagatgatcctgagccttgaaaaggaatggtgtggcttgcctggggcacataccttcaacaccttaccatatgccactccctcagccagggaggtgactctagtccactctgagttataaagaattttttctttcacgcaccacattttcagcttctcctaaaatctagaaatatcctcaaactaacattaaaccaacagcggtgtctgtaggcctggctgtatcgctccagaacattgggctcagccagttaaactctgacaagcaatctttatgtcctgattgtccaagcacaaatggctgaccatcagcaattaaacatagcatccagcaattcacattctagcacatgtcgaacgaatcctccaggaattatcataaccaatttaactcaacacttccaaggaagaggattaagatgtgcacaccagagtaatttcttctcactcattcttttagcttgcttgtggcacaattggtccttagagcaagagtcacatcagagaaagtatgcttggatgcatttattccagcaatgtcaggaaactcatcctggttagtagcccaaactgtagcttctaacatgggagatcttttaaaaatactttagcccatttcactatgtgtttgtattgcaaccagaacacataaaaaataatggcatgcagctgggtgctgtgatgcatgcctgtagtcccagctactaggaaggctgaagaaggaagattgcctgaggccagcctgggtaacatagcaacaccttatcaagaaaagaaaaaaaaaaaaagataatgacatgcaaagaggcagaaaataaagaaagtcccattttaatcatgagaattcatctgggaaatagtagactttttaatagaatttaattattttattttgattgtagtgttattcaaattacaacttatcctgttctagattattgttagtgatctgtaaatgtcttccaaatcatttgataaaaacactttctaacagtgagctactgcttgatttcagaacaggctggacttttgaatccacaaaatgacactgttataaatgtccaggattctgcataaactctgcttatttttccttactcttaggaagattagatagtctgttttcaagtcacagtcctttttctggtctctcatttggtgtggatcaagtcacttaaccttctatgtgtttgtttcttcatctttaaaattaggttaataattttgaccttttgccttggcgttttactctgaactaaagaaaaacattaacacatggaaattatcctgggatctgtagatgaaatgtgcagagatggaaggagttattctatttaaaagaaaaaattagacatacttcagtgaattcacttcacatgtgtgttctgcttcagtgaagttgaaagaaagtggttactggaatagacagatgtttacatgcatgtttggactggtaagcaatgatattgaaaatattactattcctaacacatagagacttactggcctgatcaatttgattcttcacttatttattcacagctgaattctgcttgcagtacacatgcaaagcattcttgctggcaggtaggggaataaagattttttagtttgtgtttttaaaatgaactcaagaagaaaattaaattccagatacttcataaatatatttttacaaatatgtttctataaattttagtttacctcttgctgagagaaaatcaaatgcattgtgaaaagtggagaggatatgtgaagaccaccttccctttcttttccttgacctctgcaactgtcctttattgcattgtttttgatctgggtagaggttatggaaggtaactactctccagaactatgaagcctatctgctttgtcgtttctctttaagtccctttaaaaaaatctaaagacatgaattagatgcttggacatgtcttttactttacatacctctatttccctatttccctctaggaaatataagaaatccagtttttcccccttctgtgattaatataaattttgtgtagtattaatacccaacagcacaattcaaaaaaaatttatcaaagaaaaccctgataacaaatcacattttaattcaaattttataattttactctaaagtgacatgaaatcttggatttatggaaattatagatgtttggattaaacacataaattatttaagacaagaaagaccatttcttacataaaattgaccatagacaactgacaaccttaaattcttaggctcaaatctaaagtgtggcaaggtagaagtatgcccaacatacttcctttttttcgacttctcctttgcaaaaaaactacacctaccagtcatactgtccagatgaaagccactcagtctgctttcaataagaacatgaattaaatactctcaatggaatcccactgctggttgagtcaagcattctttgcacatcctgcttcacaaagttccacaaaatctgaccattccttatattttaacatgattataattcatacatactgagcatttgctacatatcaggtgctatgcaaacgatttacttttccaaacttaaataataatcccaagaattccacaaggtagacactgatagtttgctaagttacaaatgtgtaactaaatctagagaaaactgagtaactttgcaagaggctcaaggttagtaagtgacagaaacaaaatataaactcggatctgcctgatttgggatggttttcttaatacttacactgtcttgtctcctgtccaaataactctggaaattgttttattctccctgttgttagttgctactctctgtcttcctcacttccacttccagaaaacttcaagctcttaactgctctaacctgttcaccaagttcctactggtgaacaggtgtgtattagtccatcttgcattgctataaagaaatacctgaggctggataatttataaagaaaagaggtttaattggcttacagttctgcagactgcacaggaagtatgatgctggcatctgcttggcttctggggcagcctcaggaaacttacaatcattgtggaagacgaatggggagcaggcatgtcacatggtgagagcgagagcaaggcggggcggaggtgctacacacttttatacaatcatgtctcatgagaactcactcactatgatgaggacagcaccaagttgatggttctaagccattcatgaggaactgcccccatgatgcagtcacttcacacgaggccgcagctccaccactggggattataattcaacataagatttgggttgacatagatccaaaccatatcaaggtaagcaagtgattattgttctagtagtttttgaaaaagtttataaatgattatctataaattatacctctgcatttgattacagatgctaagtagtttaggaatctgaagttagtaagcttttctttttaaaatattgatacatccaagaagagaagataataattaaatatagcattgttttagttttgtgcttattatatattgttgatttttatattatatacattgattttattgattttagcagaaaatttagctctgatggagttttgtcatcttgatggtgaaaacagtctcatcatccttttaaatgagtcactgctaaaaaagtatctgaatagacacatggctctaaatacacacacacacaaacacacacacacacacaagctgatcatgtcaagttatttaaagtcagaagacttaccaattgatcctgcgctggcagaattttatcagtttggggaactaactggggcctgatcatcactggtaaaaatatgtgctatataatgataatttctttgtcttgtgaaaacactaaaattcctaggagaactggctaactcatatttattgtctgcattgtaggaattatgtagaaccagaaaataagaaatacctctgtacaattgtgtgtgtgtgtctgtgtatgcatgtgggtatcaccaaaaaatattaaaatattttccaaacaaaactaagcatgtgacttaatattaattctgttggtcttcatgcccattaagatgttcttaatcagtggatctctgtgttacaaaggtggttctggataggggttagcaagattaatatgttgaagggaaatataaaaatgaagctgtgttcttcctaacattatgaggaagcatacttgaaccctaataaaattctaaaagaattttcctcttttcagtttccctaaatgtactgctatctctgaccctcatcatcctggcatttaagtcacaatgctgacaaaatctaatcaggaaatggcaacctataaattttgtggaccaatgtaaaagggctccctttatcataatatgataatatcataatatcaaatatacccggggtccccaacccttgggccacaggcaagtacacacttttttggggagattgcaaaaataaagggaaaagccacaaacgcagaaaaaggaagggaaattaagatatgtaagctgagtcttccacttaggttatggaaaatcacaacaaaagatcacctctcatcacagcaagaacatgctagatgttctacaaaacctaaattttgtaaagaccatcagaaagctgaggttgtaatgtaaactaatgaaatgaaaggctaatgatggactagttgagaagaaatccttccacaggcaagtctgcactcatccacacaacccactcttttatgtggtctttacttaaaagagagctcatgaagattctgagcagcacggaggcatgaaaaagaccctttgtactgcaaacaggagaagtctgcctaagtttgagtgtgaaacaggaaaaacaaggaaaaccctcccacattctggattctgcatgagtttaaaggcaaagatcttttgtcacttaaagaggggccagcaaacactccctttactttcagcctagcagcaagtacagagaaatgttatctacaatggagggaggtcaggactattgagaaagcccaaccccagggcataggtatacagagactaagactaaggctgaaacaagagagccaaaagaagtcttcttatgatttagattctgcctgagagtgaggtaggaggtcattagccacagtgggagggacaagaattctatttgtattccagaacttgtacagagaagaagacaaaggttttctcctgcctatactcttgattataggttgaaccatgaggcagaagtcatctgttactaagtgaaggggtggaaaacatgcacatggtgtaaagtctgcaatgactaggaagaagtgtatgcttctgggaaaagagcagaaaaattgagagtgatttcctctggggtgtaggtgcagggtgagcctgcacccaatatgactaaatgcgaagcaaagaactggactaagtgagggctactgccaatgagcagttaactagagcttttctatgagagagaatatcaagtaaggaggaatattctaagacaaagcacctggctaagaagctggaaaagacagatggagtgataaagaaacggatgcattttgcaaagagcagctggctagagtagaggaaaggaactcagagttctgcaaggtcaccactcaacataattagaaagctgctgaagaggtggcaggaaagttcaagtgcataagtctcatccagtctttactgatccatatgccacaattctccagtattatcaccagaacaacccaaaactctcagctgctctgctctggccaaccagtatagacagagcatgcttgtgaagggaagataaaatgaacttttagagcatgcaaaatttcttcaacattaattcaagggatgcaacatattttttttcctagtaagaaaataacctatttgaagagaagagcatcaaaaagtattatgtagcagattcaacagaattatattacatcttaatcagcaacagtttaaaaagccaaggcctagatcagggatcagtcatcaaagaacactcttcaatattaataaacctcatttatggtgattaaaagagaaggacagctctctccacatttttgtatttttaacttaacttctactgattataaattatttctcttgtaattcagctccatcattcggtgaacctacattctagcaaatttggagtttgggtggcaggggctaataggaatggaaagaggaggaggcaaacaatcttggggcaacagtgctatgtggaattgtctagactgtggcatgttgattttctctcttttgcttttttcctttgattacttaagagctatctcattttaacttctaatagtgatcatgcaaacaaaaagacaaaaaggagaaaagatgtacctttttactggaatagtatttatgattaaaagtcaaacaaggcatttttgtcaatataaaggcaattttagccaggcacaatggcttacacctataatcccagcactttgagaggtcaaggtgggcagatcacctgaggtcaggagtttgagaccagactggccaacatggcgaaaccctgtgtctactgaaaatacaaaaattaaccgcgtgtggtggcgagcacctgtaatcccagctacctgggagactgaggcaggagaattgcttgaactcggaggcagaggttgcagtgacctgagatggtgccactgcattccagcctgggtgacagagcaagactccattgctgagaccagctcattcggagagactctaacccagcggcgctagaggaattaaagacacacgcacagaaatatagaggtgtgaagtgggaaatcaggggtctcacagccttcagagctgacagccccgaacagagatttacccacatatttattaacagcaaaccagtcattagcattgtttctatagatattaaattaactataagtattccttaagggaaacgaagggatgggccgacttaattgaagcaggaacacgcccttaagacacagatcgctcatgctaattgtctgtggcttaagaatgcctttaagtggttttccgccctgggcaggccaggtgttccttgccctcgttcctgtaaacccacaaccttccagcttgggcattagggccattatggacaggctatagtgctgcagagattttatttatggccagtcttggggccagtttatggccagatttgggggggcttgctcccaacactccatctcaaaaataaataattaattaattaattttaaaaaattaagggaattttggcttacacaacttctcctttaccataaatactgttatattcacgccattcactatcaataataaatgttttgtgatgaatattggcattgtaaaaccaaaaactcaaaaaccctcatccaaaaactttatgggcaactgaaaacccctcccatacatggaactgcacagagtaccaagaggcagctgtctgccgctggtagacaagagcactgagaaagatatagctctactcctgtgtccaagtcacaggtgcacagagcctgtttacgcgtgaaaacatacacattgaaacaaaacttcacacaaacacatactctaggacttttagcaagtactacacagtagcaatgtacttctgagatagaagaatactgatagaaagtacttctgtgatgcacgcacacagggccagctgaagtattagtgtagagaactaatgataaggtagtgtctatatgcaaatcaggtacttgaaggctgtggacactgatcttaaataaagcaacaaagaccaaatgcagctcaactagagattgagttagcccaacactcgtacttgagggctcacagaaaaagaagcatgtctgtttctgggtataaatattatatgcattaatctgtactgttcatctacaaacaatgttcagtatttaatttaaaaattatttggcacatataagtcaagaacatattgctcatcatcaagaggtataatagtcaatacaactagattcagaaatggggtggggggctaggggagggatagcattaggggaaatacctaatgtaggtgatgggttgatgggtgcagcaaaccaccatggcatgtgtatatctatgtaacaaaactacacattctgcacatgtaccccagaacttaaaatataaataaatgaataaataaaaacaaatagcctacatgttagaattatcagaaactttaacaaataataatatattaaaggatttagtggaaaaagtaatgatatacaacaaaaatgaaaaatttttaaagtactataaaaaagaataaataaaaatgctagaaactaaaaacatggtatcaaagataaagaatttttctgatagtcttatctgctgactagatataggagaggaaataatcaatgaacttgaatccatgcttataacctaactaaataaaaacacacacaaaaaaacagtgccaaataactgtaatggagcacttgtgatatttagcacagtataaaatcatttagcatatacactattggagtgcaagaaggataagagagcatgaggtagaaaaaaatggaaaagatactatttgaggatttaccaaaattaataaaagatacaaaactacagattccagaagctcagagtatccctaaaaggacagatataatgaaaaacatgccaaggtacaccatagtcaaacttataaaaaataaagagaaaatctttaatccaaccaaggggataaaaaagaaactttacatacaagaaagcaataataagaagatagcagacattttagaaaaagcatgcaactaaatgatgtttttaaagtgcttcaattaaaaaagaaactagaaatacatatccaaaaaatatgtttcctaaaaagtaggtaagatgaagaactcatacaaaaatgtataaataaaacaagacagagtaaatatgttaggaaatacaaaagttcctttaaaagtattcttaacatatgatttttgaatgcatcaagtaaaataataagaaatagtttaccatgtatactgaaatgaagtatatgacaccaaaacatgacatattgaagagtattagttgaaaatatacattaatattattttaaatggatcatattatagaattttaacataaactgtaataaatttatgatgcggccaggcacgttggctcacgcctgtaatcccagcactttgggaggctgaggcgggcggatcacgaggtcaggagatcgagactgtcctggctaacaagatgaaaccccgtctctactaaaaatacaaaaattagccaggcgtggtggcaggtgcctgtagtcccagctactcaggaggctgagacaggagaatggcatgaacccgagaggtggagctttcagtgagctgagattgcaccactgtactccagcttgggcaacagagcgagaccccatctcaaaaaataataataataataattttatgttacatattttaatgtctagtgcaactatgaaagtgacataggtagacgtaactaaataatcaatagaaaagataaaacagaattctacaaatgttagatctactaaaaagcatatagaaaaaagagaaaagagagaaaagagcagattcaccaagtatacagatggtattttaagtatacagatggtatacagaaatacaaacattgaaataattacattaaaggtaaataaatacctaaattaaaaggaaaaaaatcctgaatgaataaaaacacaagatccaaataaatggcttttaaaataaatacattttaaagacacaatctgttttaaattaaatgaataaaaaatgatataccataccaacactaagtaatagaaaagagatatgacagtactaatatcagacaaagtagacttcaaaggaaagagtattttgagatgaaaagtgggatatttcatagttataaaaagttaactaaataacaagatatagcaattctaaattcctgaatatgtatgcatctgatgcgaaagttctcaaaaacacgtagtaaagattgatggaaacaaagggaactatggaccaatcacaaaatgtaagtgcagaattttatatcttttcactagtaattgataaaacaagtaggcacaaatttccgtaaggtaatacatgatttaagcaaaactgttaaccgcttgacataatgatatttatagaacttgaaatacagcaaacagaataaatattttctgctttcaagtgcacatggtatatttgccaagatagaccataggctgagtcagtataaacgtttctacaactatcttaaaaacatttatgaaactgtccaagacctgacatcatgcagaatatgttctctgaccaaaattgtattaaaatagaaattagtaacaataagatatccagaaaatgtgtgaatatttagatgttattgaaagcatactactaaataatatctggttcctttaaaatattaataaaattaataatcactagaaagactggtgaataatatagaatacacagattgccaatatcaggtttaaatgaggtaacattgcattagatgcttcaaatatcaaaagaataaaaagaaaatttttggaacaatgttttgacaattaaaaagctaatttaaataaaatgtgaaacaatcttgaaagaaacacattaccaaaactcactcagaaaagaataaaaaatctattttgtcttatatatcttgcataaactgaattcatgatttaacaagttccgacaacaaccagaaaaaatactccaggaaaacatggcttcagtggtgactctagtattttaggaatatgtaatattaattgtatgcacagtcttttagaaaatagaggataaaacattctctaactcattttatgaggccattattaccatggtatttgttatagaccataagtttatgttccctcaaaccccaatataatagtattatgaagtaagtagactctttgggaggtgattggacatgagggcgtagccttcgtgagtgggattagtgcccttacaaataagacaagagagcttgcctcttctctctggcctaggccatgtgaggatataacaaaaagatgtccatctgcaaaccaggaagaatttcataactagacactggatctgtctgcaggcaacttgatcttgaacttcccagctttcagaactgttagaaataaatgtttgttagctaagccacccagtctgtggtattctattatagcaaactgaattgactaaaaccacactagaatgacacaagaactttgaaagataatacagaccaatatcacacatgaacatagatgcaaagttcataatgaatgttagcaaatcaaattcatcaatatttcaaaatgttaatataaaaaccaagcaatatttatcctatgaatgtgaagtttaacacaataaaatgcatagaagttattcactacataaagggaaattaataatgtgatccttttaatagatgcaaaaatgtatttaataatataacacacttgtatcataattatgttgcttagttttctttactatatggccatctacctttatcattaaaggataagaatgcaaggtattgttctaatcttacctatgttacctctttgtttattacctagactgtaaggtaataaagcagattcactctttaccacccgctttgcacaataccctatttgttttcccattattgtgtgtaaatgtgtaaagtagcatttttttctgaaatatgtatgccatgtgctgtctgttctcaataagagctgattcattacacaccctcaaagaacattttccttccaaatggattatgttctctttaaatggaggaaggttactgacaatcattgtatgtgccatggctgaagtaaatgagttcttgtcagaacaaggggagaaaaatagaaatttgggctaagccaaaacatgaggctggcaaaatttggcctctggattcttagaagtcctccccatctgtccagtgattgatagtcctcttttcatcatacaaagacacttttggaagggtcttttataagagatacaatcactttggtgtaacgttttccgtaagtattggatttgcaattagtattttgttgatgtttaatagcaagacgttgaaatattctataataattgtccattttttcctccatgcagtgggtatccattttcactttgtgtattttaatgctccatcatcattatgaagaaacctttcttattcctggtaaaatatctttgctctgagatctaatctgtcttacagtgatatggcccccctagctttcttttgacaagtgttgacataatatgtgttcttacattcttttcttttgactcattttgtcctcatttttaaaaaagcttgtttgtgtagtcaacagagttgacctcacgcttttatccaaatgaatactctctgtcttttaattttggtgtttagaccatttacatttaatatattattattatgtttaaattttatttattatcttgttatttattttataattgtccagtctaccttaccttcttacttttttttttttttttttgcattttcttgcactgagtacatttaatgattttcttttatctcctttgttgtcctcctggctaaaacactttatcattttaatggctgctgtagagttcatagtatatttttctttaacttacagaccagtttcaactgctattacatcctgataatatttgattggatacaaaatattaatttttctcatttctgttggctatttttttttgtattgcaatacatatcccagtgtttggtactatgattcagctagttatgtggagtcagttttatacttttatttcctgcttttatgatttttttaaagcaactccaaagtagtgctgaatctatgactaattatcctctactgatgcatgacttttctgaattatctattcaatatcctgtcatttttttccagttttgttagtgaaaacagccactattcctggctttatatgaatgctagacactgtttttcttaaactgtttcagatgatttttttttcctaaactggaacagtttcctcacagagatgcattgttcagtacactgaaaacttgcagcagatctctgggtttttttttctctacttaaacttgagcactcagcactgactaaaccaaatttgtggctagatgtctttaaacaaaatctcttcttccagttttctgtgttccttaaaaacattttaactttgcaaacttcctaaacacaattaatcttttaactattcctgtatatttccaaagcacattgtgtacacccttattaagaaactcaacactatcttacagaagtgtaagcacttgtctgtcttccttgaagggaaaaaaaaattgatttgttgatttgtacatttttacacttcatagtaagaataataaggattaacatagtagcaattaacaatatttgttgttagataaacaatacagaattctcaatcatttctgtaactcaaaaataaaagtatagtcctggaatctagaaggctaataaaagaaacagaggtaccccaaattttcaaacaggattccaaaaatgagtcaagtgtcaattgttgtgagtaaatgaatcaatttccttctctttattatacaagttttgtgtgctggtaatacctaatattaaataagtataatatggggtatttatattcagtactaacagagtattaaaaaaaccctctcctttttttccaaaatagcaattttctctctctgacacagttgtactatagtttatgtttgttcttaaatcatttaggacaatttccaaaaggtctttgcttgtaagacaaggcttcactctaagaaataggctttcaagtacatagggtccgaggaagtgagtagcagggtacgtagcaataaggattttataagcctttcttcctgtcttctgaccaaggctatccacgctttaatgctcagatcatctgttgtttataatttccagagaactattgatcttttttttctgataacatatagagcataattatatttcttgaaattttctatttttagaaggatttgaattatttgtcaaaaattgaattcaggttgagtccactgttctccctgtagctgtttctaattccgtgaggttcttgttctttgtgctgagaatattctctctttgaaagaccgatctgccttcttcttcaaatccttagcttagatgtagttatctcaccactgtctaccatgagcatgtttcatttaaagaatgaagctaatgaaaggttttggcccttgctctgcaagtgagtaacagtcggctccagtattattacgtcacatgataactatgtagttttctccatacctgggaaacatctcttatacttgatatgggaagtgaaaataatttcaacagatacagattttagactgtttaaaatcactttgtatgagttaagaggataatctttaaatacacttccaattcaggattaagccccaaacttcaagaggttcatttgattttggctgtttctcagttcattcaatatcattagctgtgcttagtggcagattcttaagaagaggtcttacttgcatgtaagtcaattgttttagagaaaatattaattaaaataagtggtgagtgaatttaaatcaagcagggccatgcctctattctgagtttaaatccctgactcatttttttctgtcttcctggatacaatatagaaatatgtatttgataaatatctccatccagaaaaatgaattcaaaatcacatttagagctttgaaccaaatctttcacagtaacagatgctctttcctgaaacaagcttattccacccagtgtatttaatagcatcacttttacaagtgaggggcaggtgggtggaagaacatgcatctcataacctgcctcccttcatactcattcatatattgcatgtttttcccatttgtgtttttataagcacacagattattatacttgcatagccagggtgataccagcgaggcctggggcccagctttgcagtgactgtgacaagcttggaaaaataacctggttgacaacacatttatctgctaaatgtgtcttggagcagagaatagcaacaatggagaagatacttttactctttctgcccagaaagtcacctctgcacttaggataaagaataataaggagccttgtggatggaaaagaatatattatttatttatagtacctttttggtttttcttctttttcaagagactgaaagaattaaagcaacgggaatttgctcgaaatgtagcttctaagtcatggaaagatgagaaaaaacaagaaaaagcacttaaacgacttcatcagctggctgagttaaggcagcaatctgaatggtaagaattaaaggtgtctgggatgcttcaaaactctcgtcaacctatggggaaattttaaaggcaaatctactgtaacaatgtaaacaaataataactaactaatagatatgtctgaagggcaaatatagttaaacatacataaattaataacttttggcctttgatatttttctttcctaatattgttaatttaatgtactctataatgaaatgatcccagaatgattcaaatacattagcatttattctatccagttgactaaatggattaatatcacttcttaatatattttttaaattttgtaataataattttaaaaaccataattaacaatatatcttagggggtggggaataagtcttctgaacatttccgtgtacacacctgtgtctagtacaaataacacgatcattgtctggctgacaaacaagatgtaattaatgcagttaaatttaccacacagtgccatttaaattgataattataatataacaagttttatactaatacattcttgtagctgaaaaatagcagttttaccaaagcttggaaccactggatgtttcaaagttgttacctggaatgcaattaaatttgtggattgtgatttgtgttcatatgaatcataatgtaaaacactaatgtagctaattaatgtgtttgacagcaacctagtgaattgtgaaacttatgcctctgtgccagaatttaaacacctattgcttaaatggaaagtaatatataataaacaggagtgagtggctcaattagttaccacaaaatattagacttaaaaggtaattttaaggaaacatttatttttgtaggaccaattatgagtaaaaatgcaattaatattcagcttgcatgtatttatttataacttttagaataatctaattaatttatgaaaatacataaaagataatcatattaacaagaaatgagaaatttcatatgaagacaaaataaaggtacaacatgtagccagaagtaaggttaatacaaaaatgcatgctctggggtcttatacaactctagaagcaacgcatacatttggtactgagctttctacagccaacacaatgagggacttacaatatgttgtgcaaacatactgttaatgagaactcagtccttgccaaaatagggcttagaaggaaaagttctattgttgttagggtagcatgcaggaaaaaatctagggaaagtgttaattcctgtgattaataaggagatgcagtaagtcagatcataacaaatggtacaagttctaacatagatatacgtctttagacaggtcccttaagggcacaacagtaaatctaaatagtcttaacaaatataattttggttgtttgttattatgaaagttgtcacacttctacatttctgcttacccattctatattttcctctggagtaaataacaaagaatcagaggtgccttgctgatggcagtggtcatggtgatggtgatgatgataatgatgctgatgatgataatgatgctgatgatgataatgatggtgatgatgatggtttatttagaagttccaagtttgctagagctacccattaagtttctttcaaataaaaaggtccactctattaagtttcagctgtccctctggaagccttattcactaaacaaacacaaacctaaccactccttttggtgatttgataaaataggcaaactctctaggtcacaatgtgcccgtattgttatggaaaagacaagtgttcagctttctagatatagagcctgaaactaggaaaataatttttttttatcgtctactgcccatcacctgcctcttagccaattgctctctctgcttaaacagactcatggttgaaggaaagtcacttaacagaattattaaatactttattttagtaggtgaattgacaagtgaaagttaaaaataaaataaaaagaaaaaatcactggcattacccttctcctggacaatcttttctttgtcctttttcctcataatgagggcttctgaataggatgatccaggtaacacaattcttctgtgaccctttgggagaagagaggtgaatttactggtagtgcataaaatgatggcaaaaaaatggtaacagatcttataaagggtcatcaaatttgaccgtctcttaactagttccagccaacctgtttcctcagcaatagcagttattatatggggctgagggtttagtccctctctgtatgtgaacttcttatgtatgtaagttttagtacatcttaatatggaaatttttccaaaatttaaaaattttagggccactgattctgagactatgaattttttaagtggtgtcatttcttaatgttccacgttatctagctcttatatgaagtttttcatataagagctggaaaatggaacacgaaagaatgacaccattttaaaaaatcatgttgttttgatatgtttttctttctgtttggtaaggatgctttttgaacaggagagaatcaaaatgtgcatttgttaagctgcagagtattagaatttttggagaacaatttgaatggaaaatccatcaataagaattaaaaaccaaactctacagacactttattaaccattattttaatataagtaagaatatattttcaaaactaaagaaagttccaaagaagtgagggaaatattaaatgtggagaaaactataaaaattgaagtttcattgagaatgcaactgtggtttcaaggggcgggctggtgggagaaatgtgaaggtattgttcaaagtttataaactttccgatgtaagatgaataagttttgaggatctaatgtagagcatgattatcttagctaataataccgtattgtttacttgaaatttgccaagagagtgaatctagtgcccttatctcacacaaaatggtaactacgtgtatgatagatgcacaaattaatttgtttgcatacatcaaatgatcacattgtataccttgaatatatacaatttttttccagttatatctcaataaacctagaaaaagttaaagctttaataatgttataatacccaaacttgtattaaaatagtagaatttaaaaccccacaaagataaaaacaggattttccaaaataataagaataactttgatttaagaaaaagcaaattaaaatttataaagcaacaagataaaaagtttaaagaataaaagtaagaagtgtcaaagattaacaataaggacaaaatgttaaaacttgtgaaaaatctgtaattataaatgcagtttaaattggaaaatgagaactagaattaaggacaagaagctagagaacattgtattagaaaaacaataagagcaaagaaattttaaaatatttaaaagaatgtaaaaagaagaagcttgcatattagagagctacatggtaaaataaaacagcagtacagaaaagaacatttagattaacataaagcaagaaaatgaataaaacagtgtcaggataatcagcaaaattattattaagaaaagtatatatataatatatttaacatgatataataaatactaaaataactgcataataatggaattgggaaaggaagaacaatagtatccatacactagacttgtggaataatttcaactgtgtttcatacaggtgataatgtcagatcgattgaagcttctggagaagattaacttaatccagaagtatagttcctacttaatccaaattgtggctacaaatatggaaaataatctctttggtaccaaggcaaagttgaatgctgcagctgtttctggatcacttccttctatctgcaggctggaggcactttcaaaggccaataatgttgtaataaagtctctacgctccttatttacttttatgcttgaaagaaacattcagtaactcatatactatcttagaatgctcctcactattcattttattaaatatgcctaatgaacatcaaaaatttactcaataaaaggagattaatgtgatgaataagaactttccgttatgaaagagttactgtaaggaagataatacagcttttaaaaacgtctaaatttagttttttacaagatttaaaggaactctgtaattctaaaattacagccattcatgaagaggagacgttctaaaatcattaaaagctaaatggtggctaaaattagtgtttgcaagttaaaatccatatggtcataatttgtaaacagattgaatattgtaaaaaaaactgagtcagtaaaatagaaataaaatcaaagaaattctccctgaactatagaaaaagactgaagacagaataaagtactgagataaatatcaatacctaaaggatatattcaggagagccaatgattttaaaacataaattccaaaggaagcaataatcagataaatcaagggaaaaaaatgtatctgaactgaagaaagttaaattgaaagtgcccaagaacaaaaattcacccaaattaatcaaccttaactatgttctattaaaatgttatacatacatatatgtatatattaatatacatgtatatatactctttatgtaacaaatctaatgaattatatatatttatatttttacactttataagaagggaaaagcatacaagcacacaagcagattcatctcaaagataaataaagggaagctaattcaatatgtctataatatgattcatctagagacaatgaagcaaagtacatgaaatttggtggacaaaaggaatgtgatgactctagagttcgatgctgatttgccaaagaatggtaaaagaaaccaacaagaatttgttagacaaggactcagaaagcactactctacattagaacttgagcaacatatggaagagataccagttggcttagtattttatattcaagcaacaaatgactagaggaaagtaaaataaaaatcaaaattagaaataagcaaacaaacacatccaagtatatggaacaagaaaaagaatgccagttcaaagcaaacaataagaaaaatgatgtgatttgtattgtcttctttccagtgaagccttcttttatagtagagggtatatagatagactgttaaagggcatataattttaatctaaagaattttatctcttatatatgttgatattttcaatcttctgtatgaattgctaatgaagctcagtagaacaaataaccttttgagacctttaaaagataaaacatataatgcagaaatggtagaaaaaatattttggtgagtaagaagcagaagaaaagatttcaaaatcattgaaggtatttagatagattgtacatatgtcttattttattatgcatttattataattagtcaaattactgacaagtcataaagaaagaacttaccactgtgtttcaaaagtaagtgaatatgagggaattttaaacccaaggagctaaacattataaaatgttagaaatagcacataaaagcaaatttaaaaaaatttttatatttttaaagtggcttttaattctatttaatttcttatttaatgtgaatgcactgattggaaaactattagtgaaatcatgttaaatctgtattccaaagattgatagattctataggacatatattgtgatgtaaatgctttagaagcagtagcataagataattcacttgctattgctttttggtaattgcaaaatactacatgtaaacaattcattttagaaatagccactatacaatttatgctaagctatataaggacaacaaaaggttatgttttagaagatgtagctcataaaatgtaaaataactcatcttagaaacactatgaaatgttcatatgtagatatgattccaaagctaatctcttaatcatttaaatatttattgtatttacagtgtttctggaaatggaccagcatacaaagcccccagggtagccatagaaaagcaactccagcaaggaattttccccattaagaatggcagaaaggtatcatgcatgaagagtgctcttctccttaaaggaaaaaatctccccagaatcatatccgataaacagcggtccaccatgccaaatcgacaccaattacaatcagacaggcgttgtttgtttggaaatcaggtactgcaaacatcttcagatctcagcaatgcaaatcacagaacaggagtatcatttactttttccaaaaaagtgcacctaaaattagaatcttcagcatcagttttcagtgagaacacagaagaaacccatgattgtaacaagtcacccatttataaaacaaaacaaactgcagataagtgcaagtgctgcaggtttgcaaataaagatacacaccttaccaaggaaaaagaggtaaatatctcaccaagccatctggaaagtgttttacacaataccatctccataaactctaaaattttgcaagacaaacacgactctattgatgagacactagaagattcaattggcattcatgcttcattctctaaatctaacattcatctttcagatgtagattttactcctaccagcagagaaaaagaaactagaaatacattgaagaacactttagaaaattgtgttaatcacccatgccaagcaaatgcttccttcagcccaccaaacatttacaaccatagtgatgccaggatatctgaatgcctggatgagttttcatcactggagccaagtgaacaaaagagtacagtgcatctgaatccaaattccagaatagagaacagagaaaaatctttagataaaacagaaagagttagcaaaaatgttcaaagacttgtaaaagaagcatgtacccataatgtggcatctaaaccactaccttttctccacgttcaaagcaaggatggccacaccactcttcaatggcctacggaacttctgctctttacaaaaacagaaccctgtatctcttatggctgcaacccactgtattttgattttaagctttctcggaacacaaaggaagaccacaatctagaggacttaaaaacagaattgggtaagaagcccttggaattgaagactaaaagagagagccaagtctcaggtttaactgaagaccaacaaaaattgatccaagaagattatcaatatccgaaaccaaagacgatgatagctaatccggattgggaaaaattccagaggaaatataatttggactacagtgattctgagccaaataagagtgaatatactttcagtgcaaatgatttggaaatgaaaaatcctaaagtgcctctttacctcaacacatctctaaaggattgtgctggaaagaataatagtagtgagaacaaacttaaggaagcttcaagggcccattggcaaggctgcagaaaggcagttctaaatgatatagatgaggacctatcttttccttcctacatctctaggtttaaaaagcataaattgattccctgcagtcctcatttggaatttgaagatgaaagacaattcaactgcaagtccagtccttgtacagtagggggtcacagtgaccatgggaaagacttcagtgtaattttgaagagtaaccacatcagcatgaccagcaaggtttccggatgtggaaaccaaagatacaagagatactctccacagtcatgtttgagtagatattcttcctctttggacacatcccctagcagcatgtctagcttgagaagtacttgttcaagtcatagattcaatggtaatagcagaggtaatttgctctgcttccataaaagagaacaccactcagttgaaaggcacaaacggaaatgtctaaagcacaactgcttctacttgtctgatgatataacaaagagcagccaaatgcagtctgaaccacagaaagagaggaactgcaaattgtgggaatcatttaaaaatgaaaaatactcaaaacgtagatattgtcactgcagagaaagacaaaaactgggcaaaaatcaacaacaattttcagggctaaaatctacgagaatcatctattgtgattctaactcacagatttcctgtactggaagcagtaaaaaaccacctaattgccagggaactcagcacgacagattggactcttactcaatagagaaaatgtattacttgaataaaagcaagagaaatcaagagtctttgggcagccctcacatttgtgatctgggaaaagtcaggcccatgaagtgtaactccgggaatatcagctgccttctaaagaactgttccagtggcccttcagaaaccacagaatcaaacactgcagaaggagagaggacccctctaacagcaaaaatccttttagaaagagtacaagccaagaaatgtcaagaacaatcaagtaatgttgagatctcttcaaacagttgtaaaagtgaattagaggctccttcgcaagtcccatgcacaattcaacttgcaccatcaggctgtaacagacaagcattgcctttgtctgaaaaaatacagtatgcaagtgagagcagaaatgatcaagacagtgcaattccaaggactacggagaaagacaaaagcaaaagttcacacacaaataattttacaattttagcagacactgattgtgataaccatctttctaaaggtataattcacctagtaacagagtctcagtcactaaacataaaaagggatgcaacaacaaaagaacaatcaaaacctttaattagtgaaatccaaccttttattcaaagctgtgacccagtaccaaatgaattccctggtgcttttccgtctaataaatatactggtgtgactgattcaacagagacccaagaagaccaaataaatctagacttacaggatgtaagcatgcatataaatcatgtagagggaaatataaactcttactatgacagaactatgcagaaacctgacaaagtcgaagacggattagaaatgtgtcataaatctatctctccccctttaattcaacagcccataacattttctcctgacgaaatagataaatataagatcctacagctacaagcccagcagcatatgcagaagcaactcctatcaaagcatcttcgagttttgcctgctgcagggcctactgccttctctccggcctcaaccgtacagacagttccagttcaccagcacacttctatcaccaccatccaccacacgttcctgcagcattttgctgtttctgcttccttaagttctcatagcagtcacctccctattgctcatctacatcctctttcacaggcacatttcagtcctatttcattttcgactctgactccaaccattatccctgcacaccccactttcttagcaggtcatcccctgcatttagtagctgctacccccttccacccatctcacataacacttcagcctctgccccctacagcatttattcctacattgtttggtcctcacttaaatccagccacaacttctatcatccacttgaatcctttaatccaaccagtattccaaggtcaagatttttgccatcattcttgctctagccagatgcaacagctaaatgaagtgaaagaggccttaaatgtgtccacacacttgaactaa

SEQ ID NO: 1568 - DNA, 887042 bp, Homo sapiens
ctgacaaggagtccatcctgaccatcctcaaggtcctcggagatctgctttctgttggtgagtaggccatgctctcatgctttcatatggcggatgtggagcctgctggctgtgatctctcccaggcacctctgtgacctgggggtttgctcttgcttcagtttcctgtgagaggcagcatcactagcccatcttttttctctaaggttaataagacccaagtaacctggactgtttgtacttgcactcctcagtcttctcacccgacactgaggaggaaattagatttagtagtaaccctccgtggttctacccctcttctcgccctgctcgcttccattgtgacctatttaagagagctgagtatcagaagctgctttggctatttgaagtagaggcaggaatatcaggcagaagctgaacttgaaagcatgtaagcatcacgttttcagagataagataacagagttgactacattggaatcaactggattaactggagcatgcttctattcgctcaagttcttactgagatttttgaacattccaacattcactcaatttgcatttttatgtatgcttgcctcattactttagaaagaaatattaacactgaacaggcaatatcagaaataaatgacactccagacccatagatcctcaggattatggtttcaagaggaaggggcccattgtattggggtctttccatggtttgtgctgcgttccactggcaggatgacttacatttagtctttcacgtggggcctgtgtaagtgaagtcactcgtcttctgggatagtgctgtcttacatttgtccagaggtgtctgaaactcttaagacaaaaccttgaagttctccctctgataaggtggtgattactttgcctcttgcagagaatgctacttttcattaggacaaaaaatcagatggtcgtctttgataatgtaccaccctgttggccaccttggttaagtcaactttgccccgtacatagagagaatcaaccaaggccaagttgtaatgaaatcgttgcttttgagtttgtccttgggcaaggtggaggaggtccctgttcaaaattgtacttaggtagaaagaccaatagttcgtcatagctctagactgtcttcaaaattccctagataggatgattggatgtttctttctcaagggactactgcagtggtttctgtaattttcttccatcaatttctgaaggctagcatcagaaaatcattatgccatcaatacaatgattccagattaggccatcatcccaatccttgttacagaagattcaaatgtatagcagagggatactgatattctctcttctaagtatatgattattcaaaagcccatatgcatatttacatacatgtacacacatgtatacatacatatactgaatattcaacagaatctcagataagctctatttattacagctgttgcagctgaacacaactaggttcttaaatattccactattttcctatttcacaaccctcttcccttaactgatagtacaactttaacacaggttgcttcaagaactacataattttacgtagttgaaatgaactaattcttgctctgtctctagttgggaggtctgtcttctgctccaaggaaaatggggattattacttgtggctcatctttcctccggtttcccctcaggcacagaccggagaattcactacatgatcagcaagggtggcagtgaagctcttctgcagaccctggtagacacagcgaggacagctcctccagactatgacatcctcctgcctctcttccggctgctggccaaagttggcctaagaggtactcgtactccaagacctaaagctgactgaaaaggcacttctagggttgttatcatgagtgcaatttgggaagctttggtggagtagcacagggagaaagcgtcagggaggttctggacaacttgatggtgatggcaggaccagccccataggagaggccattttgttgactttgatgtcagctcatccaaggtatggtgctcaggacagagcccagaacaaacatgggctacatggggcatggataatatgggggaaaggaggggagatactccaatgcagtttttaattattttaaaaataaatggaacatgtctaaaagttgcatcacaaggttgtggagaaaaaggaacacttatacactgttggtgggagtataagttagttccaccattgtggaaaacagtgtggtgattcctcaaagacctaaagacagaaataccattcgatccagcaatcccgttactgggtatatacccaaaggaatagaaataattctattataaagacacctgcatgcatttgttcattgcagcactattcataattacaaagacacggactcaacctaaacgcccatctagactggataaagaaaatgtggtacacatacaccatggaatactatacagccataaaaaagaatgagatcatgtcctttgcagggacatgggtggagctggaggccattatccttagcaaactaaagcagaaacagaaaaccaaatacctcatgctgtcacttacaagtgggagctaaatgatgagaacatatggacacacagaggggaacaacacacacttgggcctgtcagaggatggagggtaagaggagggagaggcttagaaaaaataactaattggtactaggcttaatacctggatgctgaaataatctgtacaacaaacccccatgacacaagtttacctatgtaacaaacctgcacatttacccttgaacttaaaataaaagttaaaaaaataaagtctataatataagtgtcctagtttcctagagctgccatacgaattgccacaaactgtttagcttaacgtaacagaagactgttaggaggtcagaagtccaaaatcaaggtgttggcagggttggttccttctggagtctctgagggagaatcggttccatgcccctctcctctgagggttgccagaaatccttggtgtttcttggactatagatgcatcactctgatctctgcctccatcttcacgtgctgttctcctctgtatcatttcctctttgtgtaaggacatcagtcataggatttagggcccactctaatttgtaataaaatctgcaaagattctgtttcccaaaagaataacattctgagcttctgggtggacatgaatttttgggggccactattcaatccactacaagtcacacagaagtggaacattcctagttgaagggaagatggaagaagggcctagagttctttccatttaggctccatagtcatttctctttcaccaaggaaaaccctgaaacatttccctaaaactctagaagttcttggagcacagtttaaaagcatgggcactcaggactcatgcagacattgcaaacgagtcacaagtgttaagttctaattgtgtgctgagtcttatataggtcacagctgagaagctcagatcctctgaaaagtgggcctttgatgtccagtgctatcagtggcagccaaatgcccagggggtctggagcactcttccttccaatatttggatctccacgctgagtccattcaacatgctgctgataatgatggagaactaggcttttgccaacacctgcatgagcgtgtcccagaaaaaatcaatacaattcgtttggtgaatattcaacagatatttactgcatgtctcctagggccaggtgctttaggcactaggaacaccatgatgaccaaggcagttaaggacctgctctcatggaacttatgttcaagtggagaaggccagcaaatcaacaaataacttgatgatagcagactatgatgagggctgtaagaggaagcaagagtgatgctactttagactggcatggtcaggagaggtgacattggagctaaaacttgaagaatgagaagtcagtaaagcaaagagtgagccaggtggactccaggaaaggaccacagagacttgatatatacctcggtcataaacggtataagctggagagtcagacatgggtttcaggcctggccctgacacttattagctgtgtgaccttgggcaaagtacttaaactttctgagctttgtgcccttatgtataaaatagagctatctgtatagttggtcttccatttctgtgggttctgcacccatggattcagttaaccttggattgaaaatatttttaaaaattttatctgtactaaacatgtacaaacttttttcttgtcattattccctaagcaatacagtttaacaatgatttacatagcatttacattagattaagtattatagtaatctagagatgatgtaaggtctgaggatgtgtgtagattatatgcaaatactacaccattttatatcagggacttgagcatctgtggattttggaatctgtgggaatcctggaaccaatcccacgtggacactgagggatgactctacttaattccagggtgctgtgaggattaaacaaagtattgcatgtcacatgcttatcatatgttcagtgccctggcaaactagggtcatacaggttttataggagaaagagagagatgagagatacaccaggccagtgatttccaagttattcaccttgatattactattgtagtgattacatcaccacagtttctgccatcaaggggttatagtccttgacactgacattcaagttgccatgggctgacctgaacagaacagaaatgaggttggctgctcatgaaggaatgggatagatatctcttttctgatgaagggaatgggttatgtaggtttagttacaacctctttgctggtgtcctttagtccagaggtacatatcagtaaacgaggtttaggattttatttctgttttactcatttctacctccgataaatctgatagtgatgtattcttgcaaaaagaaacaggatgatttagacatcacccattgacaggtatcatagtgggggcaaagaacagaaaataagtatttcttttttaatgcttattttctaattattaaaataatgaggactatttgtaacactagctgtcaggttatttggaacagtaatgtagaaatattagaggggaaatagggggcattccaagatggcccaataggaacagctccggtctgcagcaactagcgtgactgacgcagaagatgggtgattactgcatttccaactgaggtaccgggttcatctcactggtgctggttggatagtgggtgcagcccatggagggcaagctgaagcagggcagggcgtcgcctcacctgagaagaacaagaggttgggggatttccctgtcctaggtgagggaagccctgacagactacctggaaaaatgggggcactctcacttaaatactgcacttttcccaaggttagcaacctgcagacaatgtaattctctcctgtgcctggcttggcaggtcccacacccacggagccttgctcactgctagcacagcagtctgacatcaatctgtgaggcagcagcctggctgggggaagggtgtccgccattgctgaggcctgactaggtaaacaaagccgggaagctccaactgggtagagcccaccatagctcttcaaggcctactgcctctagactccacttctatcggcaaggcatagctgaacaaaaggcagcaaacaacttctgcagacttaaacatccctgtctgacaactctgaagagagcaatggttctcccagcacagtgtttgagctctgagaacagacagactgcctcctcaagtgtgtccctgacccccatgtagcctaactgggagacacctcccagtaggggccgactgacacctcatgtaggcagctgcccctctggaatgaagcttccagaggaaggatcaggcagcaatatttgctgttctgcagtatttgctgttctgcagcctctgctggtgatacccaggcaaacaaggtctggagtggaactccagcaaactccaacagacctgcagttgagggacctgactgtcaggaggaaagctaacaaacagaaaggaatagcattgatatcaacaaagatcatctacaccaaaacctcatctgtagatcaccaacgtcaaagaccaaaggtagataaaatcagaaagatggggagaaaccagagcagaaaagctgaaaattctaaaaatcagagcatctcttctcttccaaaggattgcagctccttgccagcaacagaacaaaattggatggagaatgactgatgagctgacagaaatgggcttcaaaaggtcggtaataacaaacttttctgaggtaaagaaggatgttcgaacccattgcaaggaagctaatcttgaaaaaagattaggcgaatggctaactagaataaacagtgtggaggagaccttaaatgacctgatggagctgaaaaacatggcacaagaacttcgtgacacatgcacaagcttcagtagccaattcgatcaagtggaagaaagggtatcagtgactgaagatcaaattaatgaaataaagtgagaagacaaggttagagaaaaaagagtaaaaagaaatgaacaaagcctccaagaaatatgggactatgtgaaaataccaaatctacatttgactggtgtacctgaaagtgatggggagaaaggaaccaagttggaaaccactcttcaggatattatccaggagaacttccccaacctagcaaggcaggccaacattcgaattcaggaaatacagagaacgccacaaagatactcctcgagaagagcaaccccaagacacataattgtcagattcaccaaggttgaaatgaaggaaaaagtgttaaggacagccagagagaaaggtcaagttacccacaaagggaagcccatcagactaacagcggatctcttggcagaaaccctacaagccagaagagagtgggggccaatattcaacattcttaaagaaaagaattttcaacccagaatttcatacccagccaaactatgcttcgtaagcaaaggagaaataaaatcttttacagacaagaaaatgctgagagattttgtctctaccaggcctgccttacaagagctcctgaaggaagcactaaacatggaaagaaacaaccactaccagccactgcaaaaacatgccaaattgtaaagaccgttgatgctaggaagaaactgcatcaattaacgggcaaaataaccagctgacatgataacgacaggatcaaatttacacataataatgttaaccttaaatgtaaatgggctgaatgctccaattaaaagacacagactggcaaattggataaagagtcaagatccatcagagtgccatattcaggagacccatctcacatgcaaagatgcacataggctcaaaataaagggatggaagaagatctaccaagcaaatggaaagcaaaaaaaagcaggggttgcagtcctagtctccaataaaacagactttaaaccaacaaagatgaaaagagacaaagaaggccattgcataatggtaaagggatcaattcaacaagaagagctaactctcctaaatatatatgcatccaatacaggagcacccagattcataaagcaagtccttagagacctacaagagacttagactcccacacaataataatgggagactttaacaccccattgtcaatattagacagatcaatgagacagaaggttaacaaagatatccaggacttgaactcagctctgcagcaagcagacctaatagacatctacagcactctccaccccaaatcaacagaatatatattcttctcagcaccacatcacatttattctaaaatagaccacataattggaagtaaagcactcctcagtcaatgtaaaagaacagaaatcacaacaaactgtctctcagaccacagtgtaatcaaattagaactcaggattaagaaactcactcaaaaccgcacaactacatggaaactgaacaacctgctcctgaataactactgggtacataacgaaatgaaggcagaaataaagatgttctttgaaaccaatgagaaaaaagacacaatgtaccagaatctctgggacacatttaaagcagtctgtagagggaaatttatagcactaaatgctcacaagagatagcaggaaagatctataatcaacaccctaacatcacaactaaaagaactagagaaacaagaacaaacaaatgcaaaagctagcataaggcaagaaataactaagatcagagcagaactgaaagagatagagacacaaaaaacccttcaaaaaatcaatgaatccaggacctgtttttttgaaaacatcaacaaaattgatagaccaccagcaaggctaatgaagaagaaaagaagaatcaaatagatgcaataaaaagtgataaaggggatatcaccaccaatcccacagaaacagaaactaccatcagagaatactataaacacctctacacaaataaactagaaaatctagaagaaatggataaattcctgggcacatacaccctcccaagactaaaccaggaagaagttgaatctctgaatagaccaataacaggctctgaaattgaagcaataaatagcctaccaccaaaaaaagtccaggtccagatggattcacagccaaattctaccagagatacaaagaggagcttgtaccattcgttctgaaactattccaatcaatacaaaaagaggcaatcctccctaactcattttatgaggccagcatcatcctgataccaaagtctggcagagacacaacaaaaagaattttagaacaatatccctgatgaacattgatgcaaaaatcctcaatgaaatactggcaaaccgaatccagcagcacatcaaaaagcttatctcaatgatagactggattaaaaaaatgtggcacatatacaccatggaatactatgcagccataaaaatgatgagttcatgtcctttgtagggacatggatgaaattggaaatcatcattctcagtaaactatcgcaagaacaaaaaaacaaacaccgcatattcttactcataggtgggaattgaacaatgagaacacatggacacaggaaggggaatatcacactctggggacagttgtggggtggggtgggggagggatagcattgggagatatacctaatgctagatgacaagttagtgggtgcagcgcaccagcatggcacgtgtatacatatgtaactaagctgcacattgtgcacaagtaccctaaaacttaaagtgtaattaaaaaaaaaaaaaaaaagcttatccaccacaatcaagtcagcttcatccctgggatgcaaggctggttcaccatacacaaatcaataaatgtaatccatcacataaacagaagcaaagacaaaaaccacatgattatctcaatagatgcagaaaaggccttcaacaaaattcagcccttcatgctaaaaactctcaataaactaggtattgatggaacatatctcaaaataatcagagctatttatgacaaacccacagccgatatcatactgaatgggaaaaaactggaaacattccctttgaaaaccagcacaagacgagtatgccctctctcaccactcctattcaacatagtgttggaagttctggccaggacaatcaggcaagagaaagaaataaagagtattcaattaggaaaagaggaagtcaaattgtccctgtttgcagatgacatgattgtatgtttagaaaaccctatcatctcagcccaaaatctccttaagctgataagcaacttcagcaaagtctcaggatacaaaatcaatgtgcaaaaatcacaagcgttcctatacaccattaacagagagccaaatcatgagtgaactcccattcacaattgctacaaagagaataaaatacctaggaatccaacttacaagggatgtgaaggacctcttcaaggagaactacaaatcactgctcagcgagataaaagaggacacaaacaaatggaagaacattccatgcttgtagatacgacaaatcaatatcgtgaaaatggccatactgcccgaagtaatttatagattcaatgccatccccatcaagctaccaatgactttcttcacagattggaaaaaactatttttaaatttcatatggaatcaaaaaagagcatgcattgccaagacaatcctaagcaaaaagaataaagctggagacatcatgctacctgacttcaaactatattacaaggctacagtaaccaaaacagcatggtactggtaccaaaacagatagactaatggaacagaacagaggactcagaaattacaccacacatctacaacgatctgatctgtgacaaacctgacaaaaacaagaaatggggaaaggattccctatttaataaatgttgctgggaaaactggccagcgatatgtagaaagctgaaactggatcccttccttaaaccttgtacaaaaattaattcaagatggattgaagacttaaatgttagacctaaaaccataaaaaccccagaagaaaacctaggcaataccattcaggacataggcacgggcaaggacttcatgactaaaacaccaaaagcaatggcaacaaaaaccaaaggaaacacatgggatctaattaaactaaagagcttctgcacagcaagagaaactaccatcagagtgaacaggcatcctacagaatgggagaaaaattttgcaatctacctatctgacaaagggctaatccaaagtctacaaagaactcaaacaaatttacaagagaaaaacaaccccatcaaaaagtgggcaaaggatatgaacagacatttcttaaaagaagacatttatgcagccaacagacatgtgaagaaaatgctcatcatcactggtcatcagagaaatgcaaatcaaaaccacaatgagataccatctcatgccaattagaatggtaatcattaaaaagtcaggaaacaacagatgctggggaggatgtggagaaataggaatgcttttacactgttggtgggagtgtaaattagttcaaccattgtggaagacagtgtggtgactcctcaaggatctagaactagaattaccatttgacccagcaatcccattactgagtatatacccaaaggattataaatcatgctactataaagatacatgcacacatatgtttattttggcactattcacaaaagcaaagacttggaaccaacccaaatgtccaacaatgatagactggattaagaaaatgtggcacatataccccatggaatactatgcagccataaaaaaggatgagtttatttcctttgcagggacatggatgaagctggaaaccatcattctcagcaaactgtcacaaggacagaaaaccaaacactgcatgctctcactcgtaggtgggaattgaacagagatcagttggatacagggcagtgaacatcacacaccggggcctgtcgtggggtggggggcagggggagggatagcattaggagaaatacctaatgtaaatgacgggttgatgggtgcagcaaaccaacacagcacatgtatacatatgtaacaaacctgcacgttgtgcacatgtcccctagaacttaaattattttttaaaaaagaaagaaacattagaggggataattttattttcttaacaatgtcttttgactttttattatgaaaactctctctcatgtagagagatggcctattatatacctaaaacttagttctaaccaatgttaacattttgccgtattttcttcacctatttatttttatctgaaatattttaagagaaattgcaggttagcattttcttcctaaatcctttcaagtgcatttctttgaaaagagacatttccctacataatcacaataccattattacaaacctaataaaattaaaaatacgtgtgtaatttatattcattccaatttctccaaatgttcccaactgtcttttatagacatagtcaaagcaagatccaatccaagttgacatactacatttgaatgttatattaagaattatattaatattaagaatattcaatattcttaattctagaatcgtcttaaaggaacaactttattcccaattgaactgtggttaatgtatgaggacaacctaaatataggggcttgagagttattcaacccacaagcttccatgtaaatatgtgtagcctgaattagctcttttgattcatttggttctagtggggacatatttagcagcatttgtcactaggtctgaaaaatgtctttggctatgattatcctcctccttcaccatcttccccttcctccactgtactcattgtacaatccagaatcaatgtgaagtgcaactaagatagattgatttgtgttcttagataaaaagattggacggaaggccctagaattggaagcacttgatgtgacattgattctggccaggaagaacctatcccatggccagaatctcctccactgtctctgggctctgcgtgtgtttgcctccagtggtaagtgactctattgtggctctcggggatggcttccaaacctgggctgggacacatggaaactgcatgagggtctggttggaagaaaagcatgggtgagagatacacatggtggtcccagccagataaataaaagagactgacaatccagaggctgtggaggtgagaagttacttcatcatcttctccttagctgggtagagctcttgagtctgctcctagagatggacttcaatattgtttctccttggcagttacacattacagcattgtaggcttttctattcgtactacaaggtaaaaaaaggtctgtgacaggagaagggcagactttatttagtccttgtcacattcaagtgttatatctgggcagaatgactctcacatcacaaatctccctaccatattcctgaaattactcattgattacaacatcccttaccatttaaaaaaacccatgatccttctcaacagggtcctccaggtaattattaggaacatcattgctcagttgatatttatttgctatctcttgatttgacttatttctaattatcatagtaattttgtatttagacccataattttatagttttgaaaaagaaactttaaagagtaaagcagggccaggcatggtggctcacgcctgtaatcccagcactttgggaggatgaggtggtcagatcgcttgagcccaggcatttgagaccagcttggtctctgctaaaaatacaaaaacttagctgggcatggtggcatgtgcctatagtcccagctacttggaaggctgaggaaggagaatcacttgagcccaggaagtcatggctgcagtgagcattgattgtgaccctgcactccagcctgggtgacagagtgagaccttgtcttaaaaaaataaaaaaagtgaagcgattgcttgaattcatacagataaaaagtcaggagggtggaatttctaactccagagctcattttaattctattccatatggaaactttttattaatacgttagatcctataccttctatctgatatgtaatgagcatagactttcatttctcctttccgagttcccttcctatgaaatgaaagtgacaattatttagaggttatatagttgataggggaaagaacgtgggcttagagccaaaaagacctgagtttgactgtggttctttttttaatgagtcataaagcatgaatacttaccctgttgaacctcagtttcatcctttacaaaattacagtagtaataatgattaccattactctgctagggctgccttaatgccttaacaaaatatcacagtctatgtggcttaaacaaaagaaatgtattttctcactttatttttttaatttttttttatttttttgagatgaagtctcactcttttgcctaggctggagtgcactggtgtgaccttagttcactgcaatctctgcctcccaggttcaagcaattctcttgtctcagcctcccgagtagctgggatcacagggacctgccatcatgcctggctaatttttatattttagtagggacagggtttcaccatgttggtcagactggtgtcgaactcctgatcacaggtgatctgcccatcttggcctcccaaattactggaattacaggcgtgagccaccatgccctttttttctcacatttttgaaggctacaatttggagctcaggatgtcggcagatttggtttctactggcccctctctttggcttccagatggctggctgctccctgtgtcctcacaaggtctttcttctatgcttgggcatccttgatgtttctttgtgtgtccaaattctcccttcttataaggacataagtccacattagactaggacccaccttaatggcctcattttaagttccctctctaaaggccctatctccagatacagtcctactccgaggtactgaagattagggcttcaatgtatgaatttaggagtggacacaactagccataatggagctcatagacttggtagatggggtgaatgggagaatgttcatgggcatgttcgtcacatggcaactgcttgataattgctagtttctcttccccgccctatgcttttcccttagtcttttgaaatagtagaatgagtacagatatggggagttaataggtgactttttatttctaattaccccaagaactactaaaatgcctgattttttttcttttctttcttttttcttttctttcttttttttttttttttagacagtctcgttctgtcacccaggctggaatgtagtggcatgatcttggctcactgcagcctctgcctcctgggttcaaatgattctcgtgccttagcctcccgactagctgggattacagttgtgcactactacacctggctaatttttgtatttttagtaaagacggagtttcaccatgttggccaggctggtcttgaactcctgacctcaggtgatccacccacctcagcctcccaaagtgctgagattataagtgtgagccactgtgcctggccacaataacctgattttcattggtaaattctcttaataaacatggaggattcataaaaagaaggtatttctgggggaataatgggatagatgcttgaatccttgttcacagatggagcctctactcacctatctcccgtatattgacctgaacaccagagagcattagggaaaggctgagtagatttgcatacacccatctctaataaaggaaaagaggaactgtggctttatataaaggacaactctcattaatgaatagacagaaggtgtgccacccacatttgcagtgtgccagcagagcgaaatttgaagcatttcctggtttcctaaagcataaataggctgaaaaacttgccttccttaaatataatggttatggagatttagaaaaattccttcagctgagttctgagaagtcctgggattttcctgtgggtatgaggaggtggctatctgattcatcttctaagcctacgttgattgtaccaactcactgttccataaggtatttaaaaaaattatactgtcactctccatacattcactttactgatgagaggtaagcagagttcaagaagcctgcggattactatcttttccgtcaattgttagccactgttgaatgttccagcaaagctttctaaacagctcctatcttcagaaggagttggctggaaccctaatgggtctgtgagagccaatgaaccctttggaagttctcagatggccaatgaggatgttcacagagctgccggagctctaacctcggacaggcatccacaaaagtgaactcagtgaggatttcttattgttatcctcttccaatttcaagcctaaaatcttccatgttagaatcagtgcttttaaaattaactcctcccttactcaataccagaattttttttaattacttgccaagagttttctctagtctgttttcccaattcggaagtaagagctgaatgagtagccacaagagtggaagattgatgggcaggactaggatgccaaatctctgaattttgatccaggcaattacttcatgtactagcctcaggagggacatatgcatggacgatgttccaggaacatgcactctgcaatagcaaagacatcagcctcagtctctatctgaaagactgtagtgagatgaggaagcttcagatttccatttagcttcctttcctgagggttggagcaattcagtatcatccacccttgtttccctctctttgcttctctaagacctcttgttcccactcacttttctcagatcaaggctagcctaaagcacaaggcattcataggtctttgtcttaaaaacacaagtccagtggaggaaagacagacgagagtgtctgtggactcctcttattttctgacatgagcagagctctacctaaagtgatctaagtggaatagggtactgggaatgttggagagacgctggggcatccttggagacaagagtaatatccaaaagttgtatttacctaaccagatacctctttggagtttctttctatcattcagatctatgaaaatgttttgataatcacccaattggccaaaaaggcaaaaacttcccagtctagttactgctgagcaggaagaactgattcttcatttgacattctagttgcggcacagtcaagtcattaccttagtcatgggagacccgagaatgacattatagaggaatgtgcaaccagggtggaaaagaaagggagctatcttgtttatcaagttgccccttaaagatttaaaggagtcaatccaagttgtcttgagccttaactcatccacttgtgaccataactactgtgcttttgtttttcttagtctccatgggagccatgctgggaattaatggagccatggaactgcttttcaaggttattactccttacacccgaaagcgcacccaagcaatcaggtacagagtgccatgtaatacttctgccccttttgtaacagatggagagatggagattgccctacatgtattttcatgatgcttccagctcagtttagtggtcatttctcctttggaaatatggtaccatgtctttatcctttctcagtttacatccctccacacccatgagtcatttcctctaattctcatcaaaaccctgaatgggtatattattattctctttttcagacgagcaagttaaaatatgtcgagagccttatccaaggtccctgtggtagcaaatagtagagttgagatttgattccagatctttcagactcgaaacctcatgttctttttgcctgaagccctcaggtatatactttttactcgcagcaaatctaccataaataaatataatcctcaaaagacatttcataaatgacagggtctctaaagagacagccagttaaacttctggcatgagttctgggccttataatagtccatcatggtcatgtgctagtcttgagatgtatttttatgattggaaaatgaaactcagcctgttctccctgcctctgcttgctggagtggagtgaatcatcaagttaaaaagggagatggttagacatgaaggctttagagatattcgggactattaagatctatcatttatgggagtgactcagcgaggaccttgaaagaatattagaagaaattcagccaatttccaagatagatgggatcatttggcaagtaacatttccatgcccaaccatgatattttctgcatctcagcgtcaatcttagcctcatattccacctgattatttttctcttgggtcactacagttatgccattatcatccattctcacctgcagctctctacaccaagcatttcgtagagtgaaatacattatatctcagtgaaaaaaaattctcatccagtaagttgagaaatactggattgaatgctggtttctttactgtaagacttctcagagcctttgtaaagccaatacatattgagaatatctgttatttagtataccctgatccaaaattgatttagtcagggaactgtggtttttttttttttttttttttgagatcaccttttttaggggaaggaggggtcagtgttctatgtctctcattttggaaacatcttctccagggtgtgaatttattgcaaggtggaattcaattaaattctgctaagaaccctcatctagtaggtaaaaaacttcaaaataaaaaactcagggaccaaaaaaatttattttctatgattatattttactctgtcttaaatttacatttatgtcagataacaagaaatataaaccagtgtcttatcaggaatctaagtcaaattagtgagtctttggttcatccagggatttcactcttctccccccacttcctggggtacatctgagttctaagaagccatggtagtgctggggtgttgatggaaaaacacagactgtcctcaatcatctcatgtccatttggacatatatatgacttggatatgtctcatttttatcattgtgtgcaggcctttgctgctgacatctgcagtctcaacatgttctttggttaccaatctatgaactttatctttctgccctattcacaaggcttcttctaatctgatgctgtcataattcagctgttcagaaggtcaggaatatctggtttcttcctttagattatgtgcaaatctttgtgatatttgctgggctcatccacatacgggtctcactcagtcttctcctctgccacttgggtaccatgttgtttggaaggctcccctaggaagctcttcccacatagccatgggtatcaaggcactaggtctcttccttctggggtgctcacatagcttttattgtcttcctcattcaggccaaacttgtggggtagcggggagaaatcaacaaagcatagaaacctcttcctcagagactcacactagttgccatttttaatgctttcttttcctcctgcaaagggagttgaattcaggcacagatctgatcaaagtgtcagaggcaagtgggaaagtaataccagggattaagggagtgagagtagggtgctcccaatcacaaaaggagccttccagggattccaggcatatttctacatgtctgatttgttttgtaaattttgggcaagatggttttccttcttcagtcaaatgccatattaaaaccaaacctctgtaggaaagaggcttttccaccaaccgttacaatatagctgtcattggcatggtgtttatgaggtgccctgcactgtgctaagctcttagcatgcattacttcctttgagcctctcatctgctctgcaaggcgggtgctattattgcccccaattttaccggaaaataaattgaaactgaaagaagttaagtaacatgctgggttttaagtgagagagctgggatttaaaccctgtctgatacatgagcctcagctcttaagccaccactggcgtatcttatacagtctatttccagcattttatttctacaaccatcatatgtaagacgatcatatgcagttaaagtttgcttaaatttcttttccatctaaatggcttatacccatggaacaatttgcttaatgatagaggagtcttactcctccatcagttggctatttcctctcaaaggctaaatatctattccctctgcttttgaattctttcccaaagctaccttgttttctatcttatccttactcatcaacagcaagataagaacaaaggtaatgaaattggaagacctgctctgtaagcctccttctaccagattccttggcgagtcatttaacttttcttaactaaactttgacatttcttaaagcatgaatgtcaagtcttacctcctaggtttattgtgggcaataacaaataatgtgtaaagacatcgtgtgctttgacatgctatgacattgttaatcattattaatacaaatactatgggatgtctggttgcctgctgcagatcagatggcagaggctggggaagagtctggagatgagaacgtcctgccaatttccatctttcacaaactccatcctgagaatagtaactaagacatacccaaatgaattctactcaagccatttggttgacagaacctgtgggctcaaggggggtcttgcagggaagggataaagtcgcatgtcagggggcatggatagctctactaagtatcatcctccaaatgctagcatgctatgggagagttattccgggatgcctttgtaggagcagatgcccagtgttgtgtcatgatgactcctccctcctgtggagattagacctgccctacttctctagcaggaacctaaaattagatgtgcagctgtcctccaatgaagctctgtctccagatagtactcagggcaagatttacaacagaagctccaaccacatacttgctagagagaagggacatgaagagcaatgtcactaaccctctgtggccttgtgccagccctcagcccagggcaggcagctatttcaggcctcctccacttcccaaatacccaccatgctgcacacacttgtgttggcttgtgccaacttccttccttcggctcctcatgagtcccatgctagtgggaacagttatggtcagacttaaactgctatgatagccctctagttggtctcacttcacttcaaagccatcaggaatgtgcctcagcttccctttccagagtggtttctcattcctgctctcatctcgctttccagccagctatctctgagtgtggcattccctcttcttccccaggtctctcccttcctctggaatgccatgctgccttgtgcagtggtagaagtcttacccagtctccagacttcactggatgccacctgctccatttcatcagagaaaaggaatctactctcctcaaacatcctccagagatttgttcagaccttctttcgacatgcattctattggactctgtactatattggcctgggtgtcttttctcctccctaaattctgtacttcctaaagtagaaatcaaattatatgtatcttgttattttccattcctcctagcccagcgcctagataataataggctcttaattaaattcaaacgaggctgagcatggtggctcatgtctgtaatctcagtgctttgggaggcaaaggcgggaggaccgcttgaggccaggagtttgcgaccagcttgggcaacgtaggcagaccctgtctctacaagaaattagttgggtgtggtggtgcacacctgtagtcccagctactcaggaggctgaggtgggagagttgcttgggcccaggagtttgagactacagtgagtcatgactatgccattgcatgccagcctgggggacaaattgagatcctgtcttaaaaataaataaatgagggctgggtattgtggctcatgcctgtaatcccagcactttgggaggctgaggtgggtgggtcacctaagatcaggagtttgagaccagcctggccaacgtgatgaaaccctatctctactaaaaatacaaaaattagctgggcatggtggtggattcctgtaatcccagctacctgggaggctgaggcaggagaatcactcaaacccaggaggtagaggttacagtgagccaagatcacaccactgcactccagcctgtgagacagagtgagattctgtctcaaaaaaaaatgaataaataaaattaaataaatacattgaaaagaaatattttaaaaaaaattattggtgaatttcctatgtagtaatgaatgaaagccagaatgtactgagtaggtgctatgctaggcacttcatatttgttaccttttttccccctgataccaggctggctgcacatgcagagttctgccccatccaaacatgtctgaaacatcagttggcacacctcccaagagctctattgcatgagggaatgaggtgccttctgggagagaactcattctgagagactgcgaagcagcagccaccagcttgaaagggagcaaagtttctctcactggagggaagaaaaaagttcagagtcttttagagttgtctgggggaaccgacagagattggagcagggaaagatctgaattggaggggcatgtggggacagcattcacattaaaactttgctgtctatttgaaataggcttctagtgtttggtctgttaatgaactcagctggggcttaaacttttctgggggtgctttttatagaagtagggaggaggaaatgacactgggccagagtgtgctacctcttgctcgtttgttccactgtggacaagcttgtttatctgcactaaagctgtctttgagctgtccaaactcactaagtagggaaatttattgaggcagacagattacttgtctgcgaatgactcatcttgtgaccttaggaaagcttgtgattactccacgtctcaacactttctgcgggaggctgtccctttgtgccgtcattcccaggatgggcctgaagattttgataataataaggaccatttccactggccacgtgcttgaccttttccaaagtacagccacatcccctctgatccttttggattctcacagtgtaatattgaacccaacctttggaactgggttatcagatgttgtcatcagtgtgtcttccaggattttaaactctgctggcttgccttgctttataagtatcatagccaattggaaatgggttggatcttcctagcagagaccaggtcttgaagcccattgtattctctgaccattgctccacacttccagaaagaggactcgggctgctcacaggctgggatagctccctcaccgctcaccttcattttctctggagctgccccaaggacacaggaagtcaggaagtgttttgctcaagaccatgctggtctcaccctcacagaggataacatctttagtatccccaccttcttaatgccctctcaggttttcagcaggaaggtcatgctatgatttatctctttaccctcagggtcagtctcatgttatgagattgtggaggtcggagtacctgggcttaaacaccttggcaacgggaggagatggatatgtttggtcttcaagcaagcttcataagcaaattcttcaccttagtctcctgttggctgtcctagtagctccttgtgcttggaatagtgttaggtgatattctccctccaaaggaccaatcttctagggcctccctggccttagaattctgcctgagtgcaggattactgggcattgctttattggcagccctttctggtgatttcatctgcaatttatgagctagaaaaaatgtcctgcttctcttctccctgcccccaaatcactcactgcctctgcccaaagccgggtcttctgggctttctccaaccatcactccattccactttatctgatcatagtaactgatagatgagtgagactcagccagagctaatggattccatgagatcatgagtgagtgggtgactcagctactcttcactgagacaatggagatccaagttagaagaaatggatttttttctgtttcttaaaatagttactgaattccccctgggttttaattccctcccagccccaactaacggcttcatgattccccattcaacattagagtctgtggtctccagggcatggcctcacagtggggcttcactctatgtctcagcactttctgcttgtaccttgtctccagagcactccaattcaaataccttggaacaggagcaaaaaaattccaccccagcctcacaagcgctgatattgggggcgtgcaccatgagctcaagttactagcagagttattattgcatctgcaacctgactccaagcctgtagctgatggggaatgaatagtttcttacatgaattaagccttggcaactagagttatagggttaaagccctttcatcttcttaagaagccactgagctcttcctgataagggcaagccatagatattcaagttgtaggatctaaagttcgaaggtcttaagggaccttcttatcatctccttcatcttaaaatgaggtcactgaaacccagagaggctgaaccaagccttctaccctaacttcaaggcaccatttattactccaagacacttttctgcatattacaaaacaaacatgctttgaattaggacttttatttgacaacattctatgtgcctgtctcaatgttaagtgctggagaaatgttgcttggggacctcaagttgccgacagcctatgccaacaagaatgatgtagtgtatgaggaaggccttgcattctgatccagtcttgggcttgtgaaatgaccagctccctatcctgtggaaatgcctttataatgcctttctcagaaaagcccacagagctgagcagacagggcctctgctttgggctctgggcctcaggcgaccctacactttggagagtcttccttgaaatgtctcaggtattcttttggtgcttgagaagggcttggtctggcagtgccatccaggggggctctagtccctgtttctcacctttgaggtgttctctaatcccctgtcacctgggtggtgaaccagattccttcaggaggaggagctcaggaactcatcctgcgtgtgggttgtcctgattcaggtgtgttggactggtgagcagatctttcccattgctggttctgtatttattcctgaggatgacatgctggacagtgagaagggtgcttgatatgttgatattggatggatcaaataagttacacagacaggcctccaaaaacaaaacaagacaaacctcccttggtccttcatatcctggggaggccttacatgcaccactttcccctgatgacggtcctctacagaaattgcatttccacctttatctgctgaagcttgtacagctcgtacctccctatagatttccctcagttttccctctagagactagaggcaggctctaggaactttcacttgccatagaagttaatcttcttgcccagcctgactcagtgaggagcttatgcaaagaaatttgtattttcctgtaaatcacaccttcctcacaacactgtaaccacctacaaatatggaggaaagggagtttgaggaacttgggggaggtatggaaagactcttatcaggagggactcttgtggtttcaccttttactttgagggaactgatatttcttttttacttttcttttttttttttttgagatcaagtctcactccgttgcccaggctggagtgcagtggcctgatcctggctcgctgcaacctccacctcctgggttcaagcgattgtcctgcctcagcctcccaagtagctgggattacaggtgcccaccatcatgcccagctaatttttatatttttagtagagatggggtttcaccatgttggccaggctgatcttgaactcctgacctcaggcagtccgcctacctcagcctcccaaagtgctgggattataggcgtgaaccgccatgcctggcccgggaactgatatttctaatagaattctaaattcttcagggatggattccacactcaggcaccataaattataaagcagatgggggaagaaaacacactctggttttcctgtggggttgtgagagggtgcagtgtctggagatgtgcttgtttagcagagacaagccaactcagttggctgggaaggaaagggtcaaaaggaggccatcacacaaatgtgtagccatggaaagctagctgcttttaagagtttaggcagagattgtaggatgaggacagattgaaagctttctgcctaagttcaattatagtgctattttaatattagctctctatgtgatcattagtcatcttcaacaaagctaatgagaaaaatgagtagagaacaataaatggttatttaaaaggagtgaattagtagagatcaggtctgagtttctttcatatggtgcatcataggtattcaataaatgccagttgaatgaatgaacactgttgttttggtttgcctgagttgtcctcttttaactatccattgattcattcagcagtattgtggggcttttattattgtcagagatttgtgggcattgagttgaaaagacacagtccttgccctcaaggattgtattgatacatgcacacattagcatgtaaacaaataagattaatgtgatcatgggggggatatttaagagggagggtttcagtctgctcaggaattagcaaggaggaactcactgagagggcagcttttgatttgaaatagggaaggaatttctggatgttaattttataagagcaccacgttctaggcagaggcagaagcaagagcaaagacaaaaaagcatgaaaacaatgagtgatatgtatcaagacaaaaaaattcctattccttaacccaatttttcttttcttaaactatgtcctaaaaattcactttgaaatgtgaactaagatttatgtgcaaaaatatcaatcacagtattatttataattggaaatattataacctgaaaaagctcaataatagggaatgcttggtaaaagtgatatgtttccatatcatattatgaagcaacacacaaaaataggttaggaacgatgtttgttgtgggaaacagcttatgataaaatattgactagaaaaagtaagtctcaaagttcagagtgatataatctacattcccagcagcatatgaatgtccatttaattgaatcctcaccaacaataaatattaccatttttctaaatttttattactttgatttctgagattgttgtcttgatctcaattgcatttctgtgattattggatagttgaatatttttaagagtttctctgttttttatttcctctttgtgaattacatattcccattcttctgttgtctactaagatattagtgttctcaccttaaaaaacaaactagagataaaatatataaaccaatgttgatggacattaggcaacgaagggcagtgattcctgagagataagcccttaaattcccccagctcattgtcttagagagtttctagattgcagtgcagggacaatgaactgacttgcagcccagcagactccctgagttaaagaaacagttgggagacagagctgaaggcctggagaaaccaaggtgcatagcatttgtaggacagagtcctagaaagaaagctgcacagaaggaaaactctggagatcttcagggattaccctcaggtatttagctggatatgcaagcgtacttatagggaaattagccaaagccaaggaaagaccacctgcaggaaatggagggaacaatatctgacacacacacaggactggaagtagtacttggttctgaaagacagactggaaaacctcatgactcatgggacattggataaagtacacaggatttttcctcagtagggaggaataaagtcatccctcgatattcatagaggataggttacaagacctcttgtagataccaaaatctgtggaggcccaagtccttcatataaaatattgcaatagtcgcatataacttatgcacttcctcctgtatacttttaaatctttaaattacttataatacctacaaatgtaaatgctatgtaaataagttgttagactgtattgtttagggaataatgacaaggaaaaatctgttcatattcagcacagatgcaatttttaaaaatatatttaatccacagttggttgaatccatgtgtgtggaacccatgaatacagagctgactgttgttacctctagactgagcgttagctgtagaccagggctctggtcctgccaaacaaatattaaaagcaaaaccttgaatcatagaactacttccaagtaaattagctgcatcccaagtcaaagcctcagaatatttattggaacacaaaaatattcagcactaagtgaggtaaaatcacaatgtgtagaatccaagaagaaattatcaggcatgcaaaggaacaagaaagcactacccatgaggaggagataatttattcaatcaaaaccagaactgagatagatgttataattattaggcaagaacattaaagagctattctaactatatttcacatgttcaaaaattaagtaatgacacagaagatataagaaaaacccaaattgaacctctggagatgaaatctacagtgtgtaggagaaaaacacactggattgaattaaagaaaattagatgtggcagaagagaagattagtttgaaaatacagaaacagaacatttccaaaatgaaacacacagagaagagatttgagaagaagagagcactagtgaactatgggacaacttcaagcagcccagtacatataatttgagccactggggagaggagaaataggtagggacagaaaaaaatatttgaggaaataaaggcttaaatctctgagatacaataaaaatgatagggacacaggaaaccatgtgcataagaaacatgaaaaaaacgacttcaaggaaaatcataattaaacttctcaaaaccagccaggtgtggtggcttatgcctgtaatcccagcactttgggaggctgagttgggcagattgcctgagctcaggagttcgagaccaccctgggcaacatggtgaaacccccctctctattaaaaatacaaaaattagctgggcatggtggctcatgcctgtaatcccagctactcaggaggctgaggcaggagaattgcttgaaccaggtggatgaatgttgcagtgagccgagatcacaccactgcactccagcctgggcgactgagcaagactctgtctccacaaaaacaaaaacaaacaaaaaactcaaaaccaatgacaaaaaaaaaaaaaatcttcaaagcacccaggaaaggaaaaaagatgcattatgtacacagaaacaaaaataagaatctaacagatttcttgttggaaacaatgcaagtgaaaaaacaatggtgcagcatttttgaagtatggaattctgtactcagtgaaaatagcttttaaaactgctgatgaaataaagacttttcggacatacaaaaactaaaagacatcatcaacagcagactctcacgccaagaaatattaaaagaaaactttaggcagaaggaaaatgatacgagtggaaagatgtatctattcaaaagaccaaggagcactagaaatggtaacatgagtaaatatatttgattttagattattattttagtctctttaaaaatagctaagtatttaaataaaggtaatctcaatgtagtctggagtttatattttttgtaaaattaaaatatatgacaacaagagcacaaagatcaggaagagagaaataaaagtattctattgtaagtgtcttatgtattaaatggtatattaacaattaaatgtagactatgataatttgaaaacgtacactaaagcaaccactaaaacagttaagagttacggctaatgagttgacaagaaggtaaattgttataaaaacattcaattcatccaaaagaagccaggaaaagagaaaaaggtagttgaaggacaggtgtcacaaatagacaaaaaattaacaggaatgtagacttaaacctaaccataactcctgagtggagttcctctccactcagatgtcaatgttgcatactctatgtaagggcaaatatataatcatattgataaacaagttactcaattctgctgcatataagaaccacaattcacaattgcaagaatatagaaccagcccaaatgcccaccaatcaacaaatggataaagaaattgtggtataaatataccgtgggataccacttagccataaaaagaaacaaaatagtggcattcacaacaacctagatgaaattggtgactattattctaagtgaagtaactcaagaataaaaaaccaaacatcttatgttctcactcgtaagtgggagccaagctgtgagtgtgcaaagtcataagaatgttaaaatggactttggagacttggggaaagggtgggaggagtgtaagggataaaagactacgcattgggtacagtgtgcagtgctcaggtgatggtgcaccaaaatctcagaaatcaccattaaagaacttattcatgtaatcatcacctgttctccaaaaacctattgaaataaaaaaattaaaattgtgctgcatataagaaacacacttaaaattttttattggtatatagtaattatacatgtttatagagcacatgtgatattttgatacattcacacaatgtgtaatgataaaatcagagtgtttaggatatccatcaccttgggcagttatcatttctttgtgttgggaatatttcaaatcttctagttattttgaaatagatatcgttgttacctatcatcacttcactatgctattgaacactggaatctattccttctatctaactgtgtttgtacccacattaaccgatttctcttctcccttccccactcccagcctctggtaactatcattcgactttcatccccatgagatcaactttttagctcagacatgtgactgagaaaaatgtgagtggtagttgtctgtgtctcgcttatttcacttaacataatgaccttcagatccatccatgttgctgcaaatgacaggatttcattcttgtttaatggtggactagtattccattatggatatagaccacatttaaaaaatccatttatctgttgataaacacttaggttgattccatatcttggctcttgcgaatagtgctgcaataaacatgggaagcaggtatctctttaatatactgatttcctttcttttggttaaatattcaatagcgtgattactggattgcatgatagtcctatttttagttttttttcaaaacctgcatattgttttctataatggctgtataaatttagattctgactaacaggctatacgagttcccttttctccacatccttgccagcatctgttatttttttgtctttttgataacagccattctaactaaagtaagatgatatctcattgcggttttgatttgtgttttcttggtgattcgtgatagtgagcattttttcatatatctgttggccacctgtatgtcttcttttgagaaatgtctatttagatcctttgcccactttattattatcattttctccatttaagctgttggcattcatcaatactctcagatgtctctaccaacataggcttcatcagaaacctttgtctactttttaatggaattatatgttttcttgctattgaattgggttccttgtatattctggttattagtcccccgccagagagtttgcaaatattttttttttcattcagcaggttgtctcttcattctgctgattgtttccttttctgtgcagaagctttttcgtttaatgtagtcccatttgtctgtttgtgtttttgttgcctgtgcttttgagatcttagccataaaatctttaaccagaccaaccttctgaagaatttctccagtgttttcttctagtagtttcatagttttgggttttatatttaagtctttaatccattctgtgttgatttttgtatgtgccgagaggtaggggtctagtttcactcttctgcatgtggatatccagttttcccatcatcatttattgaagagggtgtcctttccccaaaggatgttgttggtgcttttttcaaaaatcaattggctacaaataggtgaatatctttctgggttttctgttctgctgtgctggtctgtatgtctgtttctatgatagtaccatgctgatttggttgctatagctttgtattatattttgaaggcaggtagtgtaatgcctccagctttgttcattttgcttaggattgcttcggctattttgggtgttttgtggtttcatatgaattttggaggtttttctctatttctgtgaaggatgtcattggtattttgatgggggttgcattgaatctgtagattgctttggagtagtatagtctcaagattaattttaacaatatcaattctttcaatccatgagcatgggtgtctttccatttgtttgtgtccttttcaatttcttcatcagtgttttgtagttttccttctagaggtctttcacctattggttaaatttatttctaggcattttgttattttttgtagctattgtaaatgggattgcttttttgatttatttttcagctagtttcttattagtgatagaaatactactgatatttgttgattttgtatcctgagactttactgaattcagtgatcagttctaagagtttttttggtgtagtcttggtttttctaaatataataagatcacgttatataaaaagagagacaatttgactttctgttttccaatttaagtgccttttatttctttctcttgctagagattgttccggctagaactgtcagtactatgttgagtatgaatagtgatagtgggcattgttgtcttgttccagttctcagaggaaattctctcagcttttctccatttattatgatactagctgggtttgtcacatgtggcttttattatgtttcttatgttttattatgtttcttatgttttattatgtttcttatgttttattatgtttctactatgcctaatttgttaagagttttttatcatgaaggaatgttcaattttatgaaatgccttttctacatcttttgggaagactgtatggtttttatcttccattctgtttatatgatatgtcacagttattgatttgtatatgttgaaccatccttgcactcctgggttaaatcccccttgatcatggtatattatctttttgatgtgttgttggtttgctagtattttgtttgctatattttgttgaggacttttgcatctatgttcattagggatattgatctataggtttctttttttgttgtatccttgtttcgtttcagtattagggtaatgctggttttgtagaatgagttaggaagaattccctcctctttaattttttggagtaattctagaaaaattggtgttagtacttccttataagtttggtagaattcatcagtaaagtcatctggtcctgagtttttgttcttgttgttgttgttaggggactttttattactcattcaatcttgtactcattattattctgttcagatttcctatttcttcctggttcaatcttggtagattgtatgtatccagggattcatcattttcctctaggttttctgatttgctagcatatagttgttcataatagcatctaattattctttgtacttctgtggtatcaggagtaatacctcctgtgtcatttctgactttatttatttgggtcttctctcttttttgttagtcagttagcagtttattgattttatttattttttaaaaacttcatttcattgatcctttgtatttttttagtctctatttcatttagttctgctctgatctttattattcctttctttctactaattttgggtttggtttgttcttgcttttctagttccttgaggtgcatcactaaattgtttatttgaaattttctacttttttgacatagtcacttttttgctataaacttctcttagcaccacttttactgtattccacagattttggtatgttgtaattttactttcatttatttcaagaatttttaaatttccttctcagtgtcttccttgactcaatggccattcaagagcatgttgtttaatttcacgtatttccatatttccttttattattgagttctagttttattccactgtgatctgaaaagatacttgataggattttgatgcttaaaatttactgagattaattttgtggcctaacatatggtctgtcctggggaatgttccatgtgctgatgagaggaatgtgtattctgtagctgtttggtgaaatgttctgtaaatgttaggtctacgtgttctcaggtgcagtctaaatccaatgtttttttgctgattttctgtctagattatctgtccaatgctgaaagtgaggtgttgaattccccaactattattgaattggagtctatctctccagtaaggtcattggtgggtagagcaggttaatctccaagttccctgattgtgctagcatggggaatgatgccaggtgaggcagaactgtcctgaagcctgctgatggtgcacataagcacccaaactggcaagcattattgatgtgtaggtccctagatggtgtggtcatggtggtggcagtggtgaggacaggcttgtcttcaggccccaggaaggctcccagacagaccagactccaagcctgctgaaagcacatgcatgtgcagagtgtctgtgtctggggatgcaaggttgctgtcagtggcagcagccccagtcaggtggctctcaggttccggggagtgcatgcttcagctccctttgtcctggagaaagcttccctggtgcactgcactgccattcactagggtgtagaacaccgcgtgggctagagtgctggggacctggctgcaatgctgggtccagccagcctacttggtggacatgaggaaatatcagtggggctccatggatgtggaaattcaggggctgttgggccccagggcaggatatcatctggtggggcctgggctcttaaaatggctgtgtgctgcagctgcttgggtctggggagtgtgtgggatccagcctaaactacatctctggaacaatgtcatggtatgaactctaggcagcttcatatactagtttcagggcccatgagggctgaggggctctcctgtggctaggattgcaggagtctgtgggaatgtggagtcctggggatcctttgctcaccttttccctgcattatggagtttcttctgacacagagctgttcttaatcctggccaggctagatgcttagcttccctctccttccatgcctcagagattccctgggtgcctccaggtagccatcttgaagtctctccactcagagctgtgtataaacacattttaaatataaagacttgagtgggttaaaagtaaaaggatgaaaaagatataccaagctaatgataatcaaaagaaagctaggaagctttttctaatatcaaataaagtagctttcagagcatagcatattgccaggtataaaaaggtaattccgtaatagtaaagggtcagtttattaggaacaaacaaaagtcctaaatgtttacctaataacagagcttcaaaataattgacgtaaaaactgatagaactgcaaggaaaaatagatagatccatgactttagttggagattttaataaccctttctgaataattgatagaataagtagagagaaaatcagtaagaatatagatgatttaaataacactatcaatgaatgtggcttaactgatattcataggatactttacccacctacagcagactatacattcttttcaactgcaatggaatttttacaaagatagataatattatgaaccataaagccagtcacaatgaatttataagaattcaaatgatattgagtatgttctatgaccacaaggaaattaaattatcaacaacagaaaggtttctgtaagagtccccaaaatttgaaaattaaataatgtacttctaaaggaactataggtcaaagaagaaatcaaaagtgaaactagaaagtatcttgaactgaatgaaatgagtatagcatattaaaatctctgggatgccacattcttgggggaaatttatagaccagtaggcacatatcagaaaagaagaaagatggaatctctaatcaacaacctcagcttccaccataagaaaggataaaaagaagactgaaatataaagtaagtaaaatgaaggaaataagaaaaatcagaatagaaataaataaaattacaaatagaaaaacaataagcaattcaatcaaaagttggttctttgagatcaataaaattgataaaacttcattccaggctgggcatggtggttcacacctgtaatcccagcactttgggaggccaaggtgggcagatcacgaggtcagcagatcaagaccatcctggccaacgtgatgtaaccctgtctctactaaaaatacaaaaatttagttgggtgtggtggcacctgcccgtaatcccagctacgtgggaggctgaggcaggagaatcccttgaaccagggagttggaggttgcagtgagccaaggtcacaccactgcactccagcccgatgacagagcgagactctgccaaaacaaaacaaacaaacaaacaaaaaatccaatccagactgataagaaaaagagagaagacacaaatgaccagtatcagaaatgagaggcgaaattcctacaatttctgtagatatgcaaaggataacaaggaaatactacgaacaactttgtgccaataaattggacaacttagatgaaatggaaaaatttcttgagagacataactatcaaagctcacccaagaagaaaaagataacctatatagccctatatttggtaattgaattgaatgtatggttaaattatccccacaaagaaaagtctaggtttagataagttccctggcgaattctaccaaacatttaaaaataaataataaaaattctgtacaaactcttggagaaaatttaagaagagacaatattttctaacttattcaatgaagccagcgttaccctgataccaaaagcaggcaaagactttacaaagaaggaaaacttccaaccaatatctctcttttttaaaatattcatacaatggaattttattcagccatagaaaggaatgacattctgacacatgctacaacatgagtaaactttgcaaacatccctgactgacgaggggctcctgggctctcaatgcaatagaaattgacatggggccaaaggcttttcccagacaaagcatgcgaagggtagaggatataggttagcatcatctggttgtgatgattatcttgagtaatgggccacctggtggtctggccagcagcaacaaggctgtaaatcaattaattattcagcattccctcccaagatggggcactctgcaatcttgattccttattttggatctcctaaggccagttcctggaattgtttaagtaaaagacatggttaagcattatgagagcacagaagaacaatatagaaaggccattttctttgtatgactaaagcctcgaggttagcaggtatggtgttgacaccaatatcttttaagaacagagatgcaaatattcttaacccaattttagtaaattgttatcgacaatatatacaagatcaagatcaagtgatatttgttgcaagaatgcaagactagtttaacacgtgtagaaatcattatatatgattgattatataaaaaattaagaaaacccgacaatatatgattatctccatggacccagaaaaaacatttgacaagatctaccatttcccaataaaaagcgcaatacattagaaatagaagggaactttctcaataaatcacatctatgaaaactgttaagccacatcatacttcatggttaaaagactgaatgcttccccagtaagatcagaaaaaaaactagactgtctactgtcattaaatctatttaacattatactggcgattctagtcagtgaaataaggcaaggaaaagaactaaaagacatccatctgggtaaagaagatgtaaaactatttgcagatgattatctttgtagaaattccaacggaatctatacacaaaaaattacaagaactaataagtgagtttaccaaggttccaggatgcaagatcaacatacaaaaaatttatatttctacatagtgcaacaaattattggaaatacatcactgaaaatttttaataatatagtttacaatagcaatgtaaatgtaaaaacttagggataaatctgccaaaagatgtaaaagacctgtacactgcaagctacaaaacaatgttgaaacaaatgaaagaagacataaatagagagataactagaggtaatggttcagaagacttaatattggcaaaatgtcaattttccttaaattgatctatagattcgttgcactcccagtgaaaattgtgaaggctttctgtatgttgtggaaactgatacattgattataaaattcatatggaaagaccaaggacctagaatagccaaagcaaatttgaaaaaaaagaacaaaattggaggacaaagaatactttaagatttatcataaagctacagtatggaagatagtggggtatcagtgtcaagatagattaatggaacagtatagacacttcaaaaataaacccatgcatgaacaattaatttttggcacaggcaaatttcacggaggaataatagtatgttcaataaatggtgctggaaaatctggatattcatgtgcaaatgatagatttcagcttatactttacaacataaacaaagatgaatataaaatggaccatagacttaaatgtgcaacctacagctataacatttctggaagaaaacacagaggaaaacctttgtgatcttcagctaggcaaaaattatttatataacagcagtgaaaacacaatttataaacaattgataaactgtactttatcaatattaaaaacttctgtagctcaaaaggcattattaaaagaatgaagacacaggctacacactgggagacaatatttgccaatcatgtaccttgtaaaaaagttttattctgtatatacaaagaacagttaaaattaaataataaaaaagaacaatccaattaaaaatggacaaaagatttgaacagatatgtcactagagaagatatacagatagcaaatatgcacataaaatatgctcaacatcagaattaattagggaaattcatattaaaactgtaatatgatactactacttacttttagaatggttagaaattaaaagactgaccatcacaagaattggcaaagaagaacaccaacactcacactttgctggtgggaatggagaaatggtgcaaccactttggaaaacagtctggcagtttcttaaatattaaacacacacctatcatattgttcacacactcctcttctgggtattcatttacacaatagaaatgaaagcatatatccttacaaagactcatttacaaattttcattgcttcattatttatttgtaatagccgaaagctggaaacaatccttacatgtatcaagtggtgaataaactgtaatgttttcatacaatagaatattgttcaacaatacaaagagaaaattattgatatatgctgcaacatgaataaatctcaaaataattatgctgaatgaaagatgccagattaaaaagtatatactgtattataccattgtattaaattccagaaaatgtaaaataaactatggtgagaaaaggaagatgaatggctgtctggagatgggggttggaggtacatatggagtaggagggagggattataaagaagaatgaggaaaatttgaggaggatattgatattcattatctagattgtggtgatgtttcaaaggtacatacatgaaatctcatcaagttatacattttaaatgtgtataacttattgcatgccaataataagtcaatacatcagtcaaaaaactaaaaaagttcactttatattaaggaatatgcatagtaaaatctttaaagaaggataccaataactagttattttgaatggtggggggtaaatgatttattttttgtataacattagaaattacttttataattattaaaattaaatgaaaataatttcagtactatctagtcgaaaatatattctttttgattgtgtggctacaggcaaatgcattataactaacaacaccatcatcaataattagatcatgcattcattcattcaaaaaggaattgaggggagttttgacagatgaactagatttaactcatcagtgttggggatggaaaggaagtgaataaaatagagaagggttttttgagcatagaatgagagcattagcaaatgcacaaagcaagaaatggactggtttcggtgggacaaataattggttggatattaatataaggtaacatttgagacgagtggtaatgggagagaaaggcataaaccaattcaaggtcttgcctctatatcttgtccacttttgttctcccttgtttcctttttttctctctgctcctcttcctcccttcctctcttcttccctttctcttctctccctttgtcatcttaggttttttgcatgctagggaaattccttgtgtttgtttacaacctgaataattcaattttctgctacatcctatctgctgtttactgtctcccacaaagtatctaactatatatttctctctctctctatattcagttctttatattcttagatttatggtctcatgacagctttggtctagtgttatagacccaaatggcccctagaatattctcgagaatgcaaatcaagtacttccaaattaatttcctttttctaaattacatttactctctttcacaagaagttaccccttgaatattcaggaaattgattacctcctttttttgaactaaagaatagttttctttgctatttcagcattgcagaagcagagctgttctctcagtattagttttatttaataagtcacattggattatgctggagtttgatatagatctctcctcaaatattttataggaggatctctaagatcagaataaaagaagcaaaaggaaaccctagtagtacaattttagcagtttacatgtggcgtttgcagtttacagtttccttggagaagtagtgtagtggaacaggtctatacccatagcaagagatgttgttattttatttcagtatcactaatatgatgctccccattatggctaattctcatgtgtgtgtgtgattaagagcaaactttgagaagttctcatatgcaggtttactaaggaggaaggtaatcaaactcatgcttatccaaaagattcttacgtggttttgaccttgagttcttgtttctctgggataggggatttctccagtgtttactggtgcctctgtccgatctctggctatcagagagttctaaatattttactttggcatattccattcctgtttctcagaactgctaaaatttttgcagtttgaatatttttatgagactttctaaagggtaaataacacaatttttgactctatgacatatcagtaagttttttaattccatagaatctttaaatgccttatgcaaatgaaaaagtaaaaggtattcaatccaataccctcactttataaacagggataatgagtccaaaatagatgatttcctataatttacacaagtaaatagtgggtagaaaagctcagagaagactccaggtctcctgatgtcctatgcatatgtattttcaccacaccatgctgtagcatgatgagttttttcctcaaatttaaaaacagaaatgactaaatgactagaataaataaataaaacatgagcagtggacagttttactggagcccaagggctctaaagaggaaagagccagcctcagacctctgtttccttgaactaatttgtttttgaaaatggtccaccctaatcatagtaatcctcatcacacataataaaatcacattttatgtggtgtttcaggccaaatgaatcccccaaaaatgcttttcagagctaataccaaagtccctcaatcagatgatgccgttacgaaattaaataattaaactacagaactaaaatataaaagggtaagagggaacgtggaaaatgatcattctgaaacaagatcaagagtcaatgaggcagagaaacatgagtcagatccagatggcagccacccactaatcctcagcacactcgtgcctgcctgtcatctcttggtagccgtgggtgttacagctccagtttgccacagccacaagctggtgtacacattccttaagacagaaagagataaagtgttataatgtcttattgatagagatgtgatttccaagaaatgcaaagaaaattgcttttaaaaaatttaatttgctgatttttctctccattgttgggagaacccaaatattgacttcttaaattttgtttgtagtggagacaaatgttcattccaagtagcatcctagtagtagtctttttctcattagggttgcagtgaaggctgaaatgagttcattgagtaattagtcataaggtccatagtaattctgtctgttaaagcagaagtataagagtgtatattggagggcaattgttaaaaggcttttgattttccatggacttttatacacgatctattccttatttcttttttctttctttttttttttttttgtctcaagagggcaaacagcttaaaaatggagtcttaaaatcatttcctgaatttgaatgttggcctgcctggctaggttggggaagttctcctggataacatcctgcagagtgttttccaacttggttccattctccccgtcactttcaggtacacaaatcaaacgtagatttggtcttttcacatagtcccatatttcttggaggctttgttcatttcttttactcctttttctctaaccttgaaaatggccatactgcccaaggtaatttatagattcaatgccatcctcatcaagctaccaatgactttcttcacagaattggaaaaaactactttaaagttcatatggaaccaaaaaagagcccgcattgccaagacaatcctaagccaaaagaacagaactggaggcatcaagctacctgacttgaaactatactacaaggctacagccaaaattgacaaatgggatctaattaaagagcttctgcacagcaaaagaaactaccatcagagtgaacaggcaacctacagaatgggagaaaatgtttgcagtctactcatctgaaagggctaatatccaccatcacaaagaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatacaaatcaaaaccacaatgagataccatctcacaccagttagaatggcgatcattaaaaagtcagggaacaacaggtgctggagaggatgtggcaaaataagaacactcttacactgttggtggcactgtaaactagttcaaccattgtggaagatagtgtggtgattcctcaaggatctagaactagaaataccatttgacccagccatcccattactggatatatacccaaaggattataaatcatgctgctataaagacacatgcacacgtatgtttattgcggcactattcacaatagcaaagacttggaaccaacccaaatgtccatcaatgatagactggattaagaaaacgtgggacatatataccacggaatactatgcagccataaaaaaggatgacttcatgtcctttgtaaggacatggatgaagctggaaaccatcattctcagcaaactatctcaaggacaaaaaaccaaacactgcatgttcccgctcataggtgggaattgaacaatgagaacacttggacacacgaaggggaacatcacacactggggcctgtcgtggggtggggggctgggggagggatagcattaggagatatacctaatgtaaatgacgagttaatgggtgcagcacaccaacatggcacatgtatacatatgtaactaacctgcacgttgtgcacatgtaccctggaacttagagtataatttaaaaaaatcgtttccagtttcttaaaaaggggattctaaaataaaaattttttttctctctcaagttcagcttttgtttttgaaaattaccttttaagtagttcctatagggtgggatttcatcactagatctggtttatgggtgtccaaaacttgaacaattgaattcattcaaatctttgggagaaggtgtatttgctgtcccccaaaatgggtttgaaaatatcacgcgttctgttcttacttttaagtgagagctgaatgatgagaacacatggacacattgcggggaacaacaggcgctgggacttgcagggggcggggcatggggagggagggtatcaggataaatagctaatgtatgctggacttaatacctaggtgatgggttgatctgtgcagcacaggtttacctgtgtaacaaacctgcatatcttgcacatgtatcccggaacttaaaataaaagttgaagaaatcaaaaagagaaaatgttatgcattccaacacaagtctctggacctcacgtcctgatcagtaaacgtgaacaatggagaaatcaatgtcagtgtaaagattgtttgttcttttgtgctatggatgctccaggcctttcaagccaccatttcaagtgtagtgttaaacgtgagggcaaacctgctgcaggcctgtcaaaatgcttgctatgggagtgctgttttattctcgagagccaggctgacacggagccctctggctgccacaaaggcctcttgttggtaaatctcacagagggtatcattactttcaagaatttgatccatcgatatcaataaaaatggagcatcagttagcaaccccaaatgtgtcagctctttttatgtacattctcttatttaattttcacatcactgtgaagttggcttttatgctgctgttttacaaatgaggaaacagagcctgagagaaatttggtaacatgcacaaggtcataccagaaatgaagttcaagacaaaatgtgactctaaattccacactctcttcattatacaacacacactggtttttcaagtcatccagccccaggctatgcttatttccattaataatttgaggacattagtctattatttatactaacgttatagcaaacaaagttaaagcatttgtaactgcttcttcgtttttgtgtttaagcaaaaacatccaaactatgctgcaaacgcacacattggaatgaaaaccaacacacacccccatccacaaatcagttaacaagattgtacatagtatcagcaattaaaaaaggatatgggagaaggaaagacattgctttacattgttacaggctgatttctttacgaggttttttaaagcggaagatccctgcttcctttttcaaatgaattctaatgaaattccaaaatacaacacagataagagccgccttgttggaagctatagttaaaacttcagagttctgacttgaaacttctctgcctcatcaccttctctgggattccaggacttgaaagaagatgtattgaaagcccctcaaactattgaaaataacattaggtcagaagccatggatttgggttcaagagtgggctccctctctttcattgaccctaagcaactttcttaatgctgctgagcctcaatttttacaccttaaaaacaggtataatagtgcttgtcctatggagctgtggtgagattgaagtggtatgatgcatatcagggcccagaacaatggattgaatttaacaagttttaataatgaatactatccttcatccctcaagaggccttctctaaactgtccagatgatatacaggtcacatgtgactatgactttcactgctcaaccaatgcactatcccaaggtgtagcaaatcctgtcctttggttggcaaatatagctatctgtattgacatttgaagtcaacatcttccctaaggcttgctcaaaacgctgcttccttttacgttgctttatttccctgcaacctcaggcattcagggttggaaattaagcaaagcatcatccacatgcatttcttcaaggcatttctaatagatacagtacagaaaggcccagattaggaaaagatacaagtacttctaagataatttaaagttttttcgtctctcaaatgataccaatgcttaatagtagctactgaattagcttgggcacatggcatgaatgtgtacacagttatcatattgtttctgtgaatcttctgtgaaactgaggaagttacatttcctgattcagaggttgtaattaaaatactgtatggttgacaaaaaggggaaattttagtaactgatctgttggccccccacactatggagctgatcctgtcagttcttgttaatgatcatgctttctttagtactgagtaatgtgttaggaataaaaagtttcccccagctcttagatgtgaaaaaatgagtttgaaatcatcttctttatttctgtaaagattttaatggagctatagaaaacataaaaaaaaagactgttgataatcttgtccaaattcatattagactttgctcatctatctacagacttggcagacgtaactaatatagattttaacaaattctattcaggctataaactttctgctaaaggaaataaaaagatattacctgctaaatgtcctgcacatcttgaacacaacagtgctgaaaaggggtgtgatttgcttacttgtggatcgaggctttcataataaaagttcctggtcactttgaagtttcctcagaacatgcagaagcaattaacaacatgtttgactttataaaaatgggaagtgatagcttcttagacatgtgcctacaagatggtacatcttgatatactgttgctggccatagaaaagatttttaatctttggcctgcagtaaactattttcaaagtgtgagacaagaagaaatctcttgtaatttggaaatatgttgaggatgagaatgggggaaaaagagtactgtaaaacagatttatatgctgtttctctgaagctgtttgatctttgaagagacattaagtatcctagaaaaggatgaattaactgtacatgaatagttttaagttgtgacaattatatggaaaaaagcctcaatttttggaaataagacagcttcagaattgagaaaatgtcaatgaaaagggcaaccaaattaaacagaactttctcaatttccttactaaatttgtaatttatttagagtgcaatgttaatttcacaagtttagatgacttctgtgctttaaaaccattttccctggggtaggttaaacttcgtgttttaaaaccatgtccattttacatctggagaacttatgcacacatttaaagatgcaaaagacctgatggacaggcccaagctggtctgtggtaacaagcctgtagacacaaagtgggtggagatttggggatgaaaactaatcctacatatctaaaagcctgctgttgccagtaaataaaatattaagtattccattgttatagtttgatatttgacccctcgaaatctcatgttgaaatcggatccccagtgttggaggtggggcctggtaggaggcatttagattatgggggtggatccctcttgaacatcttggtgctctgctcatggtaacgagttggttctcattccattagttcccatgagagctggttgttaaaaagagcctggcacttccctcctctctctctctttctcttgctgcttctctcagcatggtgatctctgcacattctggctccccttcacctctgccatgagaggaagcttctggaagccctcaccagaagcagatgccggtgctgtgcttctgcagaaccatgagcaaaatcaacctcttttctgtgtaaattacccagtctcacgtcttcctttatagcaacacacaaataggctaagatgtagaagcgcaaatgcttttgtagagagcatgtatatcaccttgacattaccatgctggactgacaccaggtacccatgtaacataggctcaatgagagcagagctgcaagacaaagtaatgttacatttgctatatagttttgcctacataaaagaaggatgtcctaaagggtgcaggcatttgaaagaagtatcattagagaagtaaacagaaagattataattttcctatgtctcaaaggactaaaagaaacttgtttttcattgcatagtggtaataagacatttttaattagttctatttatgttctcttttttaaaagtattatgcaccttaaaaatacatattaatatagcatgatgaatatatagcatctctttaatatccaagagaatttaaaaagatttaaataaattgctctgttaaagaatagaaaaaattgatacaattatcattacatttttctcacatatatttgtttatacctactattaattactactaactaccacttttagtcttattttgttgtttaaatattagcatttatataatagaaagtaaatagtaagtaataatatatgatttcaagtaaacatctattcttcatattttatgttaaagtaataaaatgtctataattttttaaaaattattatttttgtctgtttggtacagccgtgtcttggattgactttctaaaatgttggcaattctccctaggtaaatgcatcataaccagctccaggcccacctgggttccctcctcctcttcctatagaatgcataaaagcagatataactgactcaggctgtgtaaagacaaacataacttacaatacccttacctccaaccgaacatctgaggggaagctaataaggtatcaaagaacatggacacagactaacagataatttaacgacatttatgtagaatgaataaaacacatagaaaggactgtcctagttaacatagaaggtaacaatgtaggggcaaaacccctctaaaagatataagcaagacggcgtacaaaagacatgaataatttaagctggggaaaacattacccaagaaacaaatgcaaatttcctacaactgctttgcagtgtagaagaatttcaggatatcatgaattcagtgactcaagatccaaagggtaggatgccaaaacaacagaatgagctggtaagaaagatgcctgaagaagacagaaactgagaacacaggccgggtgtggtggaacacgtctgtaatcccagcactttgggagactgaggcggggggatcacctgaggtcaggagtttgagtccagcctggcaacatggtgaaaccccccctccctactaaaaatacaaaaaaaattagctgggtgtggtggcaggcgcctgtaatcccagctacttgggaggctgaggcaggagaatcacttgaacctgggaggcggaggttgtggtgagccaagattgcaccattgcattccagcctgggcgacaggagcaaaactttgtctcaaaaaaaaaaaaaaaaaaaaaagagagagagagaaattaagagcacaaattctccttttaaatgaaattaacagaatagaagcagaatagatacagcaaaagagttaatttgtgacagagagagcaaaggcttgtaatgatagccctgaatgtagaagaaaaagtcaaagagattaatgcaactagaatgacaataatttataagaagccagggatgatgctgttatcaagaacaactggtctttctgaatagaaagagagagaatgccaaccgttgtgaatgacagaaaactctaccagagtggccttagaaatcctgggtcaggcatccttcacttgcctctgctgtaaatttttctgttatttttaaaatttatatatgttgggaaatcttcctccattattacctaatattgaggaagtaatttattttatttataataacatatgaacacatgggctgcgtgcagtaatcctagagctttaggaggccaaggcaggaagattgaggccaggagtatgagaccaagcctgggcaacatagaccctgtctcttaaaaaaaaaaaaacaaaaaaaaccaaaaaacacaaaaaacacaaaaattagctaggtgtaatggcatgtgcctgtagtaccagctacttaggaggctgaggttggagggtcgcttgagcccaagagttccaggctccagggagttgattgtgccactgtactctgtcctgggtggcagatggagatcctgtctctcccactcctgcacgcccccaatacacacacacccacacacatgcacgcatgcacgtgcacacacacacatgcacacacacacatatataaaaatacatgtacatttataatttataaatttataataaaatgcttttataattttatattaaaaatatagatcattttaatactgtatatataatttttacatataatggagcattttattatatatttatataaatatattacagatattaatgttttcaataatatatagtgaaatataaagtttataaacttatatagtttaaaacatgaatccaataatgcaatgtacatacatatgtgtatgtgcacatgtaaattttgtctatcacatgggccattctaaaaaaaatgataacctgacttgtatcgaggctgtgattaaacagatctggtcatacactaaagctgtctatgcacattgaaagctataaaagtgtttaactcctttgacccagaaatttcactattaaaattcttatttaaaaataaacatttatatgcatgggtatttgtgacaacattgtttctaatgctaaaagattagaaataacttaaaaattgaaccatagtgcctgttcatgaagtaggtagtggtatatatgaaaaatcaaatactattcagtcattaaaaatcagatgtcaggaaaaaatttggaattcataacacaatgctgaaaatataggtgaaaaatgcagatacaggttataaaactttgtatagtatgatcatgactatatggaaatatacacacatatataatcttatttagtgatctgtccattatgcatccattccatttatttctattgaaagcacacataagcaccaaaaagagattttaattttgtacttaatttatttcacatttttcagtcaaaaatatttttaaatattaaaaaaagtattttttagaaaaataaatataactgcagaaatgatagcaccttaatttattagtaaatgtgatcataccagatactgtgatgggtgtcaaaagaatctttgggaaccctcttcaccccagatgggaacagtttccttggttctgtttggagatgtcactgagaggagggtgaatttgccccttatttttgcccagcttccccaaagcattattttttccaagaaacgaaaggaccagatgaaatgctaatggacttgatagagtacaggcacaaagatggagaccaaagaatatgattatggaaatgggagcatgtggtcttttgggtgaagaatttttcacttctttggagactggaatgatgcaatagagcccatttatccatttttctaaattagaaggtggcaaactgaaggtgtcactctggcccacttgtgtctttttctgattttgaccccgcagcccacttgagatgaaaccacctctccactctttgtagctttggcttaatgtcaggcttggggtgcttgagacttgtacacaggcacagagtgggggactgcatctgtgagtctctcattcagggctctggaaagccttgaggagaagtggttggacattggaacaagggatcgtgtttcttaattcagtggagaagaccagtgtgtagagaatggtgtctgaagcattctctcaaggtgtcccctggagaaagtcactcctttagtcaaattttggaggctgttcaaaacctttgaattttggaatattttctacgtttattctaaccaacctcttgtcataaacacaaggctgtttgcattaaacaatcacactgattggaaatgacagagcctctctggcaagcccatcaggccaagagagaggcatagcagagtataaccggggtcagtttctgagtcctgtctctgaaaatgagactgccaggcatgaggcagaatctttgtagagtcatacattctcctgtgaggaattctgtcctgatacttgctcttgactttgccgttttttaatttcttcctttcactcgtactcacatcctgttggaacgactcattttgttctcgttctgctctgggattttcttcggagtgcaaacccagaagtacatctgcactttctcagcgaactcatcgtttggctgggctgctctataattagatttttcaaaaacctctctcctcgtatatcaattattccactcccttaatcatcttcctcagtgttttgcgtgatcctactcatttatcaagatgtctgggtctatgcttaagcatttgcaaagaaagagtgatgcctgctactagagtacagtgtctatgtggagggcgtcttgggatcttttctcccatgtctgttcttttgctttccactatccttgctagatcataacattactttcattttccaatccagaatgctgttccttttaatgtacttcaggatttccatgatgatggttttagaagtagagcattctggaaattgatgctctctgtgtttgtgtgtctgtgtactgggagacctaacttcctgaagcattcaccagttgtgtaacttattttcctacgataacctgggtgatagccaacaggcaagatatatcatgagataaattcctgaccccgtgttgggtagttagtataagagggaagatgggccagtactcaggcacagaacaggtaaccctctgttccaacaggagtgccagagtctgaaaatttacactatggtgatttaatcatagtcccaacctcatcaaactagacctgaataagctagcaaggtcttaggcaaaagacatatgtaaggaaagatatatatttctacaatttgtcatttaggtcttactgtagaacttgatacaaatatactgtctgacaagttctcttccacctgtagacactattttatgatgggtataaattcattcttttattatagtcactaagcatgagtgatttacttcttcaattgatctatgagggtttttaaatgccttattcactcatgtattcactttttcatcatgcatttattgagagcttactataggctgggtattttgtgggtgctggggaaggactgatgagtagaaaaagatatggtctctgtcctgagttttatagatctataggaaagacagatgttaatcataacatcccacaaatccttgtaaaatcatggcgatgataactcctagttgaagggtaccttggtgaagggcatgttgggggtgttctgactggctgaatttgcatatagtcatcctggactaaattagacacacacatacatgtgtgtccttggctgtaactgttctgaaggtgaggtcatgttgtagtgtttatttttcacagggtttggtagtttttattgcatttaacacacagttaacattattttgttaatcagattcagggaataaaaagctccccaaagtaatttttctatcaaaataatgcctagaaaataaaaaagattggatatctattacagcttcttaaaagtctgcaaatcatctggcttgctgggattcccatgtctttagattaaagtgagatttgactccaaatctggtgggaaatccagcatcctgtcactctcagtgttcaccaataaatgtccatatagcattttttattgaggacttttggcaaaacgtggtttaaatggcaactaaaccacagagcaggatagcaaaaatatagatactggctatgcaagattttaaaagtccctcaaatatttcctctcctgggggatttttgcttttttatttatttttttgtttaactcaaggtttgtcatttgcccatatttctaagtctatccaagctctgccgtgggggcgtctttcaacaactattctcttttgttgaggatcataagacttactgaggagaaaataaaaagatttcgtggtcaaataaatttggggagcttcagttcaaatgccataagacattttttaaaaaccataggatatctgatttttagcatactaatatatgttgtacatttttaagaaagtgattttttagtttttttcagagatctactttaaatatttcaaataaattatatcatttatgatgactttggccgcatgtagcatgcattctgacttaaatgatttaagcagaaagaaatcttatttcatgcaactgagttcagatgtaggatggacgtcagggttggttgattcagtggctcagtgatggcatcacaggcttagttttttccatcttcgcctctgccatactcagtgttgattgcatacctagtggtagagggagtgtcctgaaatctacaatagcaatatccttaagaagaggagtggccatttgttcctagagcccttaggtgtgaagaaacttgtctcagaatccccaaatgtactgtttctcatgtatctttggacagaattgggtattagccttattcctacatcaatcaacagcaaggagaaggggtgagctctcctttaagcacctggatacacatggggtgggtaatacctgcacaaaattggagggagttatgtgggattaagtgtcaagtagatcactaacaacgttttctaaagaaatacactgctatggactgaattgtgtcccaccaagtacatatgttgaagccctaacccccaatgttactgtattttaagatggggtctttaggagtaaagttaagtgaggtcataaggatgaaaccttaatcctataggactggtggtcttataagaagagaaagagattttcctttctctctttcctcctctccctgcatatgcgaatgtgcacatgtgcgcgcgcgcgcacacacacacacacacacacacacacacacacacacacacacacacgaaaggccatatgaggacatgctgagaaggcagctaaacgcaagccaggaaaagagaattcaccagaaaccaaccctgccagaccttctagcctctagaactgtgaaaaaacacatttctgttgcttaacccacccagtctctgacattttattatggcagcctgagctgacaaatacagattttggtattgagaagtggggtgctgctgtaacctaaaaatgcagaagcagctttggaactgggtaatgggtggaggctggaggagttttgaggtgcatgccagaaaacgcctaggttgctgtgaagggactgttggttgaaatatggacattaaaggcaattctggtgaggactgaaaaaggaaagaggagagacgcagagaaagcctccacctgcttacagaataagtgcagcgcgatggaaagaacgttggtagaagtaaggacatcaaaagccattctggcaaggaattagatggaaatgagaaacaagttattggaaactggaggaaaagccatcgttgttatgaagtggcaaataacttgggtgttctagtgttttgtggaaagtagaactggcaggcactaaaattggataattacctgaggcgatttctaagcaaaatgttgaagatgtggctatgttcttcctgaatgcttagagaaaattctagagaagaaagaaattgacaaaggaattgttaagcaaaaaggaactagagcttgaaaatttagtaaattctcagcctatccatgttgcaaaaagtgaggaagcatgttctaaagagaacactaagagtatggctggactattacttgataaagagataatgagattatatgggcagaaaacagcttggactgaagggaatagagcaaaaggaactaagtgaagaaagactgtcagattcttggatgcttcaggacagaacaacagagctatttcactgaaaacatgagctattctttaaaaaaaaaaaaggaaagactccaaagatgattcagagatgatcaaggctaccactcacatcacagcccagagtatacaggcccagggtgcaaggttgggtgaggtcactgccttggtttcaagaggccaagctatctcttcctggagtgttggggcaggatctctaactgacagagtcatgggggtgacagagcattgaactagaaaggattatgctccagccttaaaatctaacagaatttgccttgctaggtttggaacatgcttgggacttgtcatctctttctttggtctgatttctcacttttggaatgggaatgcctgtcttatacctgtcctaatattgtattttcaatgcacataagttttctggtctcatgagctcacagctatggagaaatttgcctgagaatagattgtattctgaatacaattgtattcgaccgtacttgacttagacaataattagatgagaatttggacttgagattttagtgctgatgctaaaatgaggtgagacttttgaagctgttgggatggagtggatgtactttgcaagagagaaagatattaatttcaaggggtcagaggcagaatgctagagccttaactgagtccccctgaaattcatatgttgatgccctaatccccaatgtgattgaatttggagacagagtctttaggaggtaattaggattaaattagatcataagggtgagatcttaatcctacaggactgatggcctcatgagaagaggaagattttctctctctctctctctctttctgtgtgtgtgtatgtgtgcatgtgttgagggagggccatgtaagaatatagtgagaaagtgctgtctgcaagccaagaagggcgcccttagcagaaactgaccctcccaggccttgatgtgggacttccagcctctagactggtgggaaaataaatttctattgcttaagccacctagtcttgatattttattattattgctgtagaagactaatacctatatcaatgtgataaaaattaaagtaaaacagaagtttctagaaaaaaatgagattcctctctctatgacaattctagccttgaagattgctgctaaaaataatttgtggtgtagttttctagtcgctttaatacttaccaaatgcacgcatatgtttgtgtatgtatacatacattaatcattatacatacatgctttgtttactttttatttttttaacattgatatttacttactgttatacaagttgtgtattaccatttaacaaaatacatagccctatctcattctttataaaggttatatagatagattgtgtagatgtattataattctttcaaccacttcagtatgggagaatgttgcgtgaagtggtttccacacttatctgaacatgaaacatctcatattatatatatatctccaaaatatataattttggacctgctattctagaacttcaggttgtctgtgtctgtttgttgccttaaaagaagatgtaacttcctgaggctctcaagacatttggccatttggccatggcaaaatgtaattggctaatagttctcaaaagccatgataatatagggcactaatgaatacccatgtgctggatggtccccgtctggtcctcgtgcacctgaagtgctaacttcccattctttaggggaccaagtactttgttctttcatttgtgacactgaactgttacggaaattgtgacattactcagcagctgacttatttcatcttggatgaactctccttctagctacgtggcttgaattgagtaaatctgactaatgaatcaacaggcaggattttggcaacatgaaagattctggcctccataaaagtttttaaaatttgcgtagtgtttataaggaaaattatttctcataatttatattacttgaatctaattttatgtatcaacaaatactctgaaagtgacaaaaagtcaccttagtcaagccatttaatccctaaagccatccaatcctattaatggggttgtgaagataaacatgggtgattctaacatgcctgtgagtttgcacaactgtcctgtttgcaagagccaaggtattcttgtgtttaccattggggattgaattgatttacaacataaagattattctgaaaatccaatttccatgcaaacgctgttaattgttatacacgtgtctcagtttgttgactcagttgtttgaaggtccagagctgtattttggaagatttgtcaatttaattttttaaaattatgacaatttaatttttcttttattcatatttaaagcctcatttaggcttggatttattttaggtgacagcacatatacataaaaaaagaaaaagaaccagtgtcattaaattgatggatcagagacttaaaatttttttagtgagcttcctttcctgatttcaacaaattataagaaagaagatctttcccaagtccacttaatctttagcacctcatttatgccatctatggcatttttctgtacaacagtgacttacaaattatcacagatttcagatactggaagctgagatgtttcccatgctttattgtttaaaggtgtttattttatagcactttttagttgcattatatcctactctagagtaatagacccctaccccccccccccttttttttttgctcccatcatggtgttgttttaagcaatcatgaatcctttttctttttctttttttttttgagatggagtctcgctcttgtcacccaggctggagtgcaatggcgcgatctcggctcactgcaacctctgcctcccaggttcaagcaattctcctgcttcagccgcctgagtaactgggattataggcacctgccaccacgcccggctaattgttgtatttcagtagagatgaggtttcaccaggttggccaggctggtctccaactcctgacctcaggtgatccacttgtctcggcctccgaaattgttaggattacaggtgtgagccactgtgcctggcgaggaatcatgaattctttaaattggaaaataaaattgtcttcttattcaaactcctatccaaatgttttcatacagtaaaagtacaaggcatatagtaatagtataattacaattatactaataatcataagtttattaaagtatgtattcaatgatacacatgcataaatatgtataattatatatgataaatagtcttgtctattattaccattatactctacttggttaatataattttaataatgaataggaatagtccaggctaccagtgttttaaaacgactgtgtacttatctatagatcaatcaagacctaggaaagataatgggaagttctatgtaggatataatgacatttttcaaatcttctccatctctgtacccttaagaagaaaaagaagtttcttgcagtttcatatttaggaaggcaaccttgggtaggatgttgattacagatatcatttgactatcattcttgtcttttaatctagatatagcaagcacagtgtcctgaagccatgtctgagacatttgaaggcagagtaggagctatcttgaatagaaaatgcctttcagcccacagagatgatgttatcacaaaacactgtgactcaatgggttgacagatcctttccctctcaacacagagtctatgatgttgttttcactgagaaagcttagtcaagagattaggtgatagcagctagcatttacctctacctcaccatggtgcaaaacctggcagctggagggaggagaggggagcacaatggagcagtgcagcattaaagactaatgtgcccaattctcaggaccccttgggaatctagggcatccttttcattgacaaaaatcatttatgtggagcttcagtaactgaatctgtcatgtcagctacttcagtaggccgcacggatttaaatgggttagaagttccttctctttaaagggcctttataggcaactcacacaaggacagataggtttgggcacatgtagggggcggtgctggcagacaaagaaggccaatttgagttcatccatttaaccaattaggaaagttcagcaacaagtaaaccctgtgtggccaggcatgggagcgcatgcctgtaatcctgtaatcccagcactttgggagaccaagtgggtggatcacttgagcttaggagttcgacaccagcctggccaacatggtgaaaccccatctctactaaaaatacaaaaattagcaaggcatggtggtgtgcgcctgtaatcccagctactctgggggctgaggcaggagaatcccttgaacccaggagggagaggttgcagtgagccaagactgtgccactacacttcagcctgggtgacagagtgagactctgtctgaaaaaacaaaacaaaaacaggtaaacctgtgttaggcacaggaggaaggggctctgtcatatgaccctattttctcacttcttccttttgtctatttttttctctctcaattatttgtaagaatatccttgtgctatagagatcagaagacctgcactgaaaaagttaatcttcttaagtctcagtttcttcatagtaaaatgagacagcctcagatttgttgtaaaaacaattgaaatgagtgaataaggaccttgacattgcacctgccacattgcaagtactcagtggattccactgactaacaatgctttgtcaaacagggcagaagctttcattatgttgggggtaatgttttataatccttaaaataccaaagtttcaatatttttatttcctataatatttctgagaatccagaaaggagctgggtcaccatactggaaaaattgccctccatctcacccatatgaaacttgtggaaatttttgattcagataagaactgtagtggcttatcacaggcaaagccctggtgctaagtgcttctagagttatcagggtccatccctgctctggaggggtttaagattgcataaggaggctgaggcaattgcacaaattactatttaataatcaccataaggacaggcacagtggctcatgcctgtaattctagctacttgagaggctgaggctggaggattgcatgagcccaggagttcaaggctgcagtgagctgtgatcacaccactgcactccagcctgagtgacaaaaagaaatctgtctctgaaaataaaaagaataatgatagtgataatgatgatgatgatgatgatgatgctaatcaccataaaagttactgagatgctgaggggaatccaaaagttgggagttcacatctggatagaggatcaggaaatgcttcatggtacagattcgtttttgaaaatctaagatcaacacattttcaagagcctgagagcttgatagcaattttaaaatgttatgcttacgttttaaagatagtcacaaatgtgctaccctaccaaaaatatatagaaaacttttcattgataacttatagctgaaaatatttttataaggctagtttctaaggtcattgtttctgaaactggcaacctaaatattgtttgtctttataaatacacagtatctgtgtatttctcaagtataagaaactgtggtgtttcagatgaggagtggatagttggatagaattttgactcacaggctttttgagtttctcactgacagattgactcctacttggacttcagcatctttgctacctgaccacagctatttttggactgtggctacctttactctgtttaatctgtcaatagacttcctttgtgtcttttctttcaaaaatttgttgaggtatttgtttgactggtgacttccccttgccattacctccattgttacggagttactcatcttcgtatttccattctgaaattaatggggtattgtgggaaaggaaatgaatttatgttactattttactttgaaggagaagtccctgtctctcatcttattcattcattctttatttatttatgcaaagacttgattaggatccaatagatgtgatgattcaataattcaaaaggaaaaagcaacaaaactgaaaataaaataaaaatttatttatgttgcactcttggcaagatattacactttacatgacactcctagataaagagtgaaggatgagacttatgatggatgaggagtctgggacaatagccaagatctttatagggaggctgaaaaaagcaggtggactgtacctgtggctctggaagcctcactaggaagagctctaagcttgtcaagccacttagaggaatcctcattctatgctttctgtgtcccaatactcagtggagccaagaaaactacctagcaccatattctcctgccaactcagtaccttcattgccccctgtccttcctcacaccattccagctcactcctggtattctttaatttttactcagtattatttttagagcaattttaagattgcagcaacattgagcagaagatactgggatttcccatataccccttaccctgcacatgcagagccccctacctgttatctgtgtctcccatcagagtggtgcattgatcccttcccttaccttcccttcctttcccttccccttccccttccccttccccttccccttccttccttccttttttctcttctcttctctttgcttgcttgctctttcatttgttcattcattggttcgtttagttttgtttttttgagacggagtctcactctatcacccaggctggagtgcagtggtgcaatcttggctcactacaacctctgcttcctgggttcaagcaattctcctgcctcagcctcccgagtagctgggactacaggcgtgcaccaccatgcccagctaatttttgcgtttttagtagagatggtgtttcgccatgttggccagcctggtcttgaactcctgacctcaggtgatccacctgccttggcctctcaaagttctgggactacaggtatgagccaccgtgcccagcctacaatttctgaatctacattggcacttcattgtcacccaaagtccatagtttacatcagagctgacttttggtgttgtacattctctgggtttggagaaatttatagtgatatgaatctaccattatagtatcatacagagtaatttcactgctctaaaaatcctctgtgcttcaacaattcactgtcaaacagggcagaaccttttattatgttgggggtaatgtcatccttttcttcctttaaccccaggcaaccactgattttttcatagatttgccttttccaaaatgtcatttagttggaatcacacatacgtagctttttcagattggctgcattcacttagcaatatgcacttaagggttctctgtgtcttttcatggcttgatagctcatttccttttagttgtgaataacattccattgtcaggatgtagcaaagtttatttattcatttacctactgaaggaaatcttagttgcttccaagttctggcaattatgaataaaactgctgtaaacatccatgtgcagattttcatgtggagatgagtttttaacccatttaggtaaatacgaaggagcacaattgctggattgtataataaaagtttgtttagctttgtaagaagctgtcaaactgtcttccaaagtggttgttaccgttttgcattcgcatcagcaatgagtgagaattcctgttgctccatcctcaccattcgtcggtattgtcagtgatctggattgtagtcattgtaataggtatgtattggtatttcattgtggttctgatttgcatttccttgatgacatatgctgtgaagcatctttccctatgctttgacatctgtatgtcttcttgataaggtgtctgttagggtttttagcttattttaaaaatcagcctgcttgttttcttgctgttgagtttttaatttaattttattttgattatactttaagttctagggtacatgggcacaacgtgtggctttgttacattggtatacatgtgccatgttggtttgctgcacctattaactcgtcatttacattaggtatttctcctaatgctatccctccccctgcccgctaccccacgacagtcctctgtgtgatgttccctgccctgtgtccaagtgttctcattgttcgattctgacatatgagtgagaacatgcagtgtttgggacagtttgctcagaatgatggtttccagcttcatccatgtccctataaaggacatgaactcatcctttttttatggctgcatagtattccatagtgtatatttgccacattttcttaatccagtctatcatcattggacatttgggttggttccacgtttttggtattgtgaataatgttgcattaaacatacatgtgcatgtatcttcatagtagcatgatttataattctttgggtatatacccagtgataggatggctgggtcaaatggtacttctagttctagatccttgaggaattgccatactgtcttccaaaatggttgaactagtttacactcccaccaacagtgagaaagtgttcctatttctccacatcctccccagcatctgttgtttcctgactttttaatgatcaccattctaactggtgtgagatggtatctcattgtagttttgatttgcatttctctgatggccagtgatgatgagcattttttcatgtgtcttttggctgcataaatgtcttcttttgagaaatgtcttttcatatcctctcccactttgtgatgggattgtttgattttttccttgtaaatttaagttctttgtagattgtggatattagccctttgtcagatgggtagattgcaaaaattttctcccattctgtaggttgcctgttcactctgatggtagtttcttttgctgtgcagaagctctatagtttcattagatcccatgtgtctattttggcatttgttgccattgcttttggtgttttagttatgaagtccttgtctatgcctgtgtcctgattggtattgcctaagttttcttctagggtttttatggttttatgtctaacatttaagtctttaatccatcttgaattaatttttgtataagatatagggaagggatccagtttcagctttgtacatatggctagccagttttcccagcaccatttattaaatagggaatcctttccccgtttcttgtttttgtcaggtttgtcaaagatcagattattgtagatgtgtggtgttatttctgagggctctgttctgttccattggtctatctctctgttttggtaccagtatcatgctgttttggttactgtagcttgtagtatagtttgaagtcaggcagcatgatgcctccagctttgttctttttgcttaggattgtcttggcaatgcaggctctttttcggttccatatgaactttaaaaagtagatttttccaattctgtgaagaaaatcattggtagcttgatggggatggcattgaatctataaattaccttgggcagtatagccattttcacgatattgattcttcttatccatgagcctggaatgttcttccatttgtttgtgtcctcttttatctcgttgagcagtggtttgtagttctccttgaagagatccttcacatcccttgtaagttggattcctaggtattttattctgtttgtaacaattatgaatgggagttcactcatgatttggctctctgtttgtctgttattggtgtataggaatgcttgtgatttttgcacatcgattttgtttcctgagactttgctgaagttgcttatcagcttaaagatattttgggctgagacaatggggttttctaaatatacaattgtgtcatctgcaaacagggaaaatttgacttcctcttttcctaattgaataccctttatttctttctcttgcctgattgccctgaccagaacttccaacactatgttgaataggagtggtgagagaggacatccctgtcttgtgccacttttcaaagggaatgcttccagttttttgcccattcagtatgatattggctgagggtttgtcataaacagctctgattattttgagatacgtcccatcaatacttagtttattgagagtttttttttttagcatgaaaggctgttgaattttgttgaaggccttttctgcaactattgagataatcatgaggtttttgtcattggttctgtttatgtgatggattatgtttattgatttgcatatgttgaaccagccttgcatcccaggaatgaagcctacttgatcatggtggataagctttttgatgtgctgctggattcggtttgccagtaatttattgaggatttttgcatcgatgttcatcagggatattggtctaaaattctctttttttgttgtgtctctgccaggctttgttatcaggatgatgctgacctcataaaatgagttagagaggattgcccctttttctattgattggaatagtttcagaatgaatgataccagctcctctttgtacctctggtagaatttggctgtgaatccatctggtcctggactttttggattggtaggctattaattattgcctcaatttcagagcctgttattggtctattcagagattcagcttcttcctgatttagtcttgggagggtgcatatgtccaggaatttatccatttcttctagattttctagtttatttgtgtagaggtgtttatagtattctgtgacggtagtttgtatttctgtgggattggtggtgatatcccctttatcattttttattgtgtctatttgattcttctctcttttcttctttattagtcttgctagtagtctatcaattatgttgatgttttcaaaaaaacagctcctggattcattgattttttgaagggttttttgtgtctctatctccttcggttctgctctgatcttagttatttcttgccttatgctagcttttgaatttgtttgctcttctctacttcttttaattgtgatgttagggtgtcgattttagatctttcctgctttctcttgtgggcatttagtgctacaaatttccctctacagactgctttaaatgtgtcccagagattatggtatgttgtgtctttgttctcgttagtttcaaagaacatctttatttctgccttcatttcattatgtacccagtagtcattcaggagcaggttgttcagtttccatggagttgtgtggttttgagtgagtttcttaatcctgagttttaatatgattgcactgtggtctgagagacagtttgttgtgatttctgttcttttacattgactgaggagtgctttacttccaattatgtggtctattttagaataagtgtgatgtggtgctgagaaaaatgtatattttgttgacttggggtggagagttctgtagatgtctattaggtctgcttggtgcagagctgagtttaagtcctggatacccttgttaaccttctgtctcgttgatctgtctaatattgacagtggagtgttaaagtctcccattattattgtgtgggagtctaagtctctttgtaggtctctgaggacttgctttatgaatctgggtgctcctctattgggtgcatatatatttaggatagttagctcttcttgtattgatccctttaccattatgcaatggccttctttgtctcttttgatctttgttggtttaaagtctgatttatcagacactaagattgcaatccctgctttttttttgctttccgtttgcttggtagatcttcttccatccctttattttgagcctgtgtgtgtctctgcatgtgagatgggtctcctgaatacagcacattgataggtcttgactctttatccaatttgccagtctgtgtcttttaattggggcatttagcccatttacatttaattttaatattgttatgtgtgaattttatcctgtcattatgacgttagctggttattttgcccattagttgatgcagtttcttcctagcattgatggtctttacaatttggcatgtttttgcagtggctggaactgattgttcctttccatgtttagtgcttccttcaggagctcttgtaaggcaggcctggtggtgacaaaatctctcagcatttacttgtctgtaaaggattttatttctccttcacttatgaagcttagtttggccggatatgaaattctgggttgaaaattcttttctttaagaatgttgaatattggcctccactctcttctggcttgtagagtttctgccaggagatccgctgttagtctgatgggcttccctttgtgggtaacttgacctttctctctggctgcccttaacattttttccttcattttaaccttggcgaacctgacaattatgtgtcttggggttgctcttctcgaggagtatctttgtggtgttctctgtatttcctgaatttgaatgttggcctcccttgctaggttggggaaattctcctggataatatcctgaagagtgttttccaacttggtttcattctccctgtcactttcaggtacaccaatcaaatgtatatttggtctttcccatagtcccatatttcttggaggctttgttcgtcgctttttactcttttttctctaaacttctcctcttgctttagttcattaatttgatctttaatcactgataccctttcttccacttgatctaatcagctattgaagcttgagcttgtgtcacgtagttcttgtgccatggttttcagctccatcaggtcatttgaggttttctctacactgtttattttagttagccattcgtctaatcttttttcaaggtttttagcttccttgagatgggttcgaacatcctcctttagctcagggaagtttgttattactgaccttctgaagcctgcttctgtgagctcgtcagtgtcattctccgtccaggtttgttccgttgttggtgaggagctgcaatcctttgaaggagaaaaggcactctggtttttagaattttcagcttttctgctctggtttctccccttctttgtggttttttctacctttggtctttgatgctggtgacctacagatagggttttggtgtggatgtccttttgttgatgttgatgctattcctttctgtttgttagttttccttctaagagtcaggtccctaagcttcaggtctgttggagtttgctggaggtccactccagaccctgtttgtctgggtatcaccagcggaggctgcagaacagcaaatattgcattacagcaaatattgctgcctgttccttcctctggaaactttgtcccataggggcacccacctatatgaggtgtcagttggcccctactgggaggtgtctcccagttaggctacacaggggtcagggatccacttgaggaggcagtttgtccattctcagagctcaaacactgttctggaagaaccaccgctctcttcagagctgtcagacagggacatttaagtctgcagaagtttttgctgccttttgttcagctacgccctgcccccagagctggggtctacagaggcagcaggccttgcagcgctgcggtgagctccacccagttcaagcttccccagccactttgtttacccactcaagcctcagcaatggcgaatgcccctcctcctgcaaggctgctacctcacaggtcgatctcagactgctgtgctagcagtgagcaaggatctgtgggtatgggacttgccgagccaggcatgggatataatctcctggtgtgccatttgctaagaacattggaaaagcacagtattttggtgggagcgtccgaattttccaggtacagggcatcacggcttccctttgctaggaaagggaaatcccctgaccccttgcacttcctgggtgaggagatgcctcaccctgcttcagttcaccctccatgggctatacccactgtcccaccagtcccaatgagatgaaccaggcacctcagttggaaatgcagaaatcaccgtcttctgtgttgttcacgctgggaactgcagactagagctgttcctattcggccatcttggaacagaatcctgttgagttttaagagttgtctcctggaattcttgtttattttctctttaaaaaaaggcttgtctttgtagtacaccttctatgtggtttctagaagtagtgtggagttaacattgaggtatatttaagtttagcagacaactgttgcaatctattcaatgattagtttatttactcaccaaacatatatttataaattactgtatagcaggtgctatgataagtgctgagattttaaagattatatttgctgtcctcaaagagcttctagactaatgtgaagtcagatacataaatacgcaatttccatgttaccgtaaacaatgttataataaagaaaattagaaagtgtgatgagaactcagagaaggaagaactttatggagtctggaactcaggaagcgggggagctggaattgagctggatgatataaggtgagtagataggggaggaaaagtttgctagctgggaaagggccaaaggggaaaaggctttctaaagaatgagagaaattccctttcaaccttggggtgaaatgcaagaacatgtgtgttaatgagaatttcaggtagttcagcatgcctggagttctctgagagattatagcccatgttgaacttcattggtactaaatcccatcctttaaagaagtgggattgacagttatttttattttttattttttgggacagagtctcactctgttgcccaggctggagtgcaatggcgtgatcttggcacactgcaacctcagcctcccaggttcaagcgattcttctgcctcagcctcccaagtagctgggattataggtgtataccaccatgcctggctaatttttgtatttttagtagagacaggatttcaccatgttggccaggctggtttcgaactgttgacctcaggtgatccacccgcctcggcctcccaaagtgctgggattacaggcatgggccactgtacctggacgacagttttattgaagtcttcccatatcatctgagttttaatgacgatcttaatttctaaacactacaaggattctgggaatcataaatcctgtcaatcaaggagtgatcaccaaatcattgcaaggctttgtgatatgtacaaaaatgaataactgcccttactgtctggaaccgcagaccttagttaggaaagagttcctcaaaactaaaagatctctttttttaggtgatagtccttagttttatttaggaaagaagaatgtttatgaaatcttttcttggagttccgcaaatcatggaactactgggaggcatcctggaggatcttgagtatttgacctgaaataaaaatggcttagcagtactcccttcacttcttactaaggaagtcccttggtcagatctactgagcacccactgcctcagtcagtgtttcacaagtgagattcctagaccatagcattagcaacacctgggaggttgttggaagtgcagtttctcaggtcccaccctagacctcctgtgtcaggaacttcggggctggagcttaaaactctgtgttttaacaagcccttccaaggagtctgaggcacagtgcatgctcaagtttgaaaatcactggtctcagtgatcgctggtgaacttttctgttgctattctatgtcctgccaagtgagggagcactttgtaggtctttgccacactgtacccctctttcccacagacccaagcaacttttaaaaagagggatgactagttagtcatcaaatacaagaataactctttttgttatttttttattataaaagatacataacctaaaatttgccgtttaaaaccttttaaagtgtacaattcagtcattaattatactcacaatattgtagaactatttccactatctactgtcaaaactttgttgttaccccctaaattctgtctgtaatcattaagcaataacttcccactccccttcccctcaacccctggtaaccactgatctactttctgtctctatttctcatcattttatgggtatctcatgtaagtggaatgaattgcacaatatttgtctttgtatgaatgacaacgttttgaaatgctagttgcattcatgctggaaggtgctaagccttggtaccgcatatggccatgttacatctcaatcaaacaggacagataacagtcaggtttgtcttcaatgtgctctttaactggagcaaaatcagatacatttttgttcatctattgaatcagaaactgtctgctgggtgcctgctctgtgctgtgcattgagataggatatcacatcttttcttttgtgctgccagatatttcaagagtggattatatcataggtacatttgacttataagagttcaactaagtgtgtggtatagtgaatattctattgtagtcaaatagcaaacattctgtagaattctattttgcatatatatgcttaattatattatttactcattatacctctctatatacatattgcagtataggattatagttgtacatccatgtataatggacttttgaattgtttaaggaagttaaattattttaagggtaatgtttgccttaagtgctaacttgagagtcacacctctatgtagaaagagactctcttgtttgtgagaacttattgcaatcccggtctgctcctttcccctcagacattagctttttccttcccagtgctggggattcccaaaagcttttgtctgagcccttgttctgatgctgttgcttgtgaatttggaagtacttcaaaaccatttctcctttgcagagtctctgcttatgacaagccaggcagaatggggccctcccagcctcgattgtggtgctctgctcctggttctatctcaggcagtagccatcctctgtcacactccctgctgagtgttcgtaaccaaaccagtctgagatctgggtttcattttctcttaaaaaaatttcccgtgattgatgaggattcctgcatctgtctttgacagcatctggatagagttgtaggggaggaggttctttgtttccaaagaaaaatggacgagctccatcctgggcacaggatctggttccatttctgcaccatatgtttattatgctttttctttcctttcagcatgcagaagccatctcagtttctgtttctgttttctcctctctcccttgaaaatggtggttagcaagatccgtgtgttaccacttttcttggtcacctggctctgtgtgtgtgtgtgagtgtatatgtatgcgtgtgtgtgtgtgtgtgtgtgtgtgtgtgtgtgtgtgtgtgattttatgcatcctgctagtccctctcaattcaggcaggaggccggcgctgtagcagatggtattctaaacaacatgttcaatcccttttaaaggtcctcctgctttatccacctgttatttggctaactcctttggttcttcactttctttttccgctgcaacaaccccttgtcccactgccaactctagtgaggctctaggattaaattctagggccaccttcttccttctttctgaaatctctccaaaaaagctcgctagtgccagtgctcaatgtggtgttggacagcaggtgttaagtacctgacattgcagtgagacagatgcccagtgaagttccagatctgctgctttctaacatggctacttcaggcaggttaagttacctttcttagtctcttcatctgtaaaatggcgattgttatgagaagtaactgagctagtattttctcagcaatctcacagcaatctgtcaagaaatcccatcagttctaaatctaaaacatatccacgtgcttcttgagatcactccaattgtaccatgaagaacagtttgaacgggtcctagagtggatatggatgtgtcattttggggactactgcaatagttaggtgaaaaatgatacttgtgtgatttctatttatttcaatctttagcaatattttttcaagtgttctctagttctcagtataaaaggatgccttttgttaaattgattaccaggaattgtactctttttgctgctaagattagtgggatttaaacaaaatcatttctgaattttcattgctaatgtatagagatacaattgacgtttgtatgttaatctgttatcatggccaccttgcaaaacttgtttattagttttaatagtttttagtgactaagatttttctgtacccaagatcacgccatctgcaaatagacatagttttatttcttattttccaaactacatgccatttatttatttatttatttatttattcatttatgcttaagtgccctgactacaatctccagtataatgttaagcagaggtagcagaatatgtatctttatcttatttctgatcttaggggaaaagcattcaatctttcttcattaagtatcatattaactgtggattttctataggccactttatcagtttgaggaagtttcctttgattccatcttattgaataattttgtaagaaaaatatgatggattttatcaaatacttttcctgcgtgttttgagatgatcaggtattttcaaattctttattctgttattatggtgggttactacattgactgaatttcagatgtcaaaccaaccctgcattcctggactaaatcccatttactcctgtgtgtaatcctttttacttgttgctgtgtttagtttgctccacatggctttctactggtctctggcttctactcttgtcttcctagtcctttaaaaaaaatgtagagttgtcagagaagtcttcttaaaacatgctaaatcattgctcaaaatccagtagagaatcctccacttacggtgaagccaaagcccttatagtacctacctcatctcagtcctgctccactcctgtcatcctcaactctagcagccctgcccatctcactgttccttgaacaggtcagggctattgtcaccttacagtgtctgtactggctgtcccctcagctcagcagatgcttctcctgataattgcatgacaaccacttcctctccatatttttatttatatgttgctttatcaaagaagtctactccagccaaccttttaaatcttgtaacccattcctctacagctgatctctttaccttgttgttgttttttctttttttccccatggcatttatcacatctaagaatactaatttagtgggcttttcaaaaatacttttgtctattggctatttctttcactttaattccctcaaacataagctctttgggtgtaagagtctttggtttatcagtttgtcttgacacatagcaggtcctcagtaaatatttgttgaacgaaagaataatataactaaggctcttagaccagtgcctagcttttgaaaaaggtttagcaaacatttgatggttatctgtgttcaaataagactaagtggtaggggtagaatagtagaaaacaaaacatgtttcctattttctggagcttgcagagtggaagaggagacagaaattaataaaacaatcacacaactgagtgaataactgcaaactaaattgtgcaatgagaaaagaggaaaaaaggatgaatgtacctaacagaggactaggggtcaagggagtctttctacaggaaatgacacctaagttaggatgtaaaggataaagtatgagatacaggtaaagaaggggagaaaggcccagggcattttaggctgcagcattagcaaggtcaaaggacaagccatgggtacatgctctaggtcttggaaaaagaacagtggggcagaggtatagaaagcaagagaaagtggtgtgggacaaagctggagagggtggcatctgccagattcagtagggcctcctggtccatgtttcagatttggattttttatccagagcaagagtggatgtggggtagcaatgtgagggtgctcaaatctgagcctctgattgagaagaccactctagttgcagactggagaacagcttgaaggagatacagagtggatatggatagattagttttggggctatagcagtagttgggtgagagatatttgggtgattttaatttatttcatttctttttgcttaattatattttctaatatacctaaggaataacctaggaagttaaaatatatgttccaaccaaggaccaatagctctagaaattacatttctcattaaagtaccagaccctcacatgcttaggctagggtgacaacagcagagatcaaaaggaatggacaacttaagagctctctagaagttacaaagtggtgtttgaggaaatgatggagatctaggtggaaagggcaggtggtgttaagggtgcatgttcaacttctgggaagatagtatttccactctctgaaaaggggacgtctggggagggtcaagtcttggtgaagtgaatgttaggttgctggtatctggatgctaaacattgcaagaagctttgggtgggggacagactctcaggtggccccctgccatgatcctcacctcctgttgtttatacctttatgttatttcctgcctttgaggatgggaaagagctgaaacttgtttttaacccacagaatatggcaaggtaaggacatgtcatccctggtcacccctgtgattatattacataattgtgttataagaggtcattgcatatgtactctctatagaaactttcctcattgatgaagtaagcagtaatgttggggaaacccccattgcaaagaacagttggtggcttgtagaaactgcaggtagcctctagaaatgcagagtggtcttactgtctgttgatacagcaagccggcagtgtccttggccttggcactgcaaggaaaggtattttaccaagaacctgtttgagttgggaaacatccttccccagttgagcctcaagatgaagactcagccctggctgatgccttgattgcagccttgtcagaccgtaagcagaggatccacctaagtggattcctgccccatataaactgtgagataatacatgaatattgcttcaagctgctacaattgtggtaacattacactgcaattgataactaatatgggtggcattgctatatctaggccatctgtgccacagaatatctgacttccaagagatagtttggtcctatgtttcctccatgtacccagggataggagcacattttttctccagtgacctctcctgactggtgaatgatgaccctgcaggctcactgcctgcaaacacatatacagagataaacccacttcctcacttggtacccattccaccttccatgatccaagaatgacattcaagttattaggttggtccaaatgtaattgtggtttttgccattacttttaatggcaaaaattacgtttggaccaacctaataatattacatttcaggggctctagtaagctttttaacgtaatttaatttaaattttactttatctcactcttcacaccatcccatcagttagatcttatacccactttataaatgagaaaggctatgagattcagagagatcaagtaaacccagaacccagaagcagaaaagtggctgctccaagcttcaaacccaagccctctaattcctaatttagcaactcagtcctgccactcaaagatgcctgtgacttgcttctccttgagttctttgtctttgtctccatgaccaccattgaacatctaaacccgcttaagctgtaccacactgtgctatgtagaatcttgaatcaaacagtggactcaagctggacaagttgtttgcctcattggctctgtgatgtatgaatcctctgaccttgcaccagtcatctaaccttttgatctccacaatccttatttgaaagataaaaatattgcacagagagatattttagattctttctagaattatgttaaaagtagagagaagactttaggatcactagatttaaattcacccagaggtagacttatagctaatgctgcctctttttttttttttttttttttttttagatggagtttcactctgttgcccgggctggagtgcagtggcacaatcttggttcactgcaacctctactgcctgggttcaagcaattctcctgcctcagcctcacaagtaactgggattacaggggcctgccaccatgcccagctaattttttgtagtttttagtagagatggggtttcactatcttggccaggctggcgttgaactcttcaccttgtgatccacctgcctcggcctcccaaagtgctgggattacaggcatgagccatcaagtccagtgaatactgcctcttgctagctgctgaaacttgggaagattatttaacctttgtgaacttcattattgctgtttgtaaaccaagactaataatttcaccctctagcattcccgtgaagatcaaatgtgatgtataatgatgtatataggacatttagcttgctgcttggcatttataggtgctccctaaataggggtgataaatattcaagactcctctgtaatggctcttaaaatttacttcaacttgaagacgtaaattgaactgttgcaattctgttgtgttttgctaaaatcttaacgagaggatatttacaaatttgccaatagtttaagcttagctttttctgaaaaggagagtggacgtgaactgtgacctctagaatcttaactgagttatcctacagtatgaaaatagataggatgtgggcggttccactttgcctttggctgttataactctcttggagcaagatgttctgcaaaaatttctgaaatgattctttcattgatgtaaacatggggacatccatttggaggacattctggcacttctactttctatctcccctgggcatcccatagggaagctcaaacaatgggggatgatgttatgagtttacactctaagaaaacagtgccctcccaagaagtcctcttcaggccgtgcacagtgactcatggctcatgcctgtaatcctagcactttgggaggctgagacaggcagctcacttgaggtcaggagtttgagaccagcctagccaacatggtgaaaccccgtctctactaaaaatacaaaaattagccaggcatggtggcatgcctgtaatcccagctacctgggaggctgaatcaggagactcactcgaacccaagaggtggaggttgcagtgagctgagattgtacaactacactccagcctgggggacaagtgcaaaactccatcaaaaaaaaataaaaaataaaaaatgaaaagaagtcctattctataaaatcagtgcagctaccagaaccatgggtgtcagatgtgcacatccagcagaaggcagtcttgcactccaaaggcactgactgtgggcccccagttcacgcactcaatacaatgggcttggctcttggagtggaagtaactgaatgccttcttagttgtttaagttttagcagcttaagcttttgctttttgtgggcttagcagttggttgacagagtagttgcctcggctctgataggttttacttctttcttcatgcttcgctgtgggagcagacaagtggcagagcagcaatgatgagagtggaccagcgctgcagacatgtaaccactgaataaaccaaaaatcaagagcctcttggtgacatgcacatgagcgactcgatgtctggatccttggcactgcgtatgggagatgaagtgctttcagtttgctcattagttgatttcagatgtttattcttatacagatcttatgtggacactacatccaaaacaacatatttacaaacttttttttttttaaggaaagcacttatatcacattcccagtaggtacacaagtgtatgttcatgcattgaagtgaaaatttcttagatcactgctaacctttgctacatgaaatgactctgatatattaaatttcattttgatttctatttcattaaaaactatagttgatacctataaaattgacttcacaatgcactattgggtcaaaatttccagtttgaaaaacagtgtgcctagacagtctggtgaagttcagtttccaaactaatcatccgcaggtctcctagttcctcaaatgcacatcttctgactcctttaggggtttcctatcctctagtgttgatgtcttcctggggcagccctctattctgctcttgattgaatttcctctccgatatcacctgcttgcctggctatgatgatcattgctgctgtagtgattcataaatgtatattcctaactgtggttgcgttcctgaattctgtatgatgtttccagcagcattccaaacagtttcatgtagccttctgttgtacccttcatcttgaactcagcaccaaaatcaaaatcattattttgtctaaacactgcaacttctcttcttagtctattaatggctctcttattcccctatctacctagcctaactattccaggccatcactgactcttcactctccttcaccctccgcagctcacctttcctcagctctcgttaattttttgctcacaacttctctctcacttttccattttgacaccacatcatctcaatttaaaaaaccaaatggcttctcattacctacagagttgaatgttaactctttagaatattggactttggcctcaaatcttatctccatcattgccctaaatgtgccctttgctgcactaaacattgatctcctacttatgccctaggaagaaataaatattttctagtttctcaggaataagcctcaatttttttgatgaatgtgacacttatcatgcatttccagctatataatgtcactgtttggattaatatttatttaggttagcatattattaggtactttctagagagttgtgatctgggagtcaccttgaattgctctctcaacatcgaaagggtaactaagccatactgatactgtcccctaaaccaattatcctaaaactttcatgtgcatataaattatctgttagaataaagattcttattcagcaggccagggatgtggtttgagattctgcgtttctatctggctttcagaaaatgtgaggctgctggttagagacccacactttgagtagcaagattcaaatgtggctttaacccatcccttcttcctccatgccactttttgggtttaagaccttattattacttattctcctgactggtctatttgccacctgtccctccccaccactagtctgtctcataaaaccattatctaatggatcattacttcatttgtgaacttcctaaaacaaaagtgcaatggaaattagaaatgcgatccttagagacctggcctctgaactaggattgggttaggcgccttgcttgggacatccttattctattcctgtttctgtggtttccttcttctctgctcattcattttgatgaaattaattaggctgttctgcttttcccaaaacactgattttctttttgccccagcccaagccaggccccatatactatggcacctggatttttcacacaacttgaattttcagaaacaccttccatgtgttccgttttcaatccactgttgtgaaaactctgtgggattcaacaacagtgggattgaagaagctgaaagttgataagaggaaaaccgtttgaaggataaatgaagtagtccatccatgaaagctagcctcgccctcttttaactgccctatggtcattttggtctccctgagtgggggtgtcatcccagttgtgggtttgcacaggggcctgtgaatttcaggcttttgctcttgtggaactgccttgtaggttatggggagcaatgctttcacatgtactgcttttctactgtattttactttatatttattctttcatttatcttcctttttactgctggctctgttgttcagtattagctaatatattgcaaagtgagctttcattgaccaggcagaggccagggtagggccactgagagattctggagaacaacagatggggaggaagcagaggtgtgcagcgagattcctgggattgggatcccagctctgctgacatgtctgtacagtcttggaagtgtgatctagcctctttggcctgttcctccaatcctgagagaggtggtggaaacagatcactgcttagcaggccttagggataagttactagggccacacagaatcttctatttttttaaaaaagcaaacacaactctcctccctataattatactacactgccctcaatgccagtgaagttttcctttgccctgtaggtagatttttgtgtgaccttctcagaagcaggaaacagattgaaaagccactaagatgtgggtcaaaaagtatttttcattctcatatgtgtccctttgttgcaaagactgtgacattcctccatggcagaaaggaatgaatttggaagaaaaatcccaacataactattttccaccctaaggaaacagcctctctttgcaatgtgtgaatgcattttccactgcatccccaggggtatgagtgtttcaagaagtttgcactgtgctgctacattcactaagcccccaagccccactccttcccagaccatcctccagagtccctgcaagtttccagaaacaaacaaatcaagagactgacaagagctctgcctggtatgaataatagaaaaatgagccactctgtgcaaggaagttggtggaaggtgggaggcaagcaggggagagaaagagattttcagcagcagaggggacctcagagacccatctacaagacggacacttcgctcagcgttatttctgcatttatgcctctttaatggtcagcggggcaatcaatagattgcctgctacctggttaatcatgggtctgttatggggtggcaatgggcatgctggctgtgggatccatgtgctgagaaaaagaccattgaatgttgactgttacttttctttctctttccccagggcagccactgaagttttggcagcattgctgaaatccagtaagcacctcttttgaagggtggctatttctctccactctgggtttaatgaaagatactttctggtccccatggctgtttctttttttttttttttcatgaactactatttctcaatcacctatggctaattcctgaccttgaaagtgataaagtcatgtcgtgggtctttgggggtaagatagagaatattatggctgttccaggtacatgaccacaaagagaaaataaatattatccatacacaatgccaccaagacaatggaccctaaagggggtatattgactactgtggagctgatggaccctccacccctgtctaacagagccagcagtccctaaagattgttgaaataaattccaggttccagtgggattgcctccaggtcccagtggaagaaaagattttggctggctggagagaagtattcctgtatttggttctcaactcagctcagctcatgagtctatattcttgggcaggtggagtgctgggaattgcttggacaatgatgatgctgataacaaatttatatttaaaagttgactcttttctcagttacttgagtgattgcaaaagaatagctctggggttctgaataatttgaggaattttttgcctggtagccctggcctaattacgttgggagtcaatttcatgtgtgcaatataatagcaggcacaatgcacttgggagggaagaagtcttagcttaatgtttttactcattttttcctccttacctcttcatctattttaatttggcaccttggaagccagctgcttcaattgtgatatttgtttctctatagggagcctgaggcctgtgggtaataggtgaactttaataaaacttttaaataaataaataaaaataaaaacactctctccccccatccatacatctctgtcaactataagcagagagaaagagccaaatcacatgctgtttccctttataggcttagaaaaattgaagcttgaattcatttggtttatttgaatttgatatgagatgcaagtccacatctgtggacttgacatgagataagcttgataagctgtgatatgagataacttgagataacttgataagctgtgatatgagatccacagcttaaagacctgcaggtagagtggaggtggtaagagcaggataggggagtgaagaggaagggcttatgaagccctggagataggaagggatggaaaagtgttactgtgggttctggggagaggaccattcattcttcagactgaacttgcttcaggtttggcatctcggttctcattatttatctgctccctcggttgctcccaaatgcctggtgtttgaagcaccaaggtgagggggtgttgaattgcaggaggaaaagatgctgagagcagcctggtaggccagcctgtgaatgtcatgccttgggaaagaagctatctctcaaatccccccagcccagccttggcatggaggacttgatgtttcatgggaagggagcccagagagctgagtaaggctggcttactttctacatacacactttccttagctcttgagcttacggttgagcatcctgatataaattgtacctacctagatgtgtaaaactctgaaagtagtcttatgtcagttgtttactctattgatcaggaacacaatgcctcagcccaggaaaaaccaatagccagtgcaaacacggcttgattcaggctcagaccgtgtagctaggttttcaacacaccagccatgcctagtaggctgagtgtgcagtgatgggcctcagcttttagaatttctaacttcttctttccctttagagcttagctcagatattgcctcctctgaaaatcctttctctgactaccacaacttggatgcccctcaccaatgcttttataggctctcccaactcagacttgattacattgtgatgaaattgctattgtctgtctcttccagcagactgcaagcttttgagggagagagtcatctgtattggttgttgtattacttgcctcagcacaatgaaaatcctgaaataagtatttgttgactaaattttttttgttgttgttttctttttaaaataattttgagtactgggataccaaatttttaaatgaatacatgatttgtgatttttcccatgtgtaaaaatggcagtactgcccccttctaccagaatctaacatccatgcatagaaccaatgatctaaacatttgtgattctcatctctatttacctgttctaacagattggtggagaactgcaatagcttgctgtcctccacatataaaacgggttttagtgtcccactaggaggatgtatagcctatttgctaattctgctgagctgtctatacatctttggtgttaattataacacaaggtagttggatgagaggttctctaacattctttctaacactaaatactcagccttaatgtgtatcagggtttctcaatgtaccattggcattttggacaggataattctttgctgttagagtctgttctgtgcattgcaggatatacagcaacatccctggcctctacccaccagacgccagtatcatgcctcagttgtaaccaaaaaattatcttcagactctgccaaatatcccccatggggggtggacagtaaaatttccacttgttgagaatcactgatgtgtatgtatttgggtacacacatgagctgaagctcattcaaagtttcaaaagaccccttccaaaatacctttattgatatttccaagaaatgcacttcttgcataattgatgtgaaattcctcagtatcagcctcattcatatgggttcataagaggtaagaacactgaaggcagaatgtcattgtgagcatttacaaagtactttggagggaaacagattctacaggatcttgagggtctgagaatgaggagggcaaatagatttaataatgagtagaaagtccaatgtgtgggtaggagaattctgagatcatgtttaagctcagcaagaaagaggacttcatttaaatcgcaaagtctgtcatggatttggggagaagtaataacagcatgctaggcagctgccgtctttgttttaccagcctatcaaaagtattgatggcatgaagggtctggttatagatggtaccaacattctgatgagtcaggggttgctgcagggcatagaagtgttgtggaattttctatttgctttacattgcctatatgtcatgtatagttaagacctgatgtggaatatctttcgacttggaccccagagtgagtttgcctcagccgaacttaaattcaggaagtcagtttctgtctaaaattcaagacttcaccatctggcactgatatctgggaacgtttatgtaaacctttagctcctaaaggcacactccttttagctggtgattattctgagcttgatctttgcttgtcagtgagtgtaaaagttggccattgtaatcgttctctgtaattgcatcccaaaaaggaaataattctctgatctaagtaaagccaggagtaaagacccactactctgcagggagagggggcagtcagtggtcctgtgacagtaaacactagggtgggttggaaatctgaggccactgaggccctatcaagtagtgacaggcggaggtcatccccaggaaaagcagaagtgagggatcagggagacttggagtctacccacagtaaccacagaaagcaagggaaagatcacctgcattgcatttggaagatctcattattcagctttctcttttatcaagtagtgactgcatgaaaagccagtgtagaatatgtgggtgttgggaaaagaaaaatgaacaaacacatttcccgtctctgtctctttctgggcaatagcaggcaaaataaacctggaaatcctagttctcttctccagttatctcagcaatttgggatcctacaaattaaaaatcattgctcactcaaggttcctttctgtgtctatgtaggctggaatggtctaatccaaatcccgtgcctttccttgtatcagttcccctcttctccactctcacatgcacaaatcccaccctaaattgtcctgtattgaaagttttgcctttttatgctttatcctatccaaacacatttagctttttattcctgaaatgtagtaaagctttagtcaggaaatagtgctacttattattgcaggaaattttttaatataataaatcaaaacaacatgtcctttgtttttccctctgtattagtctgttctcatgctgctatgaagaaatacctgaggctgggtaatttacaaaggaaagaggtttaattgactcagttttgcagggctgaggaggcctcaggaaacttacaatcatggcagaaggggaagcaaacatgtccttcttcacatggcaatagcaaggagaagtgccaagcaaaagggcaaaaaaacccttatgaaaccatcacatctcatgagaactcactcactatcaggagaacagcatgagggtaactgcccccgtgattcaattacctcccaccaggtccctttgattcaagatgagatttgggcggggacacagccaaaccatatcaccctttcttatcatctgccttcactctgcctttatctcatctcatcttcttctaccttcatctctgtcttttcctctttttccctcatcctttttgtcatttctcatttccctgtccacctttccctctttctttttgcttcctcaattaccttccatgagcattaggcataaatgcatttttgaaaaattgtgaccctggaagcggcacttgagtaagtgtgcggcaatgggattatgcctgatttgtactggctccagaaatgaatcttcaaataatgtcttagtattaaccttgctgtccagatttaaaggtcatattcttgcaacaagaaaacgccttctggttcaggccctaaaacttaataagggaatgataagtctctgtcagaccactctccaatttaagaattagcatttaaaggagtctggaagtttgcagaagttggggcatgggaacagaaaagcaagttagcaaaggaagagcgacagagaagaaaagggggagggagagatgtaaaagagctaatgggaagtttggcaggaagttgagacttctcacagatcttcctcgttaatgctctgtctggctggttcacagggacagcccgtcagcctgttgctccaggaggctaggaagggagggcattctaagtgctgagagccggatcaggaacagacagcctcatagtctcaggagtcgtctgctgtgacctggcaatcagcaatgcagagacgggagaatgtgattgatggccaaatggctgctctactacaaaatgtcaaagaaggggccatctttgatatgcacccaaatcaggtctttataagaattctaagagttccaaggagtcctcagaatggcaatatatgtttaggatggttggcattgttaatcctttgatctcatgaccatgcacaagtaccagtggatcaatgcagctgtcactgaacttgcatgtaaattctgtgtttccacactgcctgtggtctgccctcctggctccgggctctgccctgccttgatgagaatgatgcccccaaagttttgcccacagagtgtatttcttcctttagtttccagatgagggccatggagtcagactacgagaactggaaaacaccttcaaggctgtctcatccagggatattcaaatatttgtttttaaaaattcgttcttattattcatttttaattgaaaagttaaaatgtatatatttgtggtgcaccacatgatgctttgaaatatgtagacattgtgatggttgaattgaggtaattgacacatgcagtttttgagtagagagctcagagtcacgtctgcccggctcccatcaattagccccaaggcggcctctgagacacagtcacaaaaaacagggctcctgtgaacacagaaaactattgatcttacctcccccatcccccttattttcacaggaggaaactgaggaccagagagagggcgtgatccacctagatctctgagacttcgaatgtttcatgtccagcccttctttgggtcttggcacaaataacactgttcatagaaccttatgtttatatttcagagaactaaccatactgtaattgatgaatcatgttttttttgcatattatgtgtgtatgcatatttttcctactgggtatagctccaaaggaactgggattctactggatcccccatacctcatactgggctacacccagagtagctgataatacattaatgttgactaagaaagaattccaggttcctgactttagcctcacacatttgctttcagtatgccttggtgaagagtccagcctaattcccgtccccagaaggaatcaaattgtggcatgattatagagctgatgtctcttcttccaccataacttctggagaagcatgcagtatatttctgtgatgagccaaaaatttgcttcaaataatattgatagatttttgcatttgttacactgggatggacggctgtgattgagtgtgcaggaatgcagcatagcaagctatatccatcacgctgttggtttgaaatgacaacccaaatatctaccatttagcaagagttcttagtatgtcaggcactctatacacagttagcctatcaaggagattttataatccccattttacagatgtaggaactgaagtttggaaagctgaagtaactcacatcgttagtgggctgcagggcttacctgccagtctccagacccctgggacctgagctctgtgctgaaccgaggaaattaatgaggctaggtttatttagcctaaagaagatatgactggaagctgaaaaaaagctaaataaatactgtctaagtattagaaggattattgtgggagggggtatctgtcattgaggttagaaaagaacatggtccatgccttgtaggcatctgagtgggacccagcaagaggtacccagcacaccaccatggctgtgtaaagggccagggtctctgctgccctgaggccgagcctcaggccggccgatgaatggtggggtgagagagaggaaggaagcaggaagaattacagactcctcatgccatgctgtgttcaacttggcacatggctttttttcctgggctccaaattcagtcctctctgccaaaatgttatgtcttttgcataagtccatagaagagcttaaaaggtttaagctaaagggatactacctgtcctcgtcgcccccatccctgtccccttgggacggtcagacccagtaggttgggcgggccttgggctgagccgcagacagtaaagcatatcgttcctcttccggccatgtggtggtgctgttcttttagttatcttggccgcgctagtccaatatttattttcagtgagtaatttgtttatcaggaggttattttaatgtaattttggccatatttgctattccatactatctgtgcttcccagcgttagcagcttgcgtgtcttgaaggaaattagctgaagatggtctcagaggcatttgctaagccattatttaagggagttgggaggaggcagggtgagcagagccaggggtgggaacagccgatggaatttgttgcattttcagtgatgttagcatgatggatcgggacttacggagggcaggagcacccggagctgctttttcagagctgcctctggtgaatcctagaacatcttgtagttacgtctccccatttcccctctcgctctttgataacctgttatcttccttgcctggtcaggaaaacaccatgtaaggacaatgccctcctgcctccccgccctgcatgtagccctcatgccgtgtcatagtatattttgtgaaccttttactgccagccctcagcgaagtgggaaggagggtagggagtagggagagaatgagtgtttattagagtacctgcactgaataatgactatcaataattacggagcacagcacttgctaggcactttacacatggcatctcattctcactagagcctgtaatattatgatccccattttacatgcaaggaaggtgtaatcaggagaggttagtgacttgcccaagatcccacacatggtaaacgaagagctaaaatttgaactcagttgtgaccatttccaaaggagaaaagcttcatatttcaaagattattcccaccttccacatggagtcaggaaactggactctgggttcaatgcagccattgattggctctgtgactttaaactagttctttgctagtttaaatcttaccaattatcaaactgaaatcaaacacttgacttcagtttggtttttcaaacatgggagggctagcccaggcgaggagattagaaattctttagtagcaaaaccttttttttttttttcttgaacataaaatcttttgagggaaattgcatgcataaagcaaacaatggggagtaaggggagaccccaattaatgacagcatgacttgtcctttgcccctccctttccttgcctcttgataggcattgagaaacacccaaagaagttcctgaggggccagaagaaatcaagtttgaaaacctctgaagtaaatatactcaagggactctttcagagcccagtctgttgtttgagattacaacttaaaaaatgggctgacactttccttgggaggtttgaaaatgtgttaaatcttactatgcagtggcaagaaggaagaactagtgaagtttgacctggaggaagatccaaaatattgttctcatcctccagccctagtcaagtaaattctgagtctcttgggactaacagacctaatgaaacaattgaactgaacctgacccagtgaggagggtcagcttccagttgggattttactggcaggcaggatgggcagtataattccaccttcccaaggtggccagggtgttcccaggcacccattctgggtccaacacagctgtggatggtggtgttgagtttttcttgtttgagacaaaactcttggtcacataagatattgttgggttgtgattgccactaatcctagttcttacactcatgcaggatgctgtcttttatcaggagatcctgtcaagacttagttctatctcaagggctattcctctgtcctgtgtatctgcttgtaggtttcagccatgttgtttctttgaccatagtataaaagtgctcaaggtggcttggtggcatgtgtgcagaatggtgtatgttccctgtaagctcagaactcttactccgaaagagtaagtcacaaggccgagagcggtggctcatgcctctaatcccagcactttgggaggccaaggtgggcagatcacaaggtcaagagttccagaccagcctgaccaatatggtgaaatcccgtctctactaaaaatacaaaaattagctgtgcgtgatggcatgcacttgtagtcccagctatttgggaggctgaggcagaagaattgcttgaactctggaggcggaggttgcagtgagcgaagatcacaccactgcactccagcctgggcgacagagtgagactctatctcaaaaaaaaaaaaaaaaaaaaaaagagtaagtcacagtggagaatagcacttgctcagtggtcactgtgcaggctctggaaagactgtgtagagttgaactgtggccactgtggcatgtttcttaatgactctgtgctacacttccctcatctgtaaagcagggaaaacagtacactccaaagataattggtaagatttaaacaaggtgatgtttaaaagagtgggagtacagtactggatcttggtacatctcaataaagatgaactcttgttttattgtcatcaccatttcaaaagtcctggaggtttcaggaagtgatgatataagggcataaagcctgatgaaatgtaaatttgtctcccaagatcttccccgagggttgaatgatatctggttgtttttagagtctgtctttttttcaagaagctttttctgtaaaagcgccagatgatagtaaatattttacggtttgtggatcagacagttctgtcacagctacttaactcttcccttataggacaaaaacagcaacagacaacatataaagaagtgaaaaacttcatgaaaacgggctgtgggcaatttgctgaccccctactttagactatgtgagcctcggatctggggactctgttttattcttatttcttaagctattcttcttattcttatttcttattcattcttccttatttcttaagctattgactctaatgtgttttatagagtggacactcagagtaagttatctaaatgaacaaaggaatcagtgaataagtgaatgcgtgcagattgaaccctgctcaatcaatccgcatgcacttgttttgttttactctagggaatcaaaggttaatatccaaggttgatgagttctaaatgtcttaaattttagaacttgtatcatcccggcataattgatgactggctatggattgacaaagataaattatcacaaagatttaaggagatagagaaaaatataaacatttcatgactcagaaagtacatcatggcttcctcatcactttcaggattggctgtacaattatttatttacatcaagatgtacctaaggtgtttcctagcaccttctaataacagcagtttacaaagcagcttttcatatatacaatctcatttaatcttcaccatggtcctgtcagacgggtaaatatttaattattctataacagtagttctcaacatgagtgactttgccccagagggagcaattagcaaggtctggagacatttgtggttgtcacatctgtggtgggagagggtgtgctgctggcatcaactgagtaaaggccagattgctgctgaacatcctacaaatgcacaggatggccccacacaatgagtaatatcagcccaagatgtcagtagtgtgaggatgagaaaaatagtgttctatacagaggacactgaggccgaaagagattgactgacttgcccgagattgtgtaatatgcacttggcatattgggactaacctctactccttcctttcactactgcaggttttaaacttttttttgaaagaaatgaatgtttatttttattttcaaatgaaatcctttgcagagccactgtatataaacagatgacagtgtagctgctctggggacaatggaagttagagacgctgctcagcctttttcttagccccttccaccagtcccaggggcacacagtatggcaaccactgcccacagaccgtgaggcacacagagcactagacatctcttggcaccccagacttccagatgtccctggaaactactactttttttttttttttttttccagtaggggatgaagcatccaaattctgcttcaataaaatgcattgcacagaagaagagagaatggaagcattggggtcacatatgaggctattgattgctggtgcagcccaggtaataggagaggatggacatatcgagagtgataggagttgagttaaaaggagaatgcacacggctcaaggttctgtgattgcatagtgttacagctctgaggactggaggaacaccaggatccttagtctcgggccgaattggataaaacgacatgaacacacatggagtagttttaaggagtggagagtttaatagtaaagaaagaaggaagaagcctccccatacagagacagagggaggggggctccaaagccgagagaggaaaccagagtgcggcagaaatcagctggaggctggaggagggggtatctgatttgcatagggctcaggggattggtttgaccaggcgtgtcattcacatagcccggggaaaaaactgaccctcccaccctagccttttaatatgcaaatacagggtaccctgatgttccacacacacggggatatgtgggcgggggggggcgggggggggcgggggggcgccaagttgccaggcacatgttggggcaagggcaagaagatgtgggtgggcccagtttctaatggtggactcagtttttaatggcccacatttgcatatcaaagctggccagcccagctctaaaagccgggcctttcctgctagacaagaaacgttctggagctactttaaaagaaacaaaaacttcccaaggaccctctttcctctgtatctgcctaaaataatttcttaataactcctataacaatagtgacacactattggctgacataaggctgaagggtggcaggctcaggggtgcagaagcatttgctatttgcctcttcctcatacactcagggcctagaggcacaatgcagtgtgaaccgattcatgagcgatgcttgcaacgcagggcagaattgctttcctgctgtctatgttggttgtctgtactctggccagaagcaggcagcatcactggtggacagacgggtgccttaaatatcaagttggggagaaaggaaggtgagggaaggtctctgattttcttcttcttgatgtaaatcctggctttcttctttaagtgtcatcctctgatgagttgacagtggacacagcaaagtcaaaccaggtggaagattttctagacctggaagggataatggcttgtcttggggtttagcaagtacttccttccccacccacagtctagactcaaaataaaaatttggatggataaaaaaactcctatacaaatttctaggcctatttctaagacaattattctgaagggtcttcttgcagagatgcaaaaacaacagaaaggcgagtgagaaattctcagcctgacagattcccccgcttttgcacaacctgttgggatgagtctcaaaatggtggggggtcacacatcctgatccctgctcacctttcccgtcatctgctactactgtccccttgctttcttcacctggctttagctcctggacttttcattatttgtacttaccaagtttttgctttatccacttgctgtgtgcccttgaggtttgaagaatttcctatccccagatctctgcatcctggttccttcttgtcgctcatgcctcagctccaatgccccctcctcaagggtcttccctgatcatccaacctaaagcagccaccctacctcatcactctagtgccactgttttgttttctctgtatcacttgtctctatgtgaaattgccttgtttagttttctttgtgtgtgcctatttggtatctgcctccccctgccactcctgtgggactgcaaaccccataagaggtgaggctttctctatttcattttctgctgcatctctgttgtcaataatagtgcctggaacaactggtatatcgtagttgctaaataaatgtttgctgaatggattaagggtggtaccttgggttttgggtgtgtgaacatggttttagtttataatttactctctgcctagccatagggagaatctggctttccggacaaaggcctgtatgtttatttgcatctaagaagcaaacctcccaagagtctaccatgttagagaattttcaaactagcaatattgaaaaatcaaccatattttctcaaatctaagtctatcatcaactgtgaggtgtatgccattttttatgtgccactgagtgagaaaatgctgtcagttacaatgaaaacatcacccttggtaagaagcaccttaatttcagaaatgctaaaatgtggataaacatatgcctgaggattgataaagtatgtgagatagactcctcatatggaatgtagaatgttgactcagaagagtttcgagtcttgtggcgccttctatgtttatttttcaaatttattttttatttttatttttttgtagagatgggggtctcactctgttgtccaggctggtcttgaactcctggctcaagcaatgcttctgccttggcctcccaaagtgctggaattacaggcatgcccctttctcttcataggtgcagcattgcaacctaaggtccttcattagacattgtatgtgctgagggtgggggaagagcagagatgtgtgaggaagagaaaggtgtggattctgaggctttactgaaagtagagaaattcctgtggtttgggactagttctgtggcaagttattagaaggagttgaggatttataaaaagatagattcatctagatttaaaacagtggtctgaagtgtagtctcttacctgtcccggtttctggagcttcggaaaagcatctttaattttataaaggcagtcaattgagaaaacaagatttgcttgaaaccaaaatttactttatagccaagtttattgaaatgtatctattttacaaagagaaaaaaagtacccgaaagctaattcaaaaccatcattcttatttgagaaatgataatcaagtataatttccattatggatggcattaggtttccttatgcttttgtacatatccttatgcttttggctgttctcctttgcaccagccactcctgcagctgcagggcaggaggaggtggcagttgattccacctctcttcaatggtgccgcactcacacctgggcctgacattgctgggccggcctcactgtgtcattggctggatgtaaagaagtccccaaaacatcttctccagggactcaaagaaccataggctatttatttgggtctttaaaccttttcaagtttcctacgaaaaaccaactcttaccacaatttagggccctgagagggaacagagaagttggaggagggggattggctaaaagccactcttcaagcaccgcaggctgtatctccattagcctttcagaaatcttcctcaagaagctggattagtggtaagaactaaaagtctttacataggtgcaaagaatgtgaactatgctgacagccttgtgagatgatgaatatgtttattagcccgatttgttcattccccaaggtatatatataggcacgggaacctcacatcgacctccatagatatatacaatcattgctttatcaattaaaaatgaaaataaaactaaaagggagctttgaggctaccatgggatattaacctttggagtcagatgaggggatttcatttgaatcctagatatgccacttataagctctgcagacttaaataagttgtttaacttctcttagcctctgtcttcatttgtaaaagagggaaagtaatacttatctttaaacattttcataagacaaatgagatgatccatataagatgattagcctagtgcagagcacataggaaatatttagtaaataaatattcacgttgtaatgtgttctgatggcagacagcttattttcatgtaatatgatttagaatacttagtagagactactttatccagaaacatcttctaaatagactccctgaaaagacccctaagataatctgttgcaaagtcagtggtatcgtatactgtagttagggacacaactacctttattcttactaatgtctcagaaatgggaattctcaggtggaaaattgcagggtttgagaagagtggtttgaagcaagggtttcaatgtggagtcctatttgggatcaggcaagttttgcaatataattgctcaaggttgggaggaagggatttggaaggaaactttggagagtaagtaagagttcaatccccccagttgcatggtcttctgttctgagaagggggtttctatcctgaaaaagacgagttgaattgtcagtagttcagatgaatggattttcaggacggctctgaaacagtagagctatttaatctttctgggcaacaattgtttggggtagaatatgtcacggtactctgtatagctggaggtaatttctgttctcaggaatgatagagggcctcaagtccttgtatttattcttactcatatatgtcttatcaaatgtaaaggtggcatattaaacatgtaactgctatcagtcacatggatcttagaagattaactaatctcctaaaaaggctttagagtaatgagactcaatacgtgtacattttgccagagagggaaattttcaggtttatatcatggacatggccttttatggcacctggtataaaatggggtgtgaacttcagcatgcgtaaagaggagtgtttcattgtatgtatgggagtgtttcagagaggcagcaatgtaggactggtggccattttggggtgagaagtcaactacatgccatggggattgaagaaaatggttataaattttacttattttgaaatttttcctttggctctgctcattggtgaagggtatgtgaaatttggatgccatctttgtagggaaaggaatgatcatttattgagcacatactttatgtcaggtgctgagttatgttttcagttcttataatggacttgtaagaatgtttcaattatttttatcttttttatattgctttaatatttacagatgatggaaattcagttcagaacgctaagtgtccttcttagtccattttgtgtttctattacaaaatccctgagactaggtaactgataaagaatttttttttctcacagttctggaggctgggaagtccaagatcaagggtgtggcatctggtgagggccttcttgctgcatactcacatagcagaaggtgaaagggcaagctagcaggacactgtgtgaagcctcttttaaaaggtccttaatctcattcacaagagaagagccttcctggcctaatcatgtcttcaaggccccacctcttaatactatcacattgacaacacctgaactttggaggggacatgttcaaactgtaacattgagtaacttaaccaaggttacacagctagtaaacactagagccaaaagtaaaatgagtaactaggggcccctgaagcttctgttcttcttgttgttatgatttggctgtgtctctactgaaatctcatcttgaattgtagctctcacagttcccacgtgtcatgggagggacccagtgggaggtagttgaatcatgagagtgggtctttcccatgctgttcttatgatagttaataagtctcatgagatctgatggttttataaaggagaattcccctgcacaagctctctcttgcctgccaccatgtaaaatgtcccttgttcttctgccatgattgtgaggcctccccagcctcacaattcacagtggaactgtgaatcaattaaacctctttcctttataaattacccagtctcaggtatgtctttattagcagcatgagaacagactaatacatttgtccgtagcaatagagagccattggaataaaaaaaaaatagatgatgctgatcatgatgatgatagttaccacaggcaacagatattgtacctattatgtaccaggcatcgagccatctactttatatgtattatctcatttaattctctcaacagtctcacaaaggagagatgattactattggttttattttggataaagactgagtgatagagctgtaaagtaacatgctcaaagtcgcacagctagaaagtggtggagcttctggctatatgcaaggatttcagaaaggcagtgacagaaagttgaagggtctgcccacagattaggacatgcaaggcagggaggggtacatgagtttagaagtctacactcatctgcatgtctcatttctggagctgtggctgttaaagcttccaatacgttactttgctgcaggctcctacattttctctgcttaaggtcatcactgctcccaaaaaggataaggcagtccccaaatatgggaaataaagagcagtgataacaacttcctttagttttgccaagtaagaggagcagtgggctgcttgcaggtaaaattattcaggacaccaaccacttttccccgccagcctgtcatgtggccccacattgcccaggagaaattcaattttttgagtcttgaaggtttctaggctttcctgtttagaccacaaacatctttataaagatggttgggatctccagtgccttcacgagctaggcaggtaattcacttctgaaggagctggggttagacaaaaaaatgagttgattactatgtcaacctgtggactgcttgcccttctcacttgccttgacaacactgtgtggctaatagtctgtaggttaccagtttgtaacatcaaaaggatacatttttttttcctcctgattgtcaaagtttgttgtagaacgcgtaaggattaaaactacagaaaactctaaataagcaaatagaatcatcagttgatcctcaactcattaagtattcttgttaccttggcatattcccttccagtttttaagtgtaaaaatctgcatcaatgggatctgcactaaagaggcacatgtgaacctcagttaagaaatacttggggttaaaataaggatatcactaggtcccgtttcagactgagaattagctacaagtcaggcccttggaggatagaacctggagagataagcagaaatagtagaatatagaagggtgaatgggaggtgaggacagagataaatctcctgttgttcatggatttgccaaaggaaaactggccaaaaaaataccttcagcatgaggctggcagcaagggcctgatggagctagggggtgccaggaagcagggtcaatgcttttagggtggggtagaggagagggtgaggtgttaatacgaaagaccctcagaactctctgtccattccatccccatcctccaaccagtttaaaagatactaatgtaggccgggcatggtgggtcacgcctgtaattccagcacttggggaggccaaggtgagtggatcacttgaggtcaggagttcgagcccagcctggccaacatggtgaaaccccgtctctactaaaaatacaaaaaaattagcaaaattagccgggtgtagtggcgtgcacctggaatcccagttatgcgggaggctgaggcaggagagtcacttgaacttgggaggcagagattacagtgagccgagatcatgccactgcactccagcctgggcaacagggtgagactctgtcttaaaataaatagataagtagatagatagatagatagataaataagtaaataaataaataaataaataaatatatatataagtaaatagacactaatctatttagaaacttaaaaaaaattaagcaacataaaaattttgtttcaaggaaaatcttaggaaaacgctgtttatgtaaacagactatagcagagctggtctcttccaaagagggggacttgaagccctctcacatctctcaactctaagtccacccagagcagtattcaaaaatgcacctcatctctgctctgtttgccctggccctgcaaagcagcgccttcctctcagatcttccagaactcctctaagttgctgatcccagtgaccctcatttcattctttgctcttctccacatttgctctttctcagtttgatgaatctcctcttgtcgcattttagatacgtattgacttttgcacaacttcccaagccattctcagagaaagattgacgggtgtagggtcgcgggggaaggaggtttagctattttaaatgttagtaaacatgagagtttgctggggattaacaggaaatcatgaataaaatcattgggatttgataagggatttttctcccagaaaattaaagattttttttcattatctttctccccccaccaaaaaagacatggatgaaggtcactgggataacccattatcaatctaatactcttaaaacagaaaaaagacaaaagtccttaagcttatgctgcccacggggcccctgtgaactgttgttctggcatctttttagcaggtgatactgtcctttaatacctcccacttaattctcaattttcttttaaacatcagatattgaataggctgcaaactccttcaggcaataaataactctcatgctgtatggccaagatctgccaggaagtgaaatatttttgatacaaaagaacaattcattaaaggaggtaatgaaggcaattcaaaccctccacaaatgtatcaccaggtgaataaagctcgtcactctctgtttagggtcatgttgtaaagagaaaaaaacaaacaaacaaacaccaactgcacaaatgggccaaaaaatcagtggggcttagtcaagcctgacaatttagaatttgacaaacaagcagaaaaaaagagagttttattaatattatgaaaaaaatcccctctggaataaagcattacatttccatgttattgtttgcactcatatgcactcacatggtcttagggagaaatctgactttgagatgaaattttgcttatctgattatacctcatgggctctccctcacacacactcagccagaagcacatactgtctcatacgccagtgtgaatggtttcgatgatggagagatgcggtagtgagagaacggagctacaaaatttgggcattctgactgagagtcagcaggttagagccctgcaatgtacctagtccctaggagccaagagggccaggcatctactgggtagatctgaaccggtacatgcttgtccaccaaccctgtagcccaaggagcttaacctgaaaagtagtgtatattaactgttgagagaggtatcttggactgttcttcttcctctgttttaagtccgtaaaatacggttttatgggcggtcccaaacaggaatattgaactaacacagagaagtcaaggagttgaaaaggtccctattagatatgagaaagctccatactaaatccctgctgggtgggcttccgaactttacctgaacattttcagagccctgttgctcactaccacgtagagtctatcctcttgttgaacatccttaactgtgaggaattcctttcctgaattcagcctagtgtattttaatttctttctttctttctttgtttttttttcttttgagctagggtctcactctgttgctcaggactatagctcactgcagcctcgaactcctgggctcaagtgattctcctgcctcagtctccctagtaactggagccacaggtgcaagccaccacatttggcttatttttattttttgtggagatggggttttactatgttactcaggcttgtctccaaactcctggcctcaagccgtcctcctgcctcaggcccccacagtgctggcattacaggtgtgagccaccacgcccggcctgtgatttctttctaacttgatcttggggtctctttcaagagtggctgtaagccactgatagggggtaaagttagttggggtgtgtggaggaggcagcacagcaaaacccgtgaagtaacagaagtgtttctgtcgttacagagccaggagaataagcggagttgctggggagcctggaggtggcagggagctctaacagtgtctggggagagagaggtcttgttgtgggactgggccttttttaaggttcatggcgttatctgtcaggctttcctgcaggggttatggactgggcagtttaaagaaaacgcacatgaagagcaggtcctattcacatgactctggtgttgtccattgggttttactgtggtcagcagatgtgggaaatgttgggttttgggttagtgggatgaggaacaagcaggccatgtggcaaacaaccacgtgggaagggcaagttttctctaggtcagaggcaacagggtatgactgggtttcaagcaacttaagtcatgcctaaaaaatggatgtggaggttacaactatatgaaacaaatttatgagtcttgattatatataaattagcttccattctctttagaaaggacagccaacatatctcttagacatggcagccttacaggtactatatctcattcagcatcttctccttccccacctaacctgatagtcagctcaacccaaatgacaacctccgggtccactgaagttcagataggaggaatggaaatctggtggaaatctctctctgtgtctgtctctcctcccacactattattattatgtttcttttttttctgagaataaggtacagactttcatatactctaattatgaatttcctaaaaacaaaagtattctcttacataaccccagtttatcaaaatctgaaaataaacattgatacaaaactgttagtataactattagatctacagatcttattcaaatttgaccagatgcccaataatgccttttatagcaaaagaaaaaattgtttgctggcccaagatttaaactataattacttattatgctgacttgtcatgtctttttatttccctttagcctcatgttttgttctgctttgttttgcctttcatgaccttgacattttcaaggagtggagtgtaggtcaggtattttgtagcatgtccttcattttggctttgctgattttcttcatgatccaacttgggttatgcattcttggcaggaacactatagaagtgatgccgatctttctcagtgtatcatatcgggtggcacgtgatgactgtcccattactggggatgttaactttgatcacttggtttaaggtgacatctgccagttttcatactaaaatgttattattcccttgatgattaataagtatcttgtgggaaatacactggaacattctcaaagaggtgtggctgtggagagcctgtgactgaccctgcctttccctttgttttcagagtcgaacggccgcagagcagtgaaccgaggctacgtcaccagcctgctcgggctgcaccaggactggcacagccatgacacagccaacgcctacgtgcagatccgacggggcttgctgctctgcctcaggcacattgctgccctccggtccggcagggaggccttcctggcagcacagggcatggagatcctcttcagcaccacacaggcaggcagcatggggattcactctgcagctggaggccagctgggtgattcctgaaggctgtcatttaggaatcatcccagatagagctgggaacgcctcagtctatttcttgttgcctgctaagggcggatgttctggatttaaggcttcattccaggccaggcccggtggttcactcctgtaatctcagcactttgggaggccgaggcaggtgatcacctgaagtcaggagtttgagatcaacctgaccaacatggtgaaaccccgtgtttattaaaaatacaaaaattagctgggtgtggtgttgcacacctatagtcccagttactcaggaggctgagacaggagaattgcttgaactcaggaggcagatgttgcagtgagccgagatcgcaccactgaactccagcctaggtgacagagtgagaccctgtctcaaaacaacagcaacggcaacaataaaatcttcattccattggttcattcatatatacttaacatatatttgttgaatacacactaccagaggtgcagtgtatggcatagtgttaagtgttgactctagaactagagtactggattcaaatcctagctctagggcctacagctgtgtaactttgaagaagtcactcaacttctctgggccttgaggttcttcaaaaaaaagcagaaataacaaaacctaggttgttgtgtggactaaataagttattgtagaaatggcccgtgcttagaagagtgcttgccatgactgaactgcgttgtgaggatgagccgttattggaataattagcagtggaatctagtggtggatatgacaaacgaggcccttgatcctatagggaaaacctcctagcagaagagtgagacactaagtaagcaaagaatccaatgaggaagataatttcatatcgcactgtgaaatcaatgaagtaagggcataggtctacaggggctgccataggtagagggagcaggtgttcttttagagagagaggtcaagtcatctctgagcagatgacacctgagctgagacctgagttgttggaggagctggtcatgctggtcaggccaagttgcagaggaagagcatcccagggaaaggggatggtgtcttcaagggtttctacttatcagcaccccactggaatatgcattctagggattcctggatttcaacctaaataaattccttaatttcacctgattagggctaattgaaatcctatagtttgaggctacatatgccctccttattggtgatataagtgttccagtatccatcatctgctcacccaccttctcctggggccaaggcagccatgttgcacacacattatgttcctattatctctggattaggccacctctggactccctttatcagccttcttgctcttctctggacaccctccagtttttctctatctgagtacatctgaggtaatgaagccaccaatgagagtgttgtttttccaaccgtggtatctggagacatttctcattaaaaaatggtcttttcccctgctaaacaataacaaaatacagtgctgcaaaccaatatctaactccctatctgctatcacctctgggtttctttccatcattacagctttcaaagcttctcagtcatgaaatagctatattttaccttctatttctcgacatgaagcagggctttgaatttttccaagcttcctcatgctttctaagcttgtggttgcccaagtctctaatccctcccagtccttgtgcaatgccctcctgcattgccgatgtttaacagccccccactctggtccagtgctttaccgtgttcctctgccctccatgttattggctatttctctgttctgtgctaaaaaaccaaccaaacaataaacaaaacaaacaagaaaaacaagaccaataaaggaagaagacagtagtcacagagggaaatgtctacgatagaaaggtggtggagaaaacaccaaatgaagcccagcatgaggtgctatgaatctgtgcacaggttcttcaaaacagttccttatcaggtcagtgaagacttcagttgctcaattaagcacattagcaagaagcttccagccttgaactactgttggaatggaagcagaatgtgagtgcacacagagtgtgcactttatagtgaggtttctctagctcatgttataatctctgcaagtatgatatggaaaagcagttcaggaggggcctatgggatagtgctgagtaaataggccatgacacatctgtcacctggaagagtgtatagaatgtatgggtgtcaacctcaagaggttgaattcctcaccaccaccactcgcccttgcttttagtcttttaaatagtgtgctcttggccgggagtggtggctcatgcctgtaatcccagcactttgggtggctgaggcaggcggatcacctgaggtcaggagttcaagactagcctggccaacatggcaaaaccccatctctactaaaaatacaaaaaattagccgggcgtggtagcatgtgtccgtaatcccagctactcaggaggctgagacagaagaattgcttgaacccaggaagtggaggttgcgatgagttgagatcacaccattgcactccagtctgggcaacagagtaagactctgtctcaaaaaaaaaaaaaaaaaaaaaaaaaaaaaaaaaaaaaaaaaaaaaaaaggtgtgctcttccagagaaaatgttatcaagtttatgtgcaaagtcagatgtttgacattctcctggtttttggaaaatgatcattgcaggtgaaagataggctgtcctggcttagaaaccaaatggcttgttactcttccccccggcagtcataaccagtgttgagtagcctcccagacctcaggtgagtgctgtgagcacagatgcccttgcaggtgtgctggagttacagctgcccatcacccctcctctcccttctgctagagaaggcatgggagtcactggatggccaacttaggggccttggatttggtgatgttatttcagttgccatttgcaaattatgctgctgttgctgctgctgctgctattgctactgccagtgatagtgatgacaatgttaatgaagcagcagcagcagagggaggaggaggaagaggaagagaagaagtaggagaaggagaagacagttactttgaactcttactattaatacatcccttggctgtcttagcaatttatgcagactctccaatattgataatttcaaaagcttttgaggtaggatctattattatctccctttttatagatgaagaaactgaggcacgtaactgttaagtaattttcccaagttcgcaaagctcataagtgttggagctaggattggaatctggtagtctcacctgagagcccatgcttttgcccactgtaccagcagctcccccagttgagcatgcatcagagtcacctggaggggtcactgaagcagagcctgttggacatcaatctcagagtttctgactcagtagggctctggtggggcctgagaatgtgctttcctgacaacttcctaaatgacgctgatactactgatttaggatcacacttggaaaaccaatgtcctaaattaattttattgatgtttgtgatgtgctgacaaacctactgagaatgagactgactgtaaaggaactttttttaagtccttcccacacctttgccatcataatattcttctttgcctttctgctgaggccactgcttgcattgtttctctcttggtgaccctacctctctgtttcctgagtctcacgtttctgcacagattctgtaaacatcccctaaaagttcaaaggctgagatcatagtgcagcaagggtgctgtgtaatgtagtataatggaatcttattggagctttgcatgaggaaagaggaagacggatgacaatttgaatgcaagattgaaaaaaaaaaagaactcctacaaggatgcctgaaacatttggggataattatcaatttggagaaataggtaactgcagaaggaacaaacctatataagataatcagagaaaagaaccactctttggagctacaacagtttaaggggcctgaaaggttgctaaaattggtggttttcaaacttgagcatgcatcaaagttacctagaggaattgttaaaacacagattgctagatcctaccccagagtttctacttcagttgttccgaggtgagatgcaagattctgcatttctaacgagttctcaggtgatactgatgctactggtctgggtacttcactttgagaaccactggaataagaactgatatggccttttaaaagtcacagttgccaccatttgctcagaaagcacagtaggccaagccttgattcatcaggctcctctctggccaacaagaccaatgacctcagccttgtggacctgtgtaaggagggactgaattctaaagagaatattaccaggttggaatcaagaactggataccctaaaggtcagattggtctgagatcatttactatttattcagtaaatgttttctgagctccttctttgtgaaagatgttggggctgggttctatagggggttcaaagatgaaggtgatagaggactcatcatcttcaggaaacttagaatcctatatgggaaaataggatatggataatgcagtgtagccagcaggtgggggtaatagcagactttgtgtaaccatgcagaggaggccctacttggtcttgctgaccagagaagcctccatgaaggcacccacatttgaatgaggctaggagagcgttttgaaaagtctaagagaaacacttggtttgtgaactgttcagagaagcacaggaggtggccaccaggcacagacagagaagctgtggagagcgagtgggacaactaggacgttttggagggtcaggcagaaggaaagatctcagtgacaatccagaagatatcaagccatttccatttaagatatttttatattgaagctacgccacatctgcccttgggcttagaatttctcctctatgttcaaagaatcaccgcaaagagaagggagagaggggttatgccaggcaggagtcgaagagctgctgtgtcacctgagacctgaatagtaagaaagaaccagtgccatgagggtctggagacgagggttccagggagagaaaaagaaagtacatgcaaagaccctcaggtgggggagtagagtgggaggtgggtgagcttgagaaacacagacatggcagagcattgtgagtaagggtggaggcatgagattgagttggagtcatgggcagtgccagggcatttagagttccttgaactatgatagggactttgaattttacttccatcaacttttttttgtttgttttgttttgagatggagtctcgctctgtcacccaggctggagtgcagtagtgtgatcttggctcactgcagcctccgcctcctgagttcaagcgattctcctgcctcagcctcccgagtagctggaattacagccatgcaccacaatgcctggctaatttttgtatttttagtagagacgggatttcaccttgttggccaggctggtctcaaactcttgatgtcgtgatccacctgcctcggcctcccaaagtgctgggattacaggcgtgaggcaccatgcctggcctccatcaacttgtaaggaggcacgaaggagaagaggacatgaattaaagggatagggagggccagatcacatagaacttcctagggcacaaaaataaattagaattttatttctatcaagtttgaagcaggagactgacccgatacagtttatgtgtttcatttttttatttttgaaaaattttaaattaattgtagtaaaatacatgcaaccaaattcaccatcttaactgtttttaagtgtacagtttggtagggttaagtacattgttgtataactgtcactactacccatccatctccagaacccttttcatctggaaaaattgaaactctatacccattaaactgatttatgcttttaaaggaccattctggctgccatttggaaaagagattatcagagggcacaaggggaaggaaggagagtaaggggaggaattagagtgttgataggagtgtaggcaggagatgttcgtggctttggctacatagaagcagagctggaatttaaacccaggactttatactcttagtcaaggtccttttccactaaaatgccttgctttgttatcatgggaattattactaggactctgctctgcgtagcagtgactcctagtattctcttgcagactcctaggagactttatgaaactaaggatgccttctctcttcccactggctaatactaaatgcttactattcggcacttgcctactttaatgcatttaattcacacacaacattaggagagaggttgtgttattatctccactttgcagatgaagacactgtggcacagagaagtgtattaatttgccacggttatgaagttagtaatctttagtccaggatttaaactcatgtagtctggctccaggacctgagcagtttgctcttactttaccttgcctatgtatcatgcaagtagggtatttattacgccaaagcgaattcaaagatgttaactgtgacggaagcattgaatgtattaattgaatgcattctcatatttcatcatcccttccaagtagcagatgtgttattgagagtgatgggaaaagggagcctaaaatctcacctttccctccaattctgagacattggtccataaggatcctatttcctggagtcttgtctttttttgatgcaaagcacaagtaccagccctgcacttctaggagcctgagagcaagtgcttcctgggaacctccctttcctcaccttagtcttggctctgcacagcacctttccatcagcatgagggaaatgttgacaaaggaattcaagaatttctgtcaccttgaaaccaatgatctttgcattcataagtatttcccctacagtgcagcagacagcaaatatatcatgattcctaaagccttgggttttatagattttaatactccctccagccttcaaattcagttcgtggtatggcccaatttttcagaacatttgaacttgccttcatcctttcacttgttccattccaccaacaaaaaagacatgattatcttttattatcaaagaccatcacaaacatacctaggttccaaaatgttggcttttttgactgaattccctggcttgggctggctctatctctaccaaggttggagcttagaatattatatctgataagccatctctttcaccttcttgcttcctccttgagactctgttttatttttttcccattgctgatacttttcatgaaacacttgagaccatttgaccagaccaaagggtgaaatagcttcaactgttcattagcctccataatgaattagccaaaactaattcattttccaccaagagtatttcctgctgtgtatcctgaggctgttgattcagaacacctgatgggtatgactggcacacactgaaggagagagagcactcttgattgcattaagacatttcattttgaaagctggcttacttaaggctgggcgtggtagctcatgcctgtaatcccagtactttgggagactgaggtgggtattttatcctgaggtcaggagtttgatacaagcctaaccaacatggggaaaccccgtctctattcaaaatacaaacattagctggtgttgtagcaggcatctgtaatcccagcttctcaggaggctgaggcaggataattgcttgaacccgggaggtggaggttgctgtgagctgagatcgtgccactgcactctagcctgggtgacagagtgagactgtctaaaaaaaaaagaaagttgacttacttatattttggagtcatttgggtagcttaaattcatggaaaaatttttattaatttttttcctccatgttctttcacatggaagtacctgtaatgttgagtctggagatgccatagttcagcagcaccacggacattcacactaccctgtggtgtgtacctagcatccaccatctccacttctgtgacttattggcctcagagctttctgcaccctttaggaatagcaaactgggggaccccacaagtcatcttcctgtaccaagtcagtagacaaaacatttacaaagatactgaagaaaatggttgtgtttttgccaaagagatactgaactatactcaactctctgtctctcaatttagtgaacttgttcctacatttttcacagtgtctgaaaagaagggtcttgtcatgttccatcagtatcaaaatgttacatctgcaaacccaatttttctctgatttgggaaggtaccaagagggatcaacactgtgggctttgagaagaggcatgtaatttaatttaggtacttgggattcacttagtctttccttctgatttcatattttatcttttttaaaaaatatttttctccacagaagacagctgaaagagaaaagcaaaacttccatcaattcagctgctcattgcctaacgtaggcaataattcacagtgacacatgggtggctgagaaaagacaccggcctcctcttcccccagctatcctgagcaatgtcttgccttaggcgcagcatcccttgaaagaattttaagtctgtattcagactgaattcattgcagtgatgtatgaaatgagcaagagacagaaaagtgcagattctacattagacaaaattctatgttggaatgttcaaatttgacattctacattaaggctgtttacggtctgtccatgcgtataattcattagctgaaacacagctaggagactgtgctgtgttacagcttggagagtgttattagctgtgttacagctaggggactgtgcccagatgttggcatctgatataatcttccctttgctcagaactgcctggatgacaagagcatggagcccgtcatctctgtggtgcttcagatcctgaggcagtgctaccctacgagtccacttcccttggtcacagccagcagtgcctatgccttcccggtccccgggtgcatcaccactgaacctccacatgatctacctgaaggtaaaataagttggtaactatgacctttaagatgagtttttgcattttgaccatgtttcccaggaacatgggtgaaaatagaattcgttattttataggtcaaccataattgtctattaagctaattagagacatatatgaaaaagcagttttgattttcataaacagggtgatttcataaacagaaaaaaccaagctcgcttattttgttcttcattattaactgtttctgctttgcttggtagctatcaaatgcctgtacagtcatctcagctaattttaaaaaagtctatttagaatcccatgatcgaatctctgcagcatactgactgtggaattaatttgccctaaggatgaaattgaaataaaactcttgttatttacaactgcaggctagtcatattggaatatttgaaagtattattatttaatctctgggaagatcttcctgtcaaaagatcctagtacgaacagattttctataggcataattttgccacaatggtacaagatgccttctatggacttttgttttaaataacttcctcaatcaaaaaattaggggctcaatcaaggtgatatttaggttataacacatttcgtttgtgtgtgatctctaaactttggctacactagttgcataaatacctctaactttcatgggagaatccagagtggtattcatgtgtcattttttctgcacttattttgcattcaatgtgggataactgtttaaactttatgacttagtgccccgacatgcctacatgaacaccatttataccgaccaataagcatttgtgtgtggtgggatattgtgcaattaatattgggccccttatttgagagaggaagaagaaagaaccactgtatggtgaaaatctaaatcctaaatcccgggcaaaggggaaacttcacttatttcacctctttttccccatccagaggattttgaagatgatggcgatgatgaagtggacaaagactctgatactgaagatgggaaagtggaagtaggtacaccagcccatgcttctaatgatgtccatagtcacatcatgcacagaaaaatattacttcctgtgtttgcccaagcccagtgtaaattttaagaactgactttagtactgccactccagtggtcgtgatgcgcagtaaatgatagctactgttattgatttccaagttgtcattttcatcttggtaggtccggtacaatgtctcattataaagtcagaggctatcctatacattattatgacaccaatactttattcagatgacctttaggcacacatttaacacttggagttggtatatttgataagaccatttaagaccctagaaagattttccaggaagctttctgcctttgtaagtcactcttcttatcctttctgcacaggggtgctgcattgtacaattccattgacatcagactctgtgaattgttttcccttaagttgcacagtgcacaacctggccagcagagaagtgttgctctttggtccccctcccaaaaaggcctattctatagaagagaggttggtgaacttcctataaaaggtccaatagtaattattttaggctttgtggaccatacagtctttgtcacaactgctcaactttgctgttgtagcacaaaacagctatagacaatttgtaaacaaatgggcatggctgtgttccaagaaatttttttttttgagacagagtctcactcgtgtcaccaggctggagtgcagtggtgtgatcttggctcactgcaacctccacctcccggatccaagcaatttaccaacttcagcctcccaagtaactgggactgcagatgcctaccaccacacccagctaatttttgtatttttagtagaaacaggatttcaccgtattggccaggctggtctcgaactcttgaccttgtggtctgcccgcctcagcctcccaaagtactgggattacaggcatgagccactgtgcccagcctccaagcagtctttgtttacaaaaataagcagtgggatatagtttactgactgtttttgtacaacaagttttctagaccttggcactgttggcatttagaccggttacttcttggttgtgggaggctgccttgtgcattgtaggatgtttagcagcattcctcacctctacccactggatatcagtagtacctacctcattaccctccagggatgaaccaaaaatatctcttagacttgccaaaatcacccctagttgaggactactgctctagaataagaatttgtctgtgaattataattctatctccatttctgttggtggacatggactttgacaaattcctttaagttatagtttcttaattttgttgtctgtaaaataagagtcagtaaattaaggtcaatgctgccttttatgacatttactggggatgaaactcaaattaaaaaaaatcaaaaatcttccctcctttcctttctctccttctttcctatctgtctagaaagaaagaggcttttgagttctctgtcatgataatcactcaccctgctgatggtagtagcagacatacagggactacctcttaagctacatctataggtttagactgctattgacagtctggtgttctctgggttttgttgataaatagaatcatttctgaagtcatccgtagcaaattggatctttgctgtggcttgatggtgcaggcctatggagtacgtgctgaattatttgaataatactgtgctgctgcagtcattcatcaatgccactttcccctcccctcttgcttgctctttgataactgaatgtctgatgcagagtgtcacccacttcatgtatctgatggggagggaccgggtgcacgatagtgcctgacttcccacagcatgggagggagggtgttcagatagttcccttggcccacgctttgcagaggatggaggggtggggtagagagaaccctaaacaaataaataaactcaactggcaaagaagcacaagacaaattggtaagagcttgaaaactattcttcaaaaggcttcaagccaaggcaagaagatgagaagtcagtgtgaggatgaattgtagagaaggagaggagcatgagagtcagggctcaaattggaggcacagcaagagcaaggaaactgctccagaaaactggattttccctggggaaaccagcagcatttgctgccagaggcgtgaacaagaagtcaggcatattttatttctggccacagcactgatccaggcctttaacctgtggccttcccatttgacaatcttaggtaataattgggaccagcctgttagtaagaatgattaagaggatcttttatccataaagggctatgagagtggaaagtagggtgccatgatttgattgaaaactgccaaggtcaacgtattagatgtgggctgtcttcacatacacaagcattagattctgacaaactctgaagaggagggtgataaacagagtgaattcaagctctcccttccttcttccttcctttcctttctttttaattttttattctttcaggtgctttattgggtatgatccgtatgcaacatgctaaattcttggggatgataatctgaaacacaaacagataagacatagtttttatcttcaaagagttcacagtctagtggacttggagtttgtccttattaagtgttctaatcaccaccttcaatggagtggtgaactcaagtctgaggcagccaaaagacaatgtccaaaagctccaacctatggaacaagagccagaaagcattacctggattaggtgggtaccagaattctagctggtaaaggactgcctgggctgctgtgaggacacagaagcaggccacctccagataagaataaatgccatttataagaaatacaaaaggaggtggcaacctggctgagtgcctggttctcagagactaagctccagaactttgaaggcagaaatggtctctgtcacaactattaaactttgctgttgcactgagaaaacaaccatgatcaaatgaatgggtgtggctcttttccaataaaactttattgacaaaaacaaccagtgggccatagtttattaacccctgctctaaggctaagtgggtcgcctagtcacatgtggaatgaattaggttgcagctcatgggttgaatgactctcctcccttcagatgcaccagttggagcacagccttactcactggtggggacatccttcccagtggccttccaggttgtgtttcccttagtaccaccctgggccatggctgaggttgcagtggagggggtgaaggcaagcaggaattgatggatgaagctgcaaagcacaagagtgggggccatggagttggtcatggtgtgtatactgtacctgaaaatatcattaaatgaaactcatgggaattacttttcttttaatttgaagtttggagaaaaattgtgaaacatagatggaacattgcatttttttgccccttggatcagaaatacaaacatttattttccacgtttattggatttaacctttcagtactgccaggtttttccttaactaatgaaatatacttgtaaaacatatggtattttttttttctctatttcattaaggaaacttaatctaggatatgaaaagatgaagagactgggctggttcattcctggtgtcttttctctgtaagaccctacaacccttggaaaacacacaagtattcagaggagagtcaccatcatcattaaaaggtttcgaaatggtgatctatcaagaataaacaataaagtgcctgggattattcagtccaataaataaaagactcacggtgccttggtaaatttttaaatgtacaaagggataaagatgtagtaggagaataccagctcctccccaggtctcataaggattgatataatttctctcccgcctacttctcaaatctcatctcctgcaatcttcctcttattctgtatgcaacagccaccttctttctgtaagcaaattgaagcttttccttctgctaataattcactgctaggcctatgcatagctggcttttttttttttttttgccatttaggtctcagttaaaactttacctccttatgagtcctcctgagatctcctaatccaaacagcctcccattccccagtcttagtaacatcattctcttttatcatttcaagaggagttataactgttggaaattaacttattcatttgtttactttcttctttactgtttttcttctctcgctaaaaggcaaataccatggaagcatggatgtttgtctgttccattgtgaccgaaacttcagtaccgggaagagtacctgctcacagtcggtgctgattaaatgtttgtgaaaagactgacaaacctaaatgtcaaagatagataaagagggacaataattacaatgatgctgacgatagtggcaatgagataaagaatttcttttataatgtgctttatcaattatgtagtttatctcattttatacaaatttttatttctgatgaaggctgataaatactgacataaatgctgagacaagtcctttatcttctttctttttattttaaaaatacaatccagcataacaaattcttcactggatgggccagtgctataatttggaggcaagaaaaccatgtcctaagattctgaagaagcacatacatatcatgtcttgatgcttctcagggtggatttcctgactgtaatctcttctatgactattccattttaggatgatgacttggaaacagacgtgaacaagctgagttccaaacctggtcttgaccgacctgaagaggaactgatgcaatatgaggtgatgtgtcttgagctctcctatagctttgaggtaggacatatgctgtggttctgatctttgacgatgcatgatgggttctttgcagatcctgggaggccaaaccagggtgtccagatggaaagcattgctcatcattagccatatgcttctgggctcttccttagagaaaagcagaatgctaaacaaaagtgggaaaagatggcaaaaatggaaaaaagttacgatgtatgcaagagttcttcagtctgacaccttacacttaggatggatacaaggtcatgtgctgcataatgacatttccattgatgacaggcagcatattccttgatggtcccataagattataatactgtattttcactgcacctttttatgtttagacacacaaatcccattgtattactattgcctacagtgttcagcactttaacatgctgtacaggtttgtagcctaggagcaacaggccacaccatatagcctaggtacaccgtaggctaaaccatctaagttggtgtaagcacaccctatgatgttcatacaacaatgaaatcacctgatgatgcatttctcagagcattccccattgttaggtaatgcatgactgtagcatgaaggtacacatcactgcctattgtctggtgggcagggtgccctgcccccatgcactgaaaaagcaaataaaaattcatgatgatttaattgttctcatgccaaagtgggaccgttgtcctagatggctttttgaaggtggacatactgacttcaggctttcttttttaatagaaacaaattgggaacattagacctggtgatgctaattctgtgcctagttgctgctgccactgttgctgccatcgatattttagacctgctttttgatctccattattttcttatggctcttagtaatcatgaatttgcctacatctaagggtataagctaagtcatgtgtacagagggagttaatatattctatttggcttcagaaagcagaaggatggtttcagggaaggaaatttcagtttagtataaaaatttttttcaaataaacagaattattctcaagtgaaaggcactgccttggggtgcagtgaggcccccataaatatggttttccaaccagattgtaatttagtagggggtcttgaagacattcaaatactgttttgcattggactagacccaccaaaagccccttccaaacatgagtttctatgattctgtcatttatttgactcttgaaggttagtctttagttgaccttggaaaaagcttccacattcacaggatttatgcttagctctgtgcccagagagtaaggacagggatcaaattgtattccctacctggaaggacacactaacatattgtattccattttgaacctgaaggaactgcagtccaaacttggagatgatttgaactctgaaaagactcagtatgccaatcaccaccacattccagccgctgcctcctcaaaacagcattgctacagcaaggaccaaagctcctgtgggcaagaaagagaatatgctgtccagacttcccttctgtgcagggtgaagacgggaaggtccactgtgcatctaggctccaaaaaaaatcctggagtgaacctgtaccaaaatgtgcaatccaatagtctcaggagagattcttctgaaagtgaaatccctgacattcaggcttccccgaaagcagatgcctgggacgtagatgcaattttctgcccaaggatgagtgcctccttttctaattccactaggactagagaagttgtcaaagtaatagataagcttctgcagacacatctgaagcgtgtccctttccacgatccctatctttatatggccaaagccagaagaaccagctctgtggtggacttcaagatgatggcatttcctgatgtctggggacactgtccccctcccaccacccagcctatgttggaacgaaaatgtggagtccaaaggtgatggcgctactgacttgggagctctttttttctgttctttgataattttataagtaaaatggtttgtacagataattctactatctataggaaagagagcattaatcaggaacatgtcaaagcctgttggcaaactggccaaacacacaaactttgcttcctgcaaggacttttcagaatcaagtgtggggtagtggtaggcatgcattttctgatgaaaaattccttgagtaattctaatacaactccttatcctatctccattgcaaaccactatcacaaagaaagatcatccagtttttccaaatactgggctccttcctcaaaagtaggttttcaggaaaatcaagagctgattatttgggatctcttttcttgcttcctacaaattgataggggatctcttgctaatagaaaggaggaggtgtgcctccattccacagccctagctattatagaccctggcttagttaggagaatagttttgctgcctcacagagctggcggggagttgatggaagagaaattctccagggaagaaacactggttgatagattattcccagaaggcaggaaagggagctttacccatggctcagcatattgagattaaaatgaaaactgctaaaggcaaagaaaacattattctccttgaaaaaaaactgtatgcacataccaagtcaatggagcaaagtgggcagaccagaaagttttcttattatccacgtcatctgtaaattattctcttgatggtaaatcccccaaactgctcccacttggggtcctggctgacatatccaaccctaccccctgcactttatctgtcatgctcattttttgagaaacagatcacaagggctgttctagcaccatgttatccctgcataggacatcttccctctgagtccaggcctcatgtccaccttttcttcacccttctctcacacctcccttatgaactggattggaaattcaggaaggtaatctgaaagaccttctaagctttctttctctctcttagttaaatatcccagattttggtgtttcttagaagattgaccttagcctaccggagcagacagagcccaaggaatataaattgcacaagggtacacaggcttattggatcctcccaaaccttgaagatgctagcagctaatagtcctaatgtcttcctcaaaactttctcagtgcaaactaccctcttattcccacagctagaaaagttccaaagtcccccaacgcaagtgcttttgataaaattcttcaagccaagaattctctaactgaaatctaacatcactacttcctacattcctacttcttatgcagttttattttttgatagaggcagagaaagaagaagggcagggctatttgtatgctctgagctcaaagttgaggtgttattaaacttctctgtgctttcatatttttctggtgacccccaaagttcttcccaggtgatcacaggatgagtgagctagggagagaaggccgacccttaaaatgttttcaattttctttttcaggatcaggatatttgaggatattcggaggctcatccagccaagtgatgttataaataaagttgtcttcagtttagatgagccttggtaggtagtctcgtgcatctgaggaaggtggggcatggagaattctcttaatggcatgagaatagacatgtttcctgttaataatccactcctcctcctaaaacagcatgatgaaaatccaggttaaagatctataagagaaagcttagctttaagaatcatcggccaggcgcagtggctcacgcctgtaatcccagcactttgggagcccgaggcaggtggatcgtgagttcaggagatggagaccattctggctaacatggtgaaactctgtctctactaaaaatacaaaaaattaactgggtatggtggcgggtgcctgtagtcccgctactcgggaggctgaggcaggagaagcgcttgaacctgggaggcggaggttgcagtgagctgacatcccgccctgcactccagcctgggcaacagagtgagattctgtctcaaaaaaataataatgaaaaaaagaatcatcacactgttttcaaagagtagtgataacacatatgttcacatgttccttatttcattgtaggcctttgcaagacaatgcttccaattgtttacggttcttctccaaatttgagtcaggaaatcttcgcaaagccatccaagtgcgtgagtaagtaaggaaaaccacagtgggtgtctcctgtcagttcgtaagagcaagctgtgactatctcttccccatgctctgttcagtgaccttgcattggtggcttgaaatcagccatggtgggaatatttatatcataaaaattggcaaacagtacgagtgaaggtttttcctttcagagagtcatttgttaaacatttaccagtacaccactaagtgtactgatatcatagctacactgatatcatagctaagtgagccattcagtagaagtgaactgttattaatgtgtcttgtgtttcaaataatgggtccatatttcggtgtgagagcactttgactgggatgtttatactttgatgccaaggctgattctgttgaagggaagggtacatgggcttgctattcctgcacttctctatgcctgttgctctcattcctgtgtacttaggtggcaaaaatcatgagcttcccagagaaaggtgaaccatcctgcattcaagggaagatgcagtaccatgcctctctagcagaacctacagatgagctctcagtagaaaaggatatcctagccaaggaaagcctagggctgtacaaactaaaagaaaggaaataaaacacaaatgaattttacttctttttcagtgtcagaagagaccgcggttctcactatgttaaaattctttctattatagcagtgtggatatatttcccatataccaaaaggcaagatacatgattcatcttctataggtgaacttctgaaaaaacagtccagaacagataatggtgtggtggccatagacagacatcagaatcagagtgccagggtaacttcatcaccttccaaccaggagactgagcaagtttcctaactcacttcatgcctttatttcctcactcacaaaatgagaacaataatcgcacctactactttgggatttcatgagagctaagtaatacacttaagtctcttagagtagtacctggcgcatggtcagcacttagtcaacatccgttcttactcagggatgcatattcgccattgttggagctcagaattcagtatagctgagacctccctcatatccacctgatgattcatttttgaagttcttcctctttgggggaggtgaagggtgatttttttttttgtacataaaatatttcaaggaagcccaacaaataaaacagagaccagtttaatcaggctgaagacgggaaagacagtcatgtcaagactctttctcagccctctttgtgttgttggcttagtttccacttcttcctgtggctcctgcttttactatttcttctctccagatatcatgttcaaaggatccaggaaaggagacctgattatgagtctcctggtggaacagttatcagatcaggatgcggctaagctgctggcccggctcaggtctttttctctatacatttcccttggaccagagtctaaaatcctaaattcatcagttatggtcagggtaatagagtcaaatagcagaaacaaacctacttatgggtaaggaattttttatgattactttttggagagagcactgtgggaatagcagacaatttgagggtcatagactttccagaattgttcttgtgagtgccactccatggggttatgtgtcatgtgttgtgtggtgagcccagtggttagagtgtggtgcccacagagacagtgtgaggactagactccatcagatagctctactctgctctcatctgtcttataccaagctcagcgtttcataaatctcacacaatgccatttaccaggggtccagtgtgggagagtatgaatggattggggcaaaaacattttccttttcataagagcaatgcaaagagaataccaagaggatggagcaacatttttaaaaatgaaatatcctgataatgtttaagtcaaaactgcattgctagttctgttgctagagatcagaaaaataataatctttggagatatatagtgatggggagaggatccctgagggcctcctggggtgctggaaatgtcctatatctgggtagtagtcacacaagtggtttcagatgtagataaattcatggagctgtatatttaagatgtgtgtattttatagcatgggagttatatcacaatgaaaatgaaacaacccctgcattgctagcctaattcatgtttgttgttttgctgggggatgtatatttactaggttatttgatttttataaacagcacctcaagtttagacacttccattttccgtatgtggaaattgaggctcaaaagtaacgttgatctcaaatagcaatggcatatccaaaccagatgtgattgaattttctctggtatatagcacacttgcattttttctagctagataaaaacttcattatagtttaataaaaaggtgtgctaatatttcaaaatagtaaaaagactagaattggaatgttcttaacccaaaaagtgttaaatgcttaggtgatagacatttcaattaccctgatttgatcattacacattgtattattgtatcaaaatatcacatgtaccccataaataaatacaactattgtgtatccataatagtttaaaaaaatttaaaaatatgcgctattgtgtaattgactcttgtaatactaggaagccccctcacctccatgaatttccaaaatctgtacccaatattgtggtatcaggatgataagtataacttaccagctggctgagatcctgggtcttagatctgtaacccagaaactgaaacgtgtagattcttagtgtctgaagtttacctgaaagactttccagataaccctccagtcttgcttctgatctgcaggttcgagtatgacttgctggtcaacgcagatgtgaatagcacccagcaccagcagtggttctatttcaaagtgagcggtatgcaggcggccatcccttaccacttcaacatcatcaactgtgagaagcccaacagccagtttaattatggtatgaacgcttggggagcaggggctttctggaacatgccaggaatgacatttcttgactgtttggattcaaagagcctttgcttgggttcagagggtttgaagttgggcagagttttgggttgccaggtgcagcaaggcaggcagtggccctcagtggcacactgctactttagaggggaggctgggcaccctcactctgccacacattgacatccactgcttctggattccctcgctctaccttgaactttttgaggttggtgagcgttctcatttattccttctctccatctcctaagtcccataggagcaaatgctttgacctgctttttttcctgcaaggtagaggaacaacaaaatccaattggacaacactgatttacattcttagaaagctcttgaagaagtttaaattctcctgaatacccgtggccattttggaggagatattcaagagagaaaggctgacgagcaggctgtatttatttcaaatgttttgaggaatggaaattctgcatacaactgctgcatcatatactaacttgctgggtggctttgaatgaggaagaagtattcccaggtgtctaggtccaagtgcagggtactgtctctattttgtagtgactaaacagattcctgtgggtatgagaagagaaaatatgaaccttgacatttatattcactttgtatggctattgtaacaaattgtcacaaacttggtggttgaaaacaagacaaatctgttctcttacagttctggggttcagaagtccaacatcagtttctctaggctgaagccaaggtgttgggagaaccatgtttcctctgaggattccaggggaaactccatttcctttcctttcccagcttctagagtagcattctctgcattccttggctgatggccccttcttgcatcctcaaagctagtagtgttgcatcttgaaatctctctctgcttcagtcacgttgcattttttttttttttttttttttggcgagacagagtctcgctctgtcacctaggctggagtgcagtggtgtgatctccgctcactgcaacctccgcctcccgggttcaagcgattctcctgcctcagcctcccaagtagctgggactacaggcatgtgccaccatgcccggctaattttttagtagccgtgttgtgtttttagtagagatggagtttcaccatgttagtcaggatggtcttgatctcctgaccttgtgatctgctggcctcagcctcccaaagtgctggtattacaggcatgagccaccatgcctggccacgttgcatctcttctatagtcaaacctccctctacctccctttcacaaggatatttatgattgcatttagggctcaccaggataatcaccccatctcaagatccttaacttaatcatatctgcaaatctctttggcgatatatagttaacagtcacagtttccagggattaagacctatgtgtatgtgggggtcattatttggcccagaacaactctctttccctcatggattaattcctttctgattttgtgtagggatgcagcccaccctatattctgtgaaggaggctcttcttggcaaacccacctggataaggacaggccatgaaatatgttattacaagtaagttagagcgctgttagcttccttttctctgtcctgtaattttctctcaatttcccacttttccatattgatcttataaacatcagcaatctgtgcttgtctgctaaactttttgtcactctgtcctaatggccagtgtccggcccttcagagatataagcatattcactggcacgcacagtagacctcgagaaataccttttgattggctgaaagagtttatcttcatttaaacacattaaaacttttagatcttgttgtcagatattagaagtcatagagattctacctgtgattagtgtgtcaagccttagttctttacttatttccgctgaacccagagagtgaaatgtctgagatgttctatcctgtttctatccaccccgtggtttagttttccaaagtacaggagggtgaatatgtgacaattacacataagtaactcctccccatagcaaggtaattttgtggaaaaaaataaaagagggaggagtttcaaaattcatcttcaatccttgatcagtcgccagtttcatcagtttatcctgcaaagttataatgaactttaaattgtccatatattttgatgaaagaaatgcattccagccatctagattgcttatatgtacattttcttcagatgaaaaataaaattcaaatttataagaaaataaggatagggattgctatgagaggtagaatatatataattaattattagttcagtgctagtttcttttaaaaactgagagactagtacttactttcttaaataaagtaagtttcatctctttctgaaattactagcggcctctaaaaaagtatgatcagacattctagagtttgggatagttgtcactgtggaaaagaaacagagtatatacccttatgcctcttggcttttgagactttgaagataggagtattgatagatgggaaaggtcaagaatcttgttgctgtatcagatacaaaggcaaaaatcaccatggagataatgacagtctataagacacagagccaggctgactagcctgtaataaaagagttggaggtattcaatccctgatctattaggatatgaatctaaagaggatttttttatatcctttagaaaaattgcacaatattatgactttgttggttttccattcacctaaatggcaactactctctggctcacctatcttaagactcttagggcctttcctacggttcagagagatttagattaaaaatcacctcaaggtgatagtctgtaactgcaggaaaaaaaaatgaaaacctacttttggaccttggtgtgtcaagaatgacttttagttttctctgaaaatagttattctcagtaaatctgaaagacccagcttagagctggcttggacctgaaagttagtaacagattggacaaacataacatttcctaatgggatatataaattccagttgaggatgctcctcttggaattggggagtaagaaggctaaggggaccacgtatttcccacaagagggaagaagccacactttcaaaagcacagccttgacctaaggagaaccaatgctgatagcttttagagctattagcaagacaattactatgtgattaaagagcaacagagggataagaaaaaaaccatgaatgtataatataattcatttttcatattccagccatgaatacaacagagatgaatggataagattgctacattgtaatgtagtttgttttataattattcaccacgttgtgttaacatattcccaatactgtgatgtaacaacagggtagatatgtgtaatctctattcacccacaaattagaacgcctctctcaattgtaaaatgatgccttagattatgcaatatctctctccctatttacctatcctgatttttgagttgatttgctttagaagagttctttgcttctctcctgcctttattatctctggtatattaatttgggagaactttacttccctatttccttgtctccaatatatctttagatactctgctctatttctattatgctgttaaagtcccagatttggtgccatgttttaagaggatgccagggtgctcactgtggggacaactgtgagccgtggtacctgagtatgtttatagaagggtgaaaggaaaaaggagactcagaagaaatgggatttgcatttgcattttctttcagaagttgaagttgacagcaatgatgagcagttaaggacatgggctgactactctgtagggccaatcgtcatcaaatagtctccaaactattttgacaatgtgccactaatcaataagatatatttgtatgtgttcttaccagattagtttatacatttaaaaaagtgtatatgcattactatactaatatattatgcacctaagaaagcatgtaaaaaatgaagagttttaaattaggaaaaaaagatgaaataaataatagtttatatctacctaattgttacatctttatgctatttatagcttagggcacactagaattttgttgtggagtttaccattagatgtagttataaatagtctttttggtaattttgagaaattttgattaactttctagatctgattagattattttaacaaaaatgagaattaccgagaaagacctaatattaagggtaggggtaggctatgtccattctgccattttatggtcattttgattgcaatttaattttatcatcaatagatggcttctaagaagatttttctttaaaaagtaattgtctagtttgtgaggtttagtttaatttaggtaatacaatctgtaaatgaaagtaagcttctgtaaacttaaataccttgccggaagctaaaagcaaaagaaaaaggaggggagctagctgttcccacttctccctttggagacctctcccatgcaacaatcgatgcttaactaacatataaaaaccgtagatgcagaatataatgtgtttttcatactccagccctggaatacgacagtgatgagtggataagattgctgtaccatcatctagtttgttttataattacccaccacattaggctgacatcgagacagccatgccaatccccatattaaatagtagacaacttaatttctttcttactatctagataataatcattttaaggagaaattctaatattttctgcctgtggtcagttgatcaccctgcccctcccctggagcacctcccaccccttctattccacctcctgctcttccccaccttgatgaccactaggctggaaaataaaaaatgcccctcgagagggaggaacagaaatgggcagattcatttttccctgcctctcgtaaaagtaagcaagggcccttttagtttctttttttatttagttccctgtggtctgcttcttcctctgatgtgcacagccacacacctttttgaattctctcccagctctggtctaaagtaattttggtgctgaagggcagagggagggaagctgtgcgcttagagtggccatgtaatacacaacggctgatctcttctgacatttatctccgctcgtgagaggagatggaacagctcactcatgaagatgaatgtcatacaagagctctgccatcatgcatccttccatgggatctcaagagagagatctggtattatatagaatattagaaatgctgcagacacagggaagtctggcaacttcactgctctgccttattagatcctgttaaatgaaatgatacacccttgttaaacagagccattgtcattataagattatctaatccattctccatcatggcatttgcttattttatgcaccctgctgaaaagaaacaatgactttccagcatatttttaagtacaaatggaaataacctgagttcgtaactatgcctttgtgtacttgctccttgcttcattgaagtctttatgattataaaagtgcagatccttccaaagataaatggttcaggcaatggaaaggcaaacaaaaagccttttagctgtgaagttgctggatgtacccagcccaggtcatttttgaccccagatgaccaataggatccagctaatcttcaagatcactcctgattttcaccaggctgcttctccatctagatgaacagattgaggagaggaagttctttgactcaaacttccaccactcattaatggcgtgaccttgggcaaattataccaacttctttcagattcttcatcttaaaatgggataataatggtatctacctaatagaagtgttctgaagataaaataacatgagataaaacacgtgtaaaggttagaacagtgtctagtgcatagtaggtgttcaatgaatgctagcaattatttttaataattagtaaaaacatcttagtggcatcaaataccaatgatataaaagtcatagtatatggatcattttattagctctcatcttgattattttacatttttttctattattttagactgtaagttcataggcagctctgatttatgaagatcaaaacttcagattcttacttgctaccttgggcataagacatcttgtcctttttaacccattcctaagaagcagatgatataataaaaaaattttagtttctgagctaagcctacaactggggttgaatcctgtttactatacttgttgtgtggaattgctctagacacttaacctctgtgagccttaattcccatgtgtagaatgtgtgtaataatactcaccttgaaaggatgtcattagaattggagataatacattgaacaacctaattattactcctggagtcttgggtccgtgtattatacaaactttaactgaacagctgctatgtccaggcaaggtgggaagcataaagataaacagatgaataagcatggtccttgccataaagtattggccatgagaataggagtgataagggggctatcagggcaggcttcctgaaagaggaaacacttgagttaaatcttgaggagtgaagaagacttagctaaataaggaagatggaaagggctttccatacaaagcaagaacatgggaacaatttaacataggaaggatgaacattgcttcttgcaaacatcactcgatatgtccacatcataactgggaaacgaaaagaacttgttgatgggatctcagtttatcatggatgaactgaactgtagcaagccaggtgtttcactttagagatttatcaaacatttggctttgaaggtcctgggaaagtttaaaggcctctgcagaggaaggtgtgctggaagcagagtcatctcctggacaactcctgctacaaggtggctgccaggagagtccagtggggatgcctgacatttgctttaggttcagccagagtttagaccccagacaagggttgtaactgaatttcttttagctgaaagtcattctaaataaggtgtttataataagattttttttttttttttggaattccagcagtgtgcaaccatcctggagaaggctgacttgttggtggggagcctttagtcttgctcgggagaatctaatatcaccaagctatggggggtagcatgttaggagagagagagagagtgtgtgtgtgtgcatgtgtgtgtgtgtatgtgtgtgtgtgtgtgtgtgtatgttggtggtgtgagaagacagatttgacatagtcagaactaccatttgaattccttacacttcccttaaatcttgagcccatggaagctcaagagctaaggattagcccattttatttctctttccatttcactgcagctgttttttccttggagtccaggttttgcctgaatgagggaaagaacatagagataaatacatggattttattttttctctctctttcttgctgtctcctgtggttgaatgtggtgaggttgagtttgcataggctaaatgtgcttgtgatgtgactttagtgtactaatagtgcagtggggaacctaaaaagaagcaaggcccatgccaaataagaccaaccctactggcccttcgggacacctattatttttgagtcaagatacaggctctgtctccaccatttgtaggtgaagaactggggacagtgaggcacaaggtgcgtgtttccatctgcctttacattcatgaatacatgcacatctgtgtgtgcactcacacatatgtgcttacaagtgaagcactcttccacgctttgattggttatccctggatcattttatttcaactgctgtttcccgtaaagaggagtaattgactagcatttgttgttcagcaaggtgtaaactgagtgtatgtttgcacggaggctttacaagggaaatcagaaagcaaataagaggtagagcatatgtaacttgcatgctttccgagctaccatctgcttctttacgtactttctaataaccagagtcatagcttttggagaagcttcagaactttggggcaatctggcaaagtagacctaattagccattgcgatccatatcacaccatgtgggaagacactattttaaaatttctatttctgtgggcataaaggaaacggattctattaatacaatgccaaaaacctgggtgtgacagccactgggggcttatgttgttacagggtaccctcctttccctagcatgaccaaggctccagattgccatgttggcagaagctgagggaaggaagataaaggtatcaggccatagtcagtgggctaccagcttcccttagtcccattccgaggtgtataaatattgaaaagccacaaaaccatgagaaataaaaaaacagattttctatctctttcttccatgcttactttttgcttaggtagggagtggcatgaaagtagcaaaaaggtagaaaagaataacccatgtttgttttatttttcaagaacacacaagaataattacctactatttcttcccttccccttccctttcccccagtaaaaccaaaagcacaatggactagtaagccaacgttctaaatgttcaaaggtggaattacatcttggtgtccgggtgtattttgcattataatgcagccttgatgataacatttctcaggaaagcctgtgcagctgtctcagcatcagttggcagcgtgtggggaaaatattgctcggaatggacttctgggagcaattttctttgatactgttctctgaagtatcaaaattggttcttcatctttgacaaaggaaaatgtgcactctcaagccttacgaagctgaaccacatttgaggtgacaaatatattcctttgggaagaaagtattgtacagtggaaagaacaaagcctttgcagccagagagatctgggtctcagtcttgtatctaccatttagctttgagccctttggcaaattaacttttctaagcttttgtttcatcatccacatgatgggttgctgcaataataacataagatgacatatgttaaatgttgaattggaactccatatatcatgtgattgctaataaatctacttggcaggtggagcggaaaggaaggagttgaatcctatgtggtctggggagagatagggattgggggaacccaaatttgggtgataaagtttatgtctccaattgaaacccaagaaaaacagaactgttcagattttcctcgatgttctagctcagtgactatatagccctcattttcagacagcaaggaaaggtcggtagcatatacggcacaattgggaggcagatgggccaggctacatgttgctgaactgactcatgaactggcagtaagtttacttgtacatttcccttttctcagtttcacccacagaaatgtttcaagtgaaggccattgtgccaggacagtatataacgcacaagatttatagcatctaggaccctaaatgaccctgcacccccctcccacctctcccttattctcttctcttctcctcctctctctttagaaatcattatcgccagagtacagctgttgcaggcggagcatctgggaagtgctactataccctcacctttgctgtcaccttcccacacagtgaggatgtctgctacctggcctaccactatccctatacctacacagccctcatggtaacttcctctttatagcatcactccagcaggactgaaggggctctctgaggttttcctgggaacattttggagaccctgacatcctgatggggtgcagaggggaatgtaggggaactacagccttcctaaaggagccaggttttgttgttactgacttggtgctttctaattgtcccatctccttccctggacagagcacaaggctgagccttgatcagtgacattccaaaggcccaagtggtctgcaagttggggcaggacatgggggcatttcttaagagactctgtctttaaaaagtcaagttaagtatgaagtaggttggagttgtatggggagcaacaccatacaagtaagctgagatgcaaatctgaagaaaattcagtcattcagaggaatggagaaagcaggaaggtagatcttgggaaacttctgagtctgtgtgcaagtagccacgccagcatctccagtggttccaatgaccatgagctggaggtggctagaaggatccagggtggaagagaaaagtgtaagaataaaacactagatcattgcaacagacagccacaatctttttatgagggagagtagaagaagtcagtgcagactcacagttagcattcctgtgtaccataaggccctgcaaaaagttcacaagacaattgtgagaaaatggactgcttaaaccatgcagctttctgtcatttgaaaaagctggcaaactaacccttactgctaccatttcgtggatatcctgaggataaatgaactccagtatcttctataaagcactttcatcctctatgttaatgtaaaatgttattagcatatttataatcatatgtgtgtatatgggtatatgtatcacttagcctgaaggatgagcattttcattttaaggctgtgataaggacttggaaaagataataaccaagaacatcttttccttcaaaaggaatgtgcaggtataaatgtgaatttttcgcatagagaaggcatatcttgaaccacttggctcactgcttcatgaaagtgcatctgtcctcttctccatatgttgtcttgcctaaagagagatttttactgttttccagattgcaaaaaatacacaactagtattatttgtgtatcacacttagagagctcaagaagttaatccaagtaatgtgcgttgcaagctaggctgtaacaagccacatttgttataaaacatgttttgttgcctttagggacacagaacaggcaacattcatctcccttcaacagctgtttttatggtcttgcctgtgaaacactgcacatgaaaagtctactgtgggctgggcacagtggctcactcctgtaatcccagcactttgggaggccaagatgagaggattgcttgagcccagagttcgagaccagcctgggcagcatggtgaaaccaccatctctacaaaaaatacaaaaattagccaggcctggtggcatgcacccatagacccagctacttgggaggctgagttggaggatcacttgggctcaggaggttgaggctgcagtgagccaggatcacacaactgcattccatcgtgggcaaccaagggagaccctatctaaaaaacaaaaccaaaagcagaaaccagaaaagaaaaaaaaagtctgctagggatggggattccttttaaaatacgtgttatgtgtttgcctttcccattgggtaagtgatcatggatctaggacactgttctttttgcttgttagaatatcttggactctgataaggttcctggtggccattcatataaaacattagaatgcaaaggggttgggtgaagttgtctaattcacccttaacgtttatagatgcaagaactgagaccggaagtcccacatttagctagcagccatgcaggaacagaacatcagcccttgaggtgtattcctgtggtctttctactcccctgtagaaaagtgtagaagaaattcagaatttctgccctggggtcagattagtgtcattgcttgccattacattcacaagctgctaaaacatgcagtcgttttatgagtccatgtagtcatcattgtgtgatgatacagacatctctaatgtttgaattcaaaccaccagcccacagtttttatctttaatgctgagtgccgtggatgtggttcagctgagggataatatctctttccaaacatggtctaattcttaccccaagatgctccaatggattcttgctaggtgcctacacactgattcaaattgtgtacccctttcaacctggccttgacttgatggtacctagttgtttaccttgtgcctctgggcctgcttaccttctgggcacagtttcagataagaatacagggtctaaaatttgcaattgataaataactctaagaaccactgggtggggggtcaatgaggagaagatttcatgttaaagggaaacaaaacacacaaaaaagaggacccccctctctccaccagtcactaagtttcactgagagggaaagagaggccttgttaattgatgcttattggcttgttactgttaacaatattaataactattactgttactattaattacaataagttataactacttacgactttttattgttacttttgagcctactgactgtgaatgtcttcctccagggaagtttgtggagagttaatgagaaagagggataacttatttctcctaaatgaacaaaacagggttagaaagacaatttgttacttaaaagtgacaaatgtgtattctcaattttaggttttacatttccaataactcatggtctttgtcctctctaggtttaagacaataattgactctgtgacttctcttaaaaaaaacttcctcccatcatggacaaaatgagtacattctgtaatgctaaccagtcatttttgtttttggacatgtcctgaggagaaacggtttttcttccaacagatcagtgataaattaaatgcgaatgataccccaaggggagaattaactgtatgttacttgggggttatgctgaggggtagaaaatacgtttccatgtggaattcataatttgcgagtctcctataatatggattacatttagtaattacagacatttttatagcataggacttgtatgttgaatgtttttcaacgtgactacaattttgaaactctcaaaatttttttattctcttataataaggaaattagtatttggttctttcaaatggatatcttccagatgcttgccagcaagtctgttggataatcgttcgttttatagcattcaaatatagctaaaagaaagaaatatactattgtaattctgaagcaaacaaaaaagctctattttaatcagccgtatcaagttatcagtaattgtaatgattgttaaagtgttagcaataatcgttacagtattagaattatgttataaatagcccctaggtagccagtagtattggttgaaaatggggccccaagagagtttctgatgaatattttaggaggtaaaaaattgggatctcactgagaacttataactgtatgaaatgacaagagacaacaaaagcggtcattagcagagtccatgtattgggggagcttaaggatcttaaaggatagagcagaatttttaccagacacatatacccactgtgaaagatgtgaatactgttatctccagagacaggggtgggatggggaggtggggggaggtggaagaaagagagggaagaaagaagaagaaagaaagaaagaaaagaaaaggaattagaatgccacatgcacaatattttataaaagactcagaataaatgaagagtttaagaagtgtccagtgggaaatgttgacttacatgtggcatatcgaagatgcaatgagcaggccataaatcagcactgtcaagtaatcagtagacagagatccatccttgtataggccaaacaaatgacagaccccaataaaggttcttgatgttgaagaggcgaacatggaaagccattctgaagaagccaatatgtgcatgaatggtacagtctttgacaacaaggacatctgaattccagggtcttgggcacaaagaaagaaagctttgaggtcagacaggcctagattttagtctaggtgttgtgtttccttgctgtgtatccacaggcaagctatttaacttctcttagcctcggttttctcatctgtaaaattggaaacaaaaaagcagtgactacataggctatttcgaagattaaataattgctaattggaaagttttagcaaagtgtctacatcttgtaagcaatactagatggtaaccattaaagcatttattgttttttatgatgatgtgcgattattttctctgttggactgattggaagatacccgttccataattcatactaaaattaaaataaaaaaaaaaaaacaaatggaagacccctcctcaaaaattacaaaggctactgatggttttcttggggtaattgattatgattatttttttcttactcttttttccaaatcatcataatatagctttgcttatttttaatggacaaggaatattaaaccatcctttctttataattgacaaatctgtgagtagatatctagagactaatcatttctcacatttttaaagttaagtccctttaacttggggagcataatattggcagactgggacagtttgaggaagctcatcagaacatgcctgtagcatattcttgtaccttttatttagcttaagggtgttatttgttcttctcttgtgataagaagtctttgattctctgatgagtgtatttaagtgacaactgagatctaggcagtagacaaataaagtaggccatctccttaggagtgggctttcttctaaattaggggaacagagagtgcagcagtttagggggtaacaatagaaaatgaatggtttttgagtgcatagtgcttctcactttatcagtagccatcagcaggttaccctgctgaggtcaaggaagtcttttatcaaagttttaagggagtagttgataaaggaaagggagactgaggactcctgtggagagacacaggatgaggctgcaggctaaggttatcagcttgatattgttcacagacaggattttcttttaagaagtcagtctctctgggggtttctacaattgccttaaactcattcacatttttataaagaaacccacccctgtggcttccacagggctgtaattacagtcagttggcacatgcattcagaggtcctacttttctcatcaatgatccccacaatatccaattaggcataacttttctggaccagagatgggagatcatttttaggagaacaggacaaaaccatttttgcaaaaggaaatccaacagaaatttatacttggtttacttctagcaatcttttatatgactgaagtcaaaataatcccctaaaagtagaagtgttaaatacttgctggacctgatggcaggtccagcaggagggagatttcattgaggggtgcagggagatggatccatgaaaaattgcagtttacagaaaatgagtaatatggtttggctgtgtccccacccaaatctcatcttgaattttaggtcccataattcttacgtgtcgtgggaattaattgagtcacgggggcaggtctttcccatgctgttctcatgatagtgaataagtctcatgagatctgatcattttataaagaggaattcccttgcacatgccctcttgcctgccaccatgtaagacgtgcctttgctgttctttcaccttctgccgtgattgcgaggcctctccagccacgtggaactgtgagtcgattaaacctctttcctttacacatgacccagtctcgggtatgtctttattagcagcatgagaatggactaatacagtgagcttaagctaagagaatattaggcatttgttgatttgtaatattattgtggaaaatgtaataataataataacaaattaaaagataacccatgagagaagaaaactttcaggctttgcctcgtccaacatttgctgcttgggagcctgtccagccaacactattttgaaggacagtgctcatgtgccctatgatactttttgactttttgtctctcatagctaatactgcttggtggcttctatagaccaaccttctgcctaacctgcttccgcatatctgatttataaaatctagattttatttttttttaaagtttgatatcaggcaccaaagggctatggcttaattgtaatatcacagaatgacgactactgctttttgtttttcatttatttgttcccccttctctcttttttctttttctttttttttacagattgtgtttattatttatttttaatttatttataaaagtttcatttttaattgacaaataatacttgcttatatttatagggtacaatggggtgtgttgataaatgaatatgttgcagatcgatcaaaccagaccaataaacgtatctatcacctcacatatttatcatttctttgtggtgagaacacttaaaattactcttttagggattttggaataattctgtgtattattataagctatgattactatactatgcaatagatgaccagacgttattcctcttgtctaattgaaattttgtaccctttctccaacatctctccattcctcccccttgttcccgctcctccaggccctggtcaccaccattctactctctgtttctatgagtttgacttttttatatttcatgtataagtgagatcaggtggttatttgtctctctgcgcccagcatttcacttggcatatgtccttcagggtcatccatgttgttgcaaatgacagaatttcctgctttttaagactgaatagtaatccattgtgtatgtatgtatatatatatgtgtgtgtgtatatatatgtgtgtgtgtgtttgtgtgtgtatatatatatataaaactccatcaatgcgcactgtggtcgtttccatatcttggctcctgtgaataatgctgcactgaacataggggtgtatacagatatctctttgatgtactgatttcagttcctttggatatatacccagaagtgagatggctggattgtatggtaattctatttttaattttttgaggaaacttcatactgttttccaaaatagctgcactaatttacattcccaccaatggtgttcagggttccagatcctcaccagcacttgctatcattcatctttttgataataaccaatctaacaagtgtgaagtggtatctcattgtggttttattttgcatgtctctgatgattagagatgttgaacatatttttttatgtatctgttggccatttgtatgtcttctgttcagaaatgcctattcaggccatttgcccatttttataaggttgtttgttttcttgttactgtgtagttggtgttccttgtatattttagatattagccccttatctgatgtatgatttgcaaatattttctcccaatttgtgggttgtctctttgctctgtgaattgtttcctttgctatgcagatgccttttagtttggtggaatcctattgtctacttttgctttgtttgtctgtgctcttggggtcatagttaagaaatcgcttcccagactaatgtcatgaaggtttttccttatgttttcatctcatagctttacagtttcaggttttatgcttaggtctttaatccattttgagttgattcttatataagggatcaattctcattcttccacatgtggttattcagttttcccaacaccatttattgaagaaactgtcctttccccattgcatgtttttggcacctctgtcaaaaatcaattgactataggtgtctgagtttatgtttgggctttagttgagaaagcttcaccactggcaaggacccatgtggtcataataaaatgtgaaacaaacagatttaataagaaagagagagagagagtgagctcatagaaataattcagcaagacagtgtttcccaaaacatattcaatagcatttcagtctcttgagaggtttagagaagaaaagtttaatggtcatctaaatttatgaagcactggtgctagtttttcttctaacagttcacaatgcatattgaaatattaaagaatctgaagaatcctgcatccacagaaatattttcattttctttaactcaacattttctaagcactttggctatgaatttcctgccttctccacctccttgttcacaccacagcacttacacactacgggatatattttgggaaatgctgcaaccaagtttccctttctggctttagagccttggaatcttgatagtaattgtgaggcaggctacatttagtctagattttgataataaagaatactgagagcagctgtcactcaaatgtttataaaaatcttaaaaataatttgtttatgatcacagagactataatctgaatccagcactatccataccttcttaactaaggagctggaattttccttttccaggatgacttagaaacgtgactgatattctgatggagacatttccattcttcttctgtgccatctctcgtgggatacccagatgtctacttcttatatcagggctttagttaataatttaatattgatttttgtaacctatgaatttttttccagtaagcttcttttaagaggctattttctattctctagtggttattttatttttgctgtttcgaaaaccatttttatttaagtctaatttcatttaattgtcagaaaatgtgatttgtataatttctgcttttttgggggaataatctaatgagtttttaatagctctatgtatgatcaattattgctacagttccatgaatatttgagaaaaaattaaaaaatattctctggaaagacaaagtttgacatgtgtctacaaaaacaatattgttcaaatactttatattattatttttatgccattgatttattcaagaccgaggtgctgtcttaaaatctcccactccgagaagaattttttctctttctgctgttttttgtgttatatatttgaatcccatattatttgattcttaagatttatgagttttatatgttcattgtgaattgtgccctttatcaaaataagatcttaaaatcccatttaatgcacttgatcttgaatatggcttcattgtatattactattgccatgcttgctttaatttatgtttgcttatgcttttagtttcaatatttctcctttaaaatgtttgaacagaggcaaacaaaataaagagataatttaagagcatttctcatacacattttttttcctttctctcctttaaaagtgcctcttatatacaacatgctgtgggattttaaaaagtaatccaaatttttgtcattattaaggctgactagcctgtttatacttaaacagtttttactgttacttgtcattttggtttcatgctattttccatgcctcaccgctgttgtctctttttctttttttcttatgcaatgtggaccatcatttctttcattttttcatcctcagggtttataactttactagtgctttctttttactacttaaagataatatatttgaacttatacttctccattaacagctaacatttattgtttcctacataacagatgctcttcacatacattatacaactaaattatagcaaccactgcatgagataggtaatgatgtttttatgtgccttttaaagatgagaaaactgagtcataaagaggttaaataaaaaatttacatcagttttttcagaatccacgcaaccagaatgtaaacccagatttcctccattccttggctcatggtacctccctccacgttcaaagccaaaaattgcatgcctcttacctccttttccattacatcccatctcctcctttggctctgacttcttatctccttctttcacttataaggacctttgtcattaccctgcacccaacctgatgatccaggatagtctcctcatctcaaatttcctaatcacatcttcaaagttcctttactgtgtaaaataacatcttcacaggttgcagggattagaatatgggcatctttggagggccattattctgcctatcacaccaacataagcaataaactcaactctgttttagagacccattgttctagtgatattctagagagtttgcatttatttggcacaatactaagtactgcctttcagttttcaagaattaaataatattactatatcgatgtaagttgaaaacattaacattttgttccacctttttcctcccttgtacatctctttttaagttcattttagagctaggtgatgacatcaaaatttgataatgtgtactgtctccctaaagaattattttttaatgtttatattaatatagtaaccatatttttagatagtcatttagatgtaagcttgtttaactgggttttattttagtctttttatattgcttttctgtttgatttgggggcagctgaagtgtgtcttcaagtccttcttttctttctttttttttttttttttctatttttaagacagggtctcgctctgtcacccaggatggagtgcagtgacttgatctaggctcactgcagccttgacctcccaggctcaagtgatcctcccacctcagcctcccacgtagctgggaccacaggtgtgcaccaccatgcccagcaatttttatgtatttttagtagagatggggtcttgccatgtagcccaggctggtcttgaactcctgagcttaagcaaaccacctgcttcggcctcccagagtgctgggattacaggtgtgaaccactgcacctgggccaagtccttattttcttattattttttatttattttttttattttattattattatactttaagttttagggtacacgtgcacagtgtgcaggttagttacatatgtatacatgtgccatgctggtgtgctgcacccattaactcgtcatttagcattaggtatatctcctaatgccatccctcccccttcccccgaccccacaacagtccctagagtgtgatgttccccttcctgtgtccatgtgttctcattgttcaattcccacctataagtgagaatatgcggtgtttggttttttgtccttgcgataatttactgagaatgatgatttccaatttcatccatatccctacaaaggacatgaactcatcattttttatggctgcatagtattccatggtgtatatgtgccacattttcttaatccagacttggaaccaacccaaatgtccaacagtgatagactggaccaagtccttattttcaataaagataaggtagtatgttgtctgagcttttgtatgtctgagcatacatgctacatttgctcatgagcaaaaacttggttggatataggtttattagattataatcccctcttctttcaagatctaagcagtactcatttcctctagcatgtagtgttgcagaagaaatatgagccaagaatgatttttttgtatacatatatgtacaatgggtttatttatgcacacacacagagacacatacacacacacaccacacagagacacatacatgtttaaaaataatcttcagtgtagcatgcaagtgtcattctatgcaacaatgagcagtgagttaagattggcaatcaaacacacaggttaggctttatccagaagtaaatttacttatccataagaaagaatacagagaaggcaacaaaacagcacacatagaaagggcttagtgagagtctggactcccaggcacagcttactttgtcctagtaactcctcactatggaattatgtggtcatgagagattaggttgagtgggacatatccatctcagcctaggaatactatcagccttgggcttccttcagatttcatgcttagctagttgtgtaggttgtgtgtgtgtgcttgtgtatgtgtagttagtcatcttgtattctcaggggtatgtggctccctcccaatctccaatgcaggtgcatctcatcaatacctgatactcgttatttgatggacaatcataacaattacatacaaagatttggttagatacatgggcctctgctggatttttatttatcttgaatctggtataaacatgcttcttataattcctttacttagtgttgtgtcaaatcctggctttctggaacatcacaagaacaacctgtttctaagacacagttgggtttattgctcatgttggcatggtaggcagaataatggacctccaaaatgtccacatcgcaatcctgtgaagatgttactttacatggtaaggggactttgaagatgtgattagagactttaagatggggagattaaccttgattatcagattgggtgcggggtaatcacaagagtccttataagtgaaagaattagataagagaatcagagccagagaaaaaaatgggactgaatggatgcagaagtcagagtgatgcaatttttggctttgaaggtggagggaggtaccatgagtgaaggaatgcaggtgacctctagaagctagaaaaggcaagggaagagatcttgtatagagcttccaaaaggaatgcagccctactgacaccttgaattttgcccagtgggacccattttagactactgaccttcagaactataagataataaatttgtgttgtcttaacctacaaaatttgtgatgattccagcagtagtaggaaactaatttacttgacaaaggagaaagaatgggacagagtcttactagtgtctcaaagggcagagggcaaagtggggatatttattgagaccttaaagcctggcttaaaggcagatattttaatgtgggggcattgattagggttgggtaaggatcaccaagtaatggtttaagattggtggacactgtaaggcaaggattttgaaaaagggtgagaagagggattcaaagaatcttggctcaaagatgggttgatgctttctattgaagagttgatgggatattcctgaaatgaacaatatatttatttgtaatttctgtcttcccagagcagtaaggttatgctgatgaaggttggggaataatagtcatgttaatgtagacagtaagctatgtgtgggtaaatgattttggttctcagttttaaggagaatatgactcaaggtcaaattttcaggtgcccctgaggctagagaaaggccatagaattatctggtaatcttttcttttcttggcactttttctttttccttgcaattcaactatttcagtagagtataaataggttttagtctattcctattcagatgtcgggatttgtacttactttaggacattctttttcccttgtatgttagttgtctattgctgcagtaacaaactacaaaaaatgtagtggcttcaacaggaacaggtactttttttaaaaaaaattgtacagctttttaggttagaagtttgacatgaatctcactgggcgaagaccagggttttggggttgtgtttcttctggaggctctgtggggagagtgtgtttcctttccttttccagcttctagaggccacctgcattccttggctggtgatgcctttctccatcttcaaagccagcaagggaagactgaggtcttatggggccagcagttgttctctgcagccaggaaagggcctctgcttttaatcatgttgtgattagattggccacaactggacagtgcaggacgacctccccatttcaagtagaccttaatcttaaacatgtctgcaaagtccctttcaccatgtgaggtatcctaccaaaggttctgaaggtgagaacgtgaacatctttgggggccactattcttcttaccatatctgtagtaagttatttccacatgtaaatacttcctctaccttttgaagacactacttccctttccatatattttatatatttgtcaatatttttacatattcattttattaaaaaattcatgagttttttgtttcatttacccagcaggctagttatttgtcaagaaacaaggtgggcggtttctccttggccctcttaatacctccttgattgtggaaaaaactttctacattttaagctgggaggataatttttgggcagtggtgtttttgtgctacagagggggcagtgtttccctctctggttactgaaatttccactgtcaggggatgcagtgcaggtggggaaaatctcttagcctctctatgactggtgcccctgttttgattagggaaaatttcttcggaattcttaaagattgttaaccaggggcgggatgtggtggctcatggctgtaatcccagcactttgggaggccaagcagcgtggatcacctgaggtcaggagttcgagatcagcctggccaatatggcaaaaccccactctctactaaaaatacaaaaattaactgggtgtggtcgtgggtgcctgtaatcccagctactcaggaggttgaggcaggagaatcgcttgaacctgggaggtggaggttgcaatgatctgagattgcgccactgcactccagcctgcctggttgacagagtgagactttgtctcaaaaaaaaaaaaaaaaaaaaaaaaggattgttcaccaggtgtcctaatttcaatggctatttcatttttttttttaaatgagtattggggaggtatggtaggaaaaatttgttgctattagttagttgttcttttagcttagcagtccccctggattaaccacgtctattattttttcaatgtgctcacatttctccctattactttgccctgtgatactatgtgctgtagaagttttctgtctcattttccccagtgttctgggcatgttctattttcatgataaccacatttttttttaattttaaggaaggcatgcttagatttgtctcttttctttttaaattgtttgctaatttttatttgtacaaatttatgggtacgcgtgaagttttcttacatgcatagattgagcaaaggtcaagccagcacttttagggtatccatcacccaaatgacgtacattgtagccattaacacatttctcatgatcctcccccaccccatcccctgacccttccgagtctccattttctgtgatttcctcgtatgtcacagcgataggaagagggctttatgcccctgccctcctccctcttgctttcagtgcaacttgaaaacagatcttctgttatgccaaaacatgcaggaatgatgcttcctgctcagtctcactgagtttctcctacacagtagaaatagcccccttttaatcactcaaggcccaatacataaaggacagattagattaacaacaatacttctaaactatatgtaagccgttgttgttttctattattgttgttataaaaaatgttgataatatacatgcctgctttatttctgctccagactcatcttgacatcctggaaaagagtgtcaacctcaaagaggtctacttccggcaagatgttctctgccagacgctgggagggaatccgtgtcccttggtgaccatcacggccatgcctgagtccaacagtgatgagcatctagagcagttccgtgagtaaaatgggatcctcttcgtagaagatttgactaagggtgtcctttatagtcttggaagcattctgtctcttttagatcaaaagctccataaagggttggagactgtctgtctttgtagaaatacacccccagcttttcttggtgtgacacaaaggttaaacattaatgttgctttgttgttaaagggagagaaaatgaaatgaattcaaactgtccggcagatgaaatgacagtttgctaatgatggtcacttcctctcttaaaacagaaccaggaccctgaatcatattttccaacttctaatccagggacttttctcactgtgctcactgctgttatgtgactctcagtcagtcaaggtttggaaagaaagaaagttgagtttttaagccctggctaaagaatccccttgataacctgaataccatttgtgtctgaagggctgaagatgtggacaggctctagctaagaactttgaaacaaagtcaaagccaaactcatgcacacacacgcagacacacacaaatatacgcatatggacatatagacaaacacatagacacatgtagacacaaacatatacacagacgtgtagacacaaacatatacgcctagacgtgtatacatgtgtagacacaaacatatacacagatgtgtatacacgtatacagacacgtacacacaaacatctttaaatgttgggcttctgtgcctaagtgcatatgtgcgactgacctgttgacctgttacgaactagcttttgaaaatggcttctgacatcatttcagaccttaggtaggcaaaaaaaaaaaaaacaaaaaaacaaaaaaaaaacacccaaagaatgaggaatgttttgtgatacagagaagttttggaaattaaagaagaagctggatgcccagcttaatttatccccagaagatactgccttccgtaatgaagatacagccttccctggtgaagatacagccttctctgaggaagatacagccttccctgatgaagacatagccttccctggtaaagatacacccttctctgaggaagctacagccttctctgaggaagatacagccttccctgatgaagacacagccttccctgaggaagatacagccttccctgatgaagtgctagcctcattcaggtgactctttggtagatcggaattatattttctcacaccccatcagcatctgacaatggatgcttaacaacctggcaaatcaacaaccgattaacccatctggattaatgaggccctaaaatgctttaatgaataataagggattttccaaaaattctcttctgtgttttatgcatttaagagcaatttctgtaacagtcacagagtaccccccgtcagcagatgagcagtgcttgggagctggagacagcaatcctcccagggtaactttcattgaacaattatttatttaagaaagtggatgtgtgtaagtctgagcttctttttctaaaaaagagttgagcagaactctgatgtatcattatgacatagaagtgcctccgtttttgcattttgtgctgacattggtgtttttgttgctgttataaatgtggagagtattcttactttaagaagaggacttgaaacatgcaaaggcccttaaataatctggcactccaacaaatagttctgttaaaaaaagagagagaaagagaaaaaatatctcttagtacacccttatatgaatcaaaagaggctggtttctgcttgctctgtaagatgggttatagtaagtgtacactcttatgatcataacagcttttttttcttttaaacacatgctaacatatccgatgttcatctcaagaagtatcagataaatgctatgcattttctttttgtcacttgcaaatgacaatcattgagctagatcctgaggaaaccaggctttgacctagatgaaagggctagttagggccatcttcataggtgtgtcacctatacatttgcagagctctcctgcttagaagggccatgcactctgcttaatgcttttctgctactatctttataaaattctttacaaagttttaaacaaggggccttgccttttcatttttctctgggccctgcaaattacatagctggtcctggatgtgatttaaggtcataaaggtagaaagtggcaaaggccagtgcctttctgatactactcttctctgtttccaaattatgcatgaagagctttaaggtttaacctatttttcccactccctgaaaatactatttgtatggattatgtagctgattggtatctttcatcatggggattaatttcaggaccccttattttacagatggggtaagtggagctcagaaaggttaaatactatgatcagtagaggtgacagattttcaacattgttattctgattccagactccacacacacaacaaacgtgctgactcctttgttataacacatgttcagcatcaacattttggcttcactcttggagccataacttcctctcttcctcattctgtcctcaaattattagatactagctgagttgttaaagcatttatgctaaattgaccacaaataagtgtattactctcttcttgctcacaacgaattttattttcctttcctaacccaatggaagcattttcatggtgaatgcttcagatactgtggcaggaagggagaaagaaaattctttctgcctgaaggcctttcttcatacccagcagatcccagcacagagctgagattgcatgacctaagccacgtgctggggcacagtttcagcagggctacataataaaaatgtatacagggtacgtgtctgtgtataatatatatatatatatatatatatatatatatatggtaactatatatatatggtagctatatatatataggtaactatatatatggtaactatatatatatgaatatattcttatatatatatgaatatattcttatatatatatgaatatataaacacatgccgttgctgtgtttctaaaagaagaaaaaaaacccagcccagtataaacactgcctacccttcaaagtgcaaataaccatgcctgtaaatcagaaatggaactacttattttcctttgaattataaaatgtgatgtattgattcaggagaaaacagcaaatgagcctgcagctcaagattctcctgcctccaggcctcccttcaggtgagattaaattgttttacctgcttcctgcctctcagggactagggtagcttcagtgtgggattgcatttagctgcaatttagctagtttctggttcagtagctgtcactcacccctcataaggaggcatgagtggaaataaaggttttctctccactgtgtgggattattacttgagtcttactttagaattccatgaaataagaccacggctatggaatgctgggggaactcccctctcaaggctggttcccctgatgatctggtctaaagtcctggacctgaagattactgaggacaacttaatgattacttttagttcctcccagggtctgagctccagagagtcttccaaaagtgtttattttgtttgatttatttttcaaaagcattttctttttaaagttattttcctgaaaacattgagccttactttcttgataacttattttcagttgagtcgtcaccagatttgccagctgtgtactttatcactatttggagaactgaggacagtccctttttgaaatgctcccaataaagaagacttactactttacaccttgatatttgagccctcaaagccaaactgtggcaggtcttcaagagcaaaatcattctctgcccttttcagtgggacagtgaacagggaagttctctgggagattgtcactgaagtcattatggaagaggggggcttaaggagaaaatgacggtagcagggaacctttacaaaaggatcaacagctcagcctggcatcagggactctgagtgatgaataggcgttgggcagttaggaagcccaggcccttcctaactagtaggatttgggatgtcaaaggaagccaggcagggcatttgggttttgcacagcagaacgggagtgaggaggaacacacagaatccaagaaaatggaacaggagctccaacaggttggagcagaagatatcccataagctgtttgggaataggcttggtaggcacgatcagtccaggaaattcttttcagtgccttctgagcctagtctccattggttaatggtagtctggcataattacatttagcctacttaaatccttcaacacattatatgtgaataggtactttgattagcataccctttgaatatgcaagcttccaggtagatttgagaagttttctatctttagtttgtatactcttccagaatgggatatgtcggtgggtggtgtggtatctcctttcttaaatttgaactgagagaagatgctgaatttaagcagaactaaaaagcaatcagaataaagagtcttggggggtcattatttatctaatcctggaaagaagaatgattctacctttgcccagactcagccatttccgaaaaaccatgcctgttttctgtttcttctcacacagatggagttgcctttgtgtggaaattcctcttagtaatgagctcttggccttcctatacttgttgtcttacctccattttgcagatggcatccatcaaacatattcccagatacccctctttaggctttggtcttactggactattacccagaaatgcacacaaccagaacacactacttagtgaaggctactatcatttttttaacttctccatttttttctccacattgctctcacaacctcgcattctaaatgaccattttagcctggagaaagttgagtcccattttagtttggagagctatatctctggaagatgcttcatttttcttagaaagtttattgccaaactggacatctctacatttagaccctataacaacattgtcttgactgtcctcatgagtgatctgagagaaggaatgaatttgtgggaattttctgagggaaaatgtcattctcctattagaaaccctcattctctaaatgaatagtcacaggctgattcactggtgagaagtcaagaaacaacaaaggtggctgggagggggtggatatgctatttttgcaatctgagacaccgccaccctgcatttattataatctaaaacagcaaagcataacctttctatgtttctggaggtgagataatctcactcccctgccacagtctcctatggctcacaactgttctttccagggggcctgaggtggggaaaagcaagaggctgcatttgcagttgttaaagaataactttctttttctttttcttaaaaatattcttacaaaagcaatgttctattcagcctgccattatgctaaaagcttttccttggaagacaatagctgttctcagaaaaaagatttacatggggtcccgagggtgtaatgagctactgcggcacctgccttgggttgggagttgtcacttgtaagtggttttaaattagaaaggagtggaaaaatacacagttacagaattccccttttggcttctttgcaaatcattttccactctctctggcctttgtctctttctaagcctcctgatcaggtgtgaagaacagagctttccgttggggagagctggaagtgacaacagtggttggtcccaggaaaacagaaactcaggcgaactgcaaaactctcactctggacatttctgtttttgtacctcccagagacatgtggggacaagtatcactatgggattactgaattttagagcttaacaatccataaagactattgagtcctgatttctcaattgctggtgagagattgggctgagggacatagggacatgagctggactatctaggttacctatctagttggtggcagaggtagttctagacctcagcctcttgtctcttggcaatcttttttttttttctggaaagtgatgcttttgacaaatagtacagctaaaaaaaaaattaactacaagagcataatgagttctctccatggaaatctttaataaaagaagtcagagaaactgaactgtgcccttttcttgtcttgggatttccatcttttcaggcaacctgggctgaagatattaggaacacatagataagtattatttagtctttgtcactgaggtactcataatctacagggtgtgtgtgtgtgtgtgtgtgtgtgtgtgtgtgtgtgtgtgtgtgtgtgtgtgatgtcaaacgggtcattataatacagaaagttttaacaggggtgaaactaagttcagcggaagcacagagaagagaggatgtatcttcatggtaaaatcaaagggggagttttacccaccatggtcacctgtataaactccacgtgcctggtggtcttgtattgacacagctttgctttcaaagaaagctcagttggcaatccaaaaactattctcatgactctttcttgagaatacatgaaaagtaaaatatataaaacgcatcaaaaccatcttaaatttgtttttcctcatttttctcactgttgttgatctgcctgcatatcaacagtgactcaccatgatcctaccctcttcagatacaaaccctcaagctgtgtgacatcgaggatggttgaatatctcctttctgctttccactttggcctagtcactttaataataagaagtcaggaatccttcctccttctaaggctggttgaagtgggtgggaaagattgtaaaaccttaaaggtagttgaatagcttggctaacaccctatcatgtaaatattttattcttatacagttttacataatatcatttggttcttataattatcttatgaattaagaaagacagtaattattacacctattttatggatgataaaaattagattcagtgccaatgccattgatttacactttgaagtcaaacttctatatgcagagaaatgggggcaatgtcttttcaagtagaaacatagcatatgcagaagcaaggagacctggatatggtgctttgaaaatctcagggtggacaggtgtggtggctcatgcctgtaatcccagcactttgggaggccgaggtgggtggatcatttgaggtcaggagttcaagaccagcctagccaacatggtgaaaccccatctctactaaaaatacaaaaaaatgagccgaatgtggtggcacgcacctgtactcccagctacttaggtggctgaggtaggagaattgcttgatcccaggaggtggaggttacagtgagctgagattacaccactgcactccagcctggatgacagagtgggaccctgtctcaaaaaaaaaaaaaaaaaaaaagtaaatagaaaatctcagggtacaggactacagaattgtggaatgagtatggggacagcagataaaatgggaaaagtaagttgggctaaatgataggtagccttctttttcatgttaaaaagtttttattgaaggcaattatgagctaataggatgttattaaaagcagagaaatgacaagatcagatttgttttggaaagttttgtggcagtaatgtagaggaaagtttggggtaaggaggatagtggtgtcatggagtccagcacagaggaactctgaagcatttacgtcttagacttactggggttcaaatattggctctgccatttgttaactttatgaccttggaaaagacgattaaacactttgtgtcatggtttccccacatataagttgtggataataatactttttcatagagcaatttgaagattgtaaagggcttagaagggtgtctcccacatagtgagtgttcaagaaatattatcagttgttggtcaactaagtgggtgatgaggtttcaaaggaagataggtctagggaaatgggagggaggggcctaaatttaagagatgtgtctcagaagtgagacatccttggtgactggctgagagtaggtatgaagggtagggagttgaaatattaatatttccactttggttggtgggtggatagttgaatgccaacaaagaatatgtgaaaaagagtaagactgttgtcgggggataagaagtttggttttggaaatatacattttcagaggcctaaaaattatttaagaactaaggctaaatataattatacagccaatatgctataaaatatactctattttagagagaaataaaacaaattttatactacctaattttctcaatcagcaaggatatcagagttaattctatacagttattacagcagaaacatgtaatatatttcatcagaatcagtcctagaacattctattctacaaatttgttcatgtgatataatgatttgcatatttcaaggtcattatttacaaaacaattacatatgactaatacctcacaacagccctgtgaggtaagaaaaaagaaagaattggatgtattatctccatgtttagatgatgaaattgagacctgagaaagacatataataagtaggaggtagagcttggatttgaaccaaatctgaattctaaaccccataatcgtaactgttgtactgactgcctctttcagctgtgcaataatgagggaaaatcctttaccttcaagatacaatcacccatatgtcagaagaattgtttacactacaagtaatatgttctaggctcctccaatggtcatttaaacactaataacccttataattttagtaaaatctaaatattactgcctctacaatactctgcattcctctcccacccgtatctaaaatgcttcatccctactaaccttctttctacttattgaacacagcaacctaaccacctccactgggtctctatatctgctgtttcctctgtgtccaacactttttctccatagctatgcatggttgatttctccttgtcatatagtattcatgctcacgtcaaggaagtcttcccggatcatgatatctaatgttgttcccctactccgaatctctttatcacatgaccttgctactttttttcttcattgcctctatgactgagctccatgaaagcacagactatatgttgtatttttttctattgtatgtctttgaactaacacagtctctgcatgaagcaggtgcacaagacatgtttattcaacaagtaagtgaaatccctgaacctgttcttgctcctagccaccatgtaggacctttaacctctcttggaaagttacctcttacccggttatttcttgggtccccaagggtagccacaaatgtgctcataaagcagctattggctatggtctccacaccacttcattctttccctgatgcttggacttctcttggtagttgtttgttttccttgcagtctcgaaaaggacttttgccattgctatgttttcagagagttactggattccatgtaaaggtaggggaatagccctctccaaaactgtgccacacatccacactacctcaagtggtatgagtctcctcacgtttctggtgaaaacagctccatcatcacaggctggatgaggatgagatgaaccccatgcctccaaggttcagatgcctttctctttcaggattcttatacccaaggaataaaaacacaaccaatgtttctctttcaggatccttgcacctaaggcagaaaaacacaaccgatttgtcttccattgttattaacacatgtcctgagggctgggtaattagcaaccttgtcagttccccaaactcaggatataagacggtgctagccaggcatgaccatgagtttgctattaaaattcccaataaaatatgtggttttcataaagcaaaacaatacaatttattgttcatggatatttacatgtgtagagaagtataaaaccatgctgaaggaaagctaccgccagattcaagatagtgattccatctgaggaaggagaaagggaaagcgaaatttaaagcagaaagggaaagcaaaatgaaatctaaatctcatctattggggagtttgtatttcttaaagaaaaagagttctaaagaaaatatgtaaaaatgttaatgattttaaacatgggtgtctcatattattttctgcctccaactatttttatatttcatgtctaaaattaaaaaactaaaaagtgtcaacatgtcatccttgtctaacaaatgcataaattagagttagaaatgtgaaaataactccatattcctcctattactactcctcagacaattactgttagtagttttaaatttatcctttaatacacagatgcatgcacacacacatgcacactcacatactgacgcatgaatacatatgtacagagccttgaaatttaggtaaaaagtacttaaattggccttcttgacaattgaagtctgtgacttcctttggaaatccaaatctctttcccattaatctgagacttgacagcctcgccagattctgtgctaccactttacactcccacaaagtgtaagagattattttcttccatggctcagtcaacaattttatctgtcttctgcatttttatacttaatagtttttaaaattttttttaatttaattttttttatttttaattttttggtgggtacatagtaggtgtatatatttacggtgcacatgaaatgttttgatacaggcacacaatgtgaaataagcacatcatggacaatgggacatccatcccctcaaacatttatcctttgagttacaaataatctagttacattatttaagttatttcaaaatatacaattaagttattattgactatagtcaccccattgggctatcaaatagtaggtcttagtcattctattttcttgtacccattaaccatctccacctccccctgtgaccctctactaccttccaagcctctggtaaccatccttctactctttatcttcatgagttcaattgattcgatttttagatcccacaattaagtgagaacatgcaatatttgtctttctgtgtctggcttatttcatgtaacataatgatctccatttctatccatgttgttgcaaatgactgaatcttattcttttttatggctgaataatactccattatgtatatgtaaccacgttttctttattcattcatgtgttgagggacacttagattgcttccagatcttagctattgtaaaaacagtgctgcaatgaacataggagtgcaaatatctctttgatatactgatttcctttcttttgagtatatatccagcagtgggcttgctggatcatatggtagctcaatttttagttttttgaggaacttccaaactgttttccatagtggttgtactaatttacattcccacaacagtgtgcaaggattcccttttctccatactctcaacagcatttgttattgcctgtcttttggataaaagccattttaactgtggtaagatgatatcgcattgtggttttgatttgcatttatctgatgatcactgatgttgagcaccttttcatgtacctgtttgccatttgtatgtcttcttttgagaaatgtctatttaaatcttttgcccattttttgatcggatcattcaattttttcctatagagttgtttaagctctttatatcttctggctattaattctttgtcagaggggagttttaaaaaatcttaactctcttgcccccctccaaaaagaactcaccattttagtgttattctaatttgtatttttgggggcgtgactcaggtggtccatattttaaaatgtttgtgattttcatttcttccttttaaattgtttatttttaaaatcatttgtctggtttgtctattatgttagatgatttgttctataaatgatttatgaggaactctttgaatattaggaatattcctctgtgttaaacatggattcattcatttagcaaagatttattgattattgatcattttactaaatatgggaacattttctccctgtcacctctttttaaatttgttagtttttttttgcttaattttcatggaatctaatatagtagtctattttttacacttgtaagcataatgtgttaggaaaaagtttccctttttacagatgatggaagtaagacctagggaataaaagtgatgtgcctggttgcatagctattaaatatggagtgagaaatcagaatttaggtcttctctcagcagcatagggtggcgtgtgcctgtagtcccaaccatttgagaggctgaggtgggagaatcacttgggcctaggagtttgagtctagtctggacagtatagtgagaccctgtcttaaaaaaaaaattaggtcttctctaatcagacaaacagttttgtttttagtatcttataaaataatttatataacatatagacctagattaaagaacaataataaaatggacatctatgtatacacaatccaatttaagaaatatgacatttacctatattttagtccccataacaatttgctcaatggctttcactcatactacctcagagtaactaccatcctgaattctgtgctaaatggtcttttgctattctttatacttttaaatcacatatttatatatctctgaccatctactattgagtttgcctgtttgggactttacataaacagaaacattatataattctatttataattgcttatcttattaaacatattttaaagattaaactatgttaacatgtttgagttggcatctgagttactcatttttcattgctctataacgaattcctatgtatgaatttaggtcagtttctcccctagaattcatgagttgaaaccctaatccccaatgtgattgtatttgaagtaaggaagtaattaaggttaaacaagatcatatgggtggggccctgatgatactagtgttcttataagaagagacacaagagagattactccctttctctctgccatgtgaggacactgagagaagatgtggccatctacaagccaggaagagagccctcttcagaacctgaccttgttggcactctgctatcagacttccagcctccaaaaccgttaaaataaatttctgttgtttaagccacccagtctataatatttcttctaggtattttatggttttaggtcttacatttatgttttaaattcactttgagttgatttttgtatatggtgtaagataagggattgatttcattcttctgcatctgtatatttagttttctcaacaacatatataagagactgtcctttccccattgtgtactcttgacacctgcatcaaagatcaattgaccacatatgcatggatttatttctggctccttattctgttccattggtctgtaagttcgtttttatgatagtaccatgtggagttggttactacagctttgtagtatattttaaaatcaggtattgtgatgtctccagctttgttctttatttttctcaagattgctttggctatttgggatctttggtggtttcatatgaattttagaattgttttatctatttctgtgaaaagtatcattggaattttgatagagattgaattgggtctgtagattgctttggatagtatggcaattttaacaatattatttcaacccatgaacatggtatacctttccatttatatgtgtcttcttcaatttatttttcaatgttttatagtttttagtgtggagctctttcacctccttggttaaatttattcctaagttttatttttatgttattgtaaatgagattttttaaatttcctttcaaatagtttgttgtcagtgtatagaaacactgctgatttttgtatgttaaatttgcattctgcaacttaccaaatttattagttgtagcagtttttgtgtgaaagtctttagagttttctacatataagattatgtcatctacaaacagaaaaatttttacttctttctttccaattaggatgccttttatttctttttcttgcctaattggtctggctaggaccactagtactatatcgaatagaagtggtgagagtaggcatccttgtcttactcctgatcttagaggaaaagctttcagctttttgtctttgagtatgtatttagctgtgggcttgtcatatttggcctttatcatgttgcagtaagtttcttctataactaatttattgagagttgtttttatcatgaaaggatattgaattttatggcattttatgcatctgttttaatgaccatatgatttttatccttcattttgttaatgttgtgtatcacaataataacatttattgttcatgttttgtaacacatttgtacatgttgaacatccttgcagcctagagataaatcccccttgatcatggtgtatgatgttttaatgtgctctcaaattttgtttgctagtattccattggcaatttttgtatctatgtttatcaaatatattggcctataattttcttttcttataatatccctgtctagcttcagtcatagagtaaagctggccttgaaaaattagcttgtaaatgttcccttgtcttcaattttttgggagagttagagaaggactggagttaattctttaaatacttggtagaatttaccagcgaagccatcagatcctgagcttttctttgttgggagttttttgattacagattcaatctccttacttgttattggtcttctgttaatattttctgtttcttcatgattcagtcttggtaggtttatgtttctaggaatttattcatttctttgggttgtctaatatgttgccacagaattgttcatagtagtcgcttatgatcctttgtatttctgtggtatcagttgtaatgcctcttgtttaaaattttatttaaacctcctctctttttctcttacttagtttggctaaaggtttgtcaattttgtttatttttttgaaaaagcaactcttaatttcattgatccaaagattcttggtgggcgtttggcatgatccacaggcaggcttcctgttggagtccttgggcaggtggctagttccagggtcagcaggtgagtgggtctgtgcctggattcactgaggggagcctaaagctgggatctgctgggggtggccctgaatcttagttctccaagggtcagcctggtgcagggggcccctggggtggacctgttcactggatctcaggggactggcttggagcctgtgttcgcaggggctgaacgagcacctctactgaggcagggttggaccatgggtccactgaggcatggagccgtgggggccagcctagagcctggggccacagaagctggcctggcaaaagcatttctatttgcctctgttagtcaactgagagtgctagcaaactgggatgaccatattctctactatggatttttgggatcacatatggatcataaattcaaacgtatgtgaggatttgcttatcattataaattcctagggaaaatttgacataaaaagctgttcctgctctcccgttctgtgaattaagagtaaagacctttggacacttagctttatgcagggatttcctactggatgccctgccgtgggtgggccccgcgcttcactcctggttccctgcgtcccttgcagccctcagaacagaagctcaaggtctccaaggctcagttgaaaccttcagggggagagacaggcttcgacgcttgcttattttccaagttgtgtttttggtttccctttgttcttggcacttacagatttattctttcagaccaattcagcaatgcatcaaaaatgacttttgaaaagaaattcaacatttttgttgtttcctttggcaggttgttcagaatagttagtctattattctgcaaaaaatggaagttcttacccccttgatctttctactttacatgctactttcttccattagaaagaaaaatgaaagtctattttttgtttgctataatggataatatgaatttgaaggtctgtttgtaatttgaaatagcatatctgctattctacgtttagaattgacattattcctgctgaaaagaatacgctttcttttatggttcttggaatttttttttccttagcagatagtaagaattttagtgaagaaatattttggagttcctgaattaagattccaaccaaaacccgggttttctccggggcttcctattttttttcttttttttgacatcacgaatatcaacagaagagtgtgatttttattttttccgcttgtaagatgactaatttacccagaggcacctcatgtgtgtttttagtcacctgtatccaacatcaacaccagaaagctcaaaaagacaagttattcgatataccacacccagctgttctgatctgtgaggcttgcttgaggtaccttcagctgcggaaggagcttgttcccttgcagctggtggaaattctctcagtcccaagatggaacttctaaattgtaacttacagggcgggtgtaattacagtaattgggacagtgaataattctcagcatagctgatcgatgttcccatgctctcaaaaatcaggatagagtgatgtagtagaacccagatatgaatcctagctattttttcacaatgaatgttcatgacctagtgggagtcttcatttctctgttagagtaagtgatgagtgattatggccacagggacatcccctcaccccaaaacaaaacttacagtcacattcaagccagattacagaatgctgagattgtattgtactaccacttctttcttcttgaaagcagggattggattcagtagaggaaaaccgatgtgaatgatgtggcaatttccaatttgttggtggtgttttcctactgccattcgcccaggcaaagttgtagaaaggaagttgtttggccagacaggagattgtcaatagcagcctctcgaggcggtagctgggagctcacttcactgattcccttcacaagagagatttggaaacacaggttatgagctgagtcactgggcaaattaactgccccaaatgtgataattaaaatgtatgtccatgagccaccttggtaatgatcaagtgatcaagttctccccttaagcaactgtgcgcattgttgcctttcctggtaacagatgatcgcattaagagcttgcatgctgcagctcagagggaattggtgttaccccagtgtcctatgtgtatcttccctgcagctgattttctgtggctcattgagcaacgagtccaggtggcagctgtggattttgacatcccagaattttacagggcaagggcattctcaacatgtagtgatgcacatcccgttaggaagtggctattcatgaaactgacagggtaaagccctaattagaaagaccagcagggctctctgtaccccaggatgcttcaacagagctgtcactgtctcccctcaggcaggatcattgggctgaaacactgagcaaaaaacattttgttcaatgttcaacaaaaataactcccatcattagcaacatgacaagtgaaaggacctgcatgtcaaaagaaaaggatttatgcgtcgttgtaaataatgagtgattctaaaaactttaagctgctggggaagcagctttcagcttctggaaggtgctgttggaaacccatagagtcaaatgggtatgcttctctggttttcagcagatggaagcttaatttgaggttttgggaacactttagtcatggtaagaagtgggggacacctgaatttgaatcatggattatctcaatattttgcaggacttatttctttgaggtcgattttcttggtctttaaaatggagggttgtaagtgactatcttctttgtttaggtatataatgtagtcttgtttattcagattctgaactctttagaaaaaaaacaaagaattcccacataccaaattgcagtctaagcacacttacgcaaacaacatttattccttatgattaaaaagaaatgtagccagagggtatggcagtttcttaagttgttatgaaaagcaagaatccttatcttaatttcttttcaatcaataacaatttctaattcacaaggaaaaggaaagcgaaatagaaactgtcttcctttgaaggaagctgtgatgtaatgatttgctgggcaacttacatagtttaattaagcactctgattaaatcaatatgtatccaacagttcagcctggcaatcagcttaatctcattaactgttgttcagaccccaataattgattaataatacattatcatttatgaattattgacttcaagttattataattgtcctgctttgttcatagcacctgctgccacatgttaattatgaaatgctcaagcactttcttggaataactttagagataaagctgatggggtttttaatgaaccaagattatctttagttcagagctggtcagaagagctaggctttttcaaccctgtattgttcattaagtgggagcaggcatttagcatttttagagctgaggctcaaataattagagacagggttggaaggcacccacacacaagttagatgatgagccctactaaatgagatgggtgatatcagaatcataaacgcctagatccttactgccacaggattctgcttattgaggctatctgaatatatattaaataggtatcattcctgctctccctcctggtgcttatagtctatctttgaggtttggatatgcccaagggtattttaggagaaggaactgacctctcctgggtataggtgggatgggtaggagctattcatggaaatggcctcccactctgagagaggcctttggccaaacaagaggagttaccacacctaaaccaggatagcctgttgcatgctacttcatttgcctagttctgtttagttattttttctggctagtaagatcttcctttagagtgccagcctggtctatgctgggggagtcaagacaggagctgggaatgaattcacattaaaaaagggcatggtgtccccatggccagcctggttttggcagcacagtgaattcttgcttgatatccaaaagaaggatgaaatttaaggagcaggaaccaactggagaaattctatggccccttcctctatggtgggtctctttgcacagacatttctgtaggacctgggcttaattttattgaagacaccctgggaggcatcattatcaccacctctggttcttagcccaagaggaacccttcactcaggaatgaattggagctcccgcttgtaacagtgactggctttcctgagacattgcttccccagtaggaagtccctttaatcctgagcacctcactcagaaaccagccgtgtaggaagtgagatttaatcttcaagctccatcttttctcgttgtgaattccataaaaagccatgttttcaagggcatgttttccaggaaataaggcattttgatagagttgtaaaacatgggcttgtcatcagacttggattggaaatctcgattttctgaattttggaaagtggcttaaactgtctaagcttcgggttccttatctgtaaatagggataatattcccaccttcctaaggttgtggtgaggattaatgaggtaaggtatgttttcctaacacagcgtaaagagagggtgcttgttaaatactcatacccataatctttcactccatcctccttgttcattgcaagctgaaatgtaattgcccattttatacaatgccattttaatacccagggtaacccgaaagcctttctaatggtgaaactcaaatggataggcaagctactgaaatgtaatgtcaagagttatagctcaggtgtaggtattggagtcactcttatctgcactcacatttgggctttctctcagagtagctaggtagacttctaaaggtattgactgttgggcaacctagttaagcctcagtttcatcatctgtaaaatgaaatacctgtagtattttcacatatgactatggtaaagcttaaaaaattcgtggggccgggcgcagtggctcacactggtaatcccagcactttggaggccaaggcaggcggatcacgaggttaggagttggagaccagcctgaccaacatggtgaaaccccgtctctactaataatacaaaaaaaaactagccgagtgaggtggtgcgcgcctgtagtcccagctacttgggaggctgaggcagaagaattacttgaacccgagaggcagaggttgcagtgagctgagatcacaccaccgcactccagcctgggtgacagagtgagactttttctcaaaaaaaaaaaaaaaaaagtatatgtaaaacacagtgctaggcacacagtagatgctcaataaaatattagtcctctaccttccttttatttcacacgggaatactatagctagcatttaactccaaagtggcactggtcaaagggaaggatatagcctttcccatctgtagtttcagaaaataccagaggggaggaaatagcaagcattacaaaacatcctgcttcagcctaaagctctcaggaaaaaaccttatctatatttagtacaacaagttagagacagctttcagcaaagactaaagcactatctcattcattttattcaaatgaatccaaatgtatctaatttttgctttggcaaatgaatttccttctatccctcacctatttctttattcctagcttgtctactaaagatagacccatgaaggatgcctaacagggtcccatgacagtagtgtaaaaggtttagaggaagttacaggggagaagtgtcctatcttaatgactgaaactctgtttccgagttgaaataaatcccaactcatcttggagtgaaaggctcttccagaggccccaaatgattccttagaactttgagctgtgcttgattcattttttcttgtattcctcctctttctctcctacacggcttatactaaagaaccacacccactcatgccgtgggtggacaggaacaagccatcaaacgcaggagtgaacggagtgggtttggaagcctgacggccctggctctcatgcctgctctacccctcggtaatttgaacatctgtctcctcctctgagaaacccagaggtcagtcattgtggaggtgaccccacttcagaggattcagcaatcagtgggtcccttgactttctgcaggccaccgaaataatgctcttcctgtctgactagattttatctgtgaggtggaggagcaaattcatggtaagggaaaaatgggtcagagggtctgaagatgacaagaccacattttccatcttaccctaactgttgtcttcctcagctgtgctgatagcactcgtctgagctctgctgtgtgaatctccagtgatttggccaagtcactgtgtgtcctcctttctgatctcagttgagcactcggtcttgatccttgacttcctgtttttccctcagagcaggagactgaatcctgccaggctgaggcagtcctgtgagaagcagtgctcttgtgtaggatgattgtggaagcttgaactgggactttcagggctatgagccgtcctgtgaacaaacagaagacttcagtttccatggccgccagtctagcattatcccctcttgccatattccttcacagcatttataaacatgcaatttggtatttcctgcctctcatctgtttccggcttcttcctctccatcctttcttccaaagggatttgcataaaggcagtctatcaatactgttcttaaaggaagtgtccacaaaacactttgaatcaacctagtttctagctcatctgtttccatagcaaccaatcatgatgtcacaaacagagggggatgacttgaggtgggaattaggtggcaagagagcagatgggcttttgtaaagaaagaaaaggaaaacaatatcctatccgcacagagatttccttggtaataaagagcaagggagagataaataaagaagcaatgagagaaaggaagaatcctttccaaacagcactggagaaattaggagtgaaaattagcaacacttgcgagcaatgtttgtttcctttcaggcagtatgaatgatgaatcggcaccactcccttggggtgatgaacaccatgcacaatgaggaaataaaactttgagaggcgaaagaatttgccagggctgtgaagcaagtcacagactagctttgggaggaggattgagtcgatattaatgatgaaatagagcagggattgacaaactttttctgtaaagggccagatagtaaatattttagactttttgtgccagaagatctctttttcaactactgagctctgactttgtcacacaaaagcagacatagacaataaataaacaaatgggtatagttgtgttccaataaagatttatttataaaataggaatgggccagatgtggcccatgaaattcttgaagtggaagactatagaatataagtttcatatttaaatggaaaggtccttgatagttgtatggacaccagatgcactcctgagacttctggaccaagtattatagtgtcatgagtaaaaagaataggtgggtactgagtccaagcttcttcatttattcaacaaacttgattgtgaatctgcttcatgaaatattctgggcattgggaatacagcagtgcatgaatgtctgtcatcaaaagttttatgtcctaattagctggacagcttgggcaaaccatttacccaaagtcagccccagctttctcttgtggggatgtaattttttaaaatcatgagtcatattacatatacaaaacaatttatgtagaacataaacataaaataaatacctatttgcccactatccatgttaacataaagtagaacattgccactagtgtgtctctcccaggtctcattatccttctcttctcttcagaatattttgttattttcttttctgtctgttttttgatttaatcatataaatatttcataaaaaaaacttaattttgcctctgatgttttaaattatttgagccataatgtagtactatcctttgacatatatcttttactcaatgtttttttttttcccattcatccacacagacgtgtgtagctattaataaagcctgggtccaaagaccactagagccagatgtgtagtcaaacaatgttagagttattaactggctgcagcaatagagaatagagaatcactgagcctttcaaaggggagttatgggagggtatttataagatttgaagggtagagttgatcatagatttttttttttttttttttttttttggcagggattggtcaggatttgtaagccagagagttgctggaattgtcaatgggtttatctttagaatgcatgaatccatgtaaaggtctgtttgtggttttctgttaggatatatggatctgaatgaagtgttattattatatggtctgtgatgtacattgtagctgagttggccatagtttatttttcttgtgagtctgggtgaattttatatatgttgattaaatgatcagttttccccgtacagtcttgctaccagcaaggacattaaaacaaacaacaaagaaacaatttaactttaccactatagtttttcttcattgctatataatattccattatatgaacagactgacatttacttatccaatctacttttgataacatccgagttgttcctgaatatttgctgttacaagggatgctgctatgatgtggttcaaagtctctcctaaccgagtatatacttagaagggaatcatagtatctaggagcaggcagatgtttaactttactagggaatactgcactggtttctgaagtcattacacagagttaacttcctgccagttgtgaatgagagttgctctacatcctggctaactttctgatttttgccagtccaatgagtatgtgatggtatctcattgtagttttaattggcatttttttgataataaataaggttgaacattttctcaaatatttctttagccctttggatttcctcttttgtgatgtttctgttcatcctctcctccctccccccacattttgctattggtttgtctttctctcacattatatatggaatccttctggccactgaggtgtaataccaattctgacgtaaatcatgtttttatagacgtgggtctgtttctgttattttagttctgatttgtgttttatttgcccatctctgcactcatatgttactagctttatgtcactttaaataaattctgatacctcgtggggaagtcttgtagtcttgtactttgttttgcctctttggtagttttttttttttttttttttttttttttttttttttgagatggactctttgtcacccaggctgaatgcaatggcacgatcttggttcactgccaccttcgcctcctgggttcaagtgattctcctgcctcagcctcccgagtagctgggattacaggcacccgccaccacatctggctaatttttgtgtttttagtagagacagggtttcaccacattggtcaggctggtctcaaactcctgacctcaggtgatccgcctgccttggcctcccaaagtgctgggattgcaggcatgagccactgcacccggcctctttggtagtattttaactattcttggcctctttcacttctaaataaattttggtatcagcttgtctacttttaaaacaaaaatataaaatgtctattgagatttttcattgagattttattgaaatgatattcctatcgggaaaaaaggacattcctatgatatctaatgctcctctccaaggttttgagaacatgttatttcaccattaagtaagattctacaattggtttcataaaattttattttttttttgtataaagagcttgctttcacatcatatttttattggataatttatatacttgtggctattacaaataatatattctttaataatttcttttaaaaatgattcctactggtatagaaaaatgtgatggatttttctatatttgttttgtattttaaaatgatatacttttaaaatttaaataatttttgcaaaactttagaattttttatgccgatatatcatttgaaactgacaagtttttttttcccctttgcttctgttatattctttattttctcttttttatgattcagaacaatgcttattatatgcggtgatagtgagtatttttgtattgtttctgatcttcaaagaaatgctcttaacgtcttactattaagtatgacatttactgaaggtgtgtgtgtgcgtgtgtgtgtgtgtgtgtgtgtattcatttatgaggttaaggatgtgtctttctattccccacttgctataagatttttaacatgaatggatgttgaattttattacatgcttcttcccacatctattataattatcagatagtttttctcctttaatctgctattgagataatcacatgaattgattttatagtgttaaactgtgcatgcagttctggaataaatccatttgtcatcatatattatcttttttatacattgcttgattaaatttgcttttactttgtttaggatttgcatatatattcaaggtggtgagaggcttgtaattttctttcttttgtgtctttgtctccttttggtatcaaggttgtgcttatcccttaaaattaagtgacataatactcttttatttttaaattctctgaagagtgtgtgtaacattaataacattagaatgagctcttccttgtatgtttgggagaatttgcctctatagttctggtgctttcttgtgagaactttttaacctgttaattaaaattcatgattgattaaataatattttctggttttcttatttatttttgaaacaagtttgacaagttgtccttattttttctgtaatgtttctatttaatctgacttttaaccttgactgtaagctgttcaagttcttccgcttgtgtaattatgtccttattttctttcttaatgttgtttattcataccttattcttttctgatataaaaatttcagagaggccgggtgcagtggcttatgcctgtaatcccagcactttgggaggctgaggcaggtggatcaccagaggtcaggggttcgagaccaggctgaccgacatggcaaaaacccgtctatattaaaaatacaaaaaaaaaaaaattagttgagcatggtggcggatgcctgtaatcccagatacttgggaggctgagtcaggagaattgcttgaacttaggaggtgaagcctgcagttagctaaaagtgcaccactgcactccagcctgggcaatgaagtgagactctgtctcaaaaaaaaaaaatagaatttattttcctttaaatgccactttatctctataccactggcttttctatgtgatattttcattttctgtcagtactaattttttttattgttactttttttaacccatgaattattcaatactttctttaaaattttcaaatatgtgaagtttttcaagtatgttctggttatctatttaatgttgattgtaaattaattttattgtaagcagagaatgttatctgcctgttacccatcctttgataattgttaaggctatctttatggcttagtgtatagctaatttttgtaactatctcgtgtgcatgaaaggaatgtgtactttccagctattgggtgcattgttctgtatagccgatttaggtgaaacatgtttgtctgtgctatttgaatcttatatatctttattaacttctttttttgactgcttaatctgtctgtttgagagaattgtgttaaatcttccactacaacaagagatttgatatttttttcttgttaacagtttttctttacctattttgagactatgatgttaggtgcgtataaatttagaattattatactgtatttttctaattaattgtaacattgatcattatgtagtgattttctttaccttaaatgccttaaagggcactttgatattaatatttatgctttaaattttgaggggaccaatacatgaaatttgaggggacctggtaaatctatttccaattagattatgtctttggaggtttatttttaatgtcggttttttcagctagtttttatttgtaatatcgcattactagtatgctttatgaatattgattgtaaggtgactatttatttggaactgcatctgggggaacactttataatgggttaagttatattcctgagagaatttcttctgctagtcacccagcagcatgctcaacacaagtccagatgaagttaaattatttacttcatgactatcaaactacattagtagtgtgcatttgtactgaaaaccagcttggggatatacatggatactttcccagagtagcactggagccaagtgcagtaatttttcttgccactccctttgcaaaagtgttttgtttctggttcacttttgtattacgtttgtggcttttttgagtaccagctttttgcagtggtctattaaattttccactgtggacaagctttgggctgtttctcctatttcctgggatctgtggagttgtcaaaccaaaactcaaaatctctaggggttggcaggaaactctcaggttcaaagatgacttcaatagtcacttattccccaaatttttggttttactttactttggagcatagcacattttctttcttaggccagcatagtgattttttttttttgtattttattgaacatttcagttggttctgtgggaaggttgaatgagggcacctcatccaccatgttgctagaagtggaagagtctatttaatgaatatttttcatatcttattcttagggtggctgtggggatcaggaaaataatatatgacaaataaagtacttggcttttccataattatgtaaataaccaaataacattaccaattgaggcaaaacatgtcagggagagtcatattttgaaaaaaaaaaatcaactaacttcattctaaggtggctgtgtaagcctcagtattgtgcattgtcatgttaaataactaaatataaatggtccatccactatcaggagaaataatcatttcattgacagattatgttaagggcaatttgactagagacaagggcattgaaagttaaataactgccagtgcaaaatcctgcttgccctttggtgctaaatgtggtttaagtggtcttagggtttaaatgtgatgctcctcatattcaggtatagacaatctaaaaagaataattcctctgactctaccttgcttgaccatctgtatactcaacactgtcagtgtgacttctgaaactatccttttaccctactaaggtcatggaccattggtgctcagttttgcacagtattttgcaaacttaatggacttaccactactgacctctcttcatggtgtctttccttttctctgtgcagtctggcatgacttgctttttggaaaggatgtaatttaccaagtattaacctgtatgttgagctgctgtatatcccagaaccccagttaatggatggtgatgtgcacagagaagactgtcaataatttctgcagtgaaatgcttcatgtgctataagaaaaaatagagtcataagcatgtctcattcagccatttatttgctaatttaaaaattactttaatttagtgtcaggcactgggctagatactaggggtagagtgatgactaagatagtcctcatccttaaagaattaatgattttcttaggaggaaatatacaaacaaatagaatgtgtaagtgttgtaagcactatgatagaagcaaattagagatgaagtataaagaagggagcttaaaactctacccgggaatgaatggaggaagtcagataagacttaaaagagcaaatgatgccagcactaagggatggaagctgtaggggtaggtgtttcccattatggtggagtagacaaagggccttctctaggcttaggaatcatagtgagtgaaggtccactgatgtgaggcagctgtgaacatctcatagcctgcattcattcattagtttatacggcattcattcattagtttatatggcattcattcaaccaatttgtattggcatctactaggtaccagggactaaaatatttatagagagagtttctggttttttgacactttcacactaatgggagacagtcgataaactgtccagttaacaattaagtgagtattcacataatgtgatagtagccataacaaaaaaagtgggtggtagtaataaagaataaggtagagtcgtagtggtaaatcatttagaacaggatggcctctttgaaaagacatttaagccaataccccaaccacaagagtttgccatttgagaaggtgagtgaagtggggccgagtttggggaagagggttagaggaagtgagccaatgtctccctagctcactagcatgtgaggagaccatgtagcaggaatgagtttggtgtgtttcaggatcggaaaggaggtgagggtgactggacaagggagacagtcaaagtaagtgacattggagaggtagacaggggacagatcttggagtgcattatagaccaggctaaggaggagttttgtttcatcctatagtcagtggagaatgtttaaagggttttgggttttagaaatgtgtctcttccatcagtaggcaggataggatggaggcctagaagactagagagagaggcaaggaaaacacggagtgatttttgtaatagtgtggacaaaaaataatgagtataattgggaattctaggaagaaatgtatgaaaaatatttgggcaagaatagaggaagaatggcagataacatccacgggggatgagtagatgatgctgtcattttccaaatctctaaattaagcaggaggaactagttgtagtgggaaggaaagtttcttaaatgggtaacttttgaggttttaagagcatgagaaaagagaacagcctggagttggggaatgcagttctatttggagcttatggagcaatcaggacttgaattagagatgaatgcaggtttggcagggcctctccttttctgtaacttgctaaaatacacgatagggaatcaggtttcacacatggggagtcttcgcctctgctgccagcctggcattgttatatcaccgagtgggccagctccacagcccaatcaatatctgccggcacagccatcttccatccccctagcaaggtgagcatcgaacagttaatctccctttctccagttcttagtaactcctggtttgttttcaccagacaaggcattggactatactggaaatataggttgctatttttccaacgggtcacatagatctcagagtggtacagtctgtgcacgttgggggtggtgggaaggggcacatgataacttcttaattttttcaattttctctcagacctcctacactcaagccctcatatccagtagctgctctcttcttcagaaaattccaagccttcctacatgagcaggaagttctgttcccttatcccctcctgtatcttccagatatgatcatgtaagtctttaatagacaataaataacttttttaaaggttcaaatgagaagagtgcagctctggtcccatttgtgaaggcagatcgatgctccaattctcattcattctctccatcaacaagtagttgattttttcactgttaggaagccagcacactttattacagtgagcttttttttttcattttgttcaggacagcacagttcagtctcatagacataatgtataccctttcagtctagaagatattttcctgcctccttatgaaacaagaaatgcagacttatcagtctacactagccatgagtgtctctctcttagccatctggtgtgggggaaaaacagttccattacattctttttttacttattatatacttctaaatataagtatacataggagaagggtatagagaatgattttcagtttattatacaatgtaaataaaattatcaaatattataacaaggccaaccaaggtgaggatgcagaaaaagaagtgattcattcctttggctagagaagtttggctggtgggaaacaagaaaatgtgtatagcttttcttttcttttcttttctttttaaggatacttgattgttaagggaaagagaccatttgagcaataattagagtattcaggattgagggaggtatatgttgcttgttgttgttaattttttacttgtttgttttgtttacagacaacagcatttgagcaaccttcttaaatatctgtctggagcagaagccattcttgagatagaaaagatcagaagtgcagccaagactggtaacaactgatgaagtatctgaaagaagctagaagggggtcagaatagattagtcatgaacttctaaccatgagcaggaggtagaatgatgttatcccccatatcctcgagtttttttctttttcttttttttttttttaattttgcacagagcattatgaggtcatctgctgatgggaaatagagtaggagaaggatttgaggaaaatagtaaaggaggaacagtcattaaagggaatggaaggaaaaactgaccagtgatagagcaaagagggacagaggtaaaggatcagtggtaaggaagactgtggatttctgtggcttcaacctatgtggatgggtacttttccccagcagtgatcaataggtctgatggaacagagatagtcaatgtgcggactgacccaatgtggagggtgtgcatgacaagggagtggcaaaattggggaataaaagaggcttagggtcataaattctttgttttatggagttagagccccagctaagttcttatctgataaattggtggcattccaaacactaggtaatgattttgttcttgacacatgttagctagatatgttgtcctttacttaggatgctgaaggttacaacatctctgactcattctctgacagtaaaatgtattctttggatgtagaaattttggtctgaatgtaaatgtttccagaaattagtttagttcagcttatttattttaagaagcgatgaaagccacctaagagacaataaatcttaggcatatgtgcccagcagaagtgtttgtatatgcagtgtttgtttatgttttcattgaggtgtcagctgctttttctatacacgaaccattgtgagcatatggcattttgaggtgagtcataggaaattcagctgagtttgttaattgcccaaagagacaggtataaaactcagaaaggaatcagaatgtatttacaaatgaaccttaggcaggtgtgacttgcctaattacttgctgatggaaaaagcacagctattctaatttatttacatcccactctaatgatatgaggaggctcagcaattgccagatggggtgtgtcggggtacgtcctcctgagttgctccaggcagtgtgttttaaaggaaagaagaagaatatggtttaggatcctggcttcatagttatgtggaccccatacctatatgagcaagctttgtttttaagcctctgttttcctctttcttaaaaatgaagctcataatacataattttctgttattctgaaaacaagatgagtcaacaaatacttaaagcagagagcttagttcctgttcctatggatatttgtttttctcatttcctacctgcttcccccaactataaaacttccagctcctaaacatgagagatcaagttaatgcttattgtgattcttctcccacaacaagagcaaaaactacaggatcaaaataacctaacttaacaattataaataaattgagacaaagtgaacaagtgagagaaatggagagagaacgatacagaaagtatggtaaaaagtatttgaaagattttagatgaaattactaagacatcccttgaactatttttgcaactttttatttcaaataaaacttaaaaaaaatacaatttataaagaaaacggtttttaattttttttccaagatggcagattagaggcttgtagcatgcctcagccacttggaaatagaatgatagtgcacaaagataaactctgtgagccttaactcaagaggaaaaacaggaatccaccagaatcatgaaggacaccccaaatcccgaggaggagaatgtgggtaaacagcccctgtgacagtgtctatctcataaaatttgagtgaagccccagtacatgagagagacagacagcctccctctgtgactcacctttccactagtgatccaagcaactgaggctgagagagagcattttgtttctcccaagccctagagctaacttggaatgaggcttgaagacactatgagggaaagacactgggaaacgctgcaggcattttcccagattcaggaccaaggacaggacaccgtttttaatttgggctcatataaagtcagtcattctttgacaatttgcatagctgtgcaagcattttagtcttgggccagagattagagcacctgctctggaggggttagggacatccatagccagaactgtagacagtgcttcagcagtaggtgctagaattgtgctcttccccattgcaggcctggggtggaaggagagctgctacagctgtggtttctcctaggtgacgagacttgcagccagggccatcttggcagactggaaccagtctgcatgtatcattgctgggtgcctaccccagcctgttcccctgagttcgtggtccagcagatccctctccacttcactcccaggcagaaatccaggcattcagggcacccacttgcctggaccagcagcctgagccaccccaccctcatggacatagatgatagtgcagtggggccctctctgccccatgtccaggtagatctccaagtatttggagcacttcctcaccaggatcagaagcctgagctgtctcacccttcctgtgcatagattgtggtgcagaggggccctctctgttccacatgtagacaaatctccaggtatttggagcacccgctcacctgagtcacctcacccttcctgtgcaaagatcctagtgtagcaaagccctctccacttcatgcccaggcagatctccaggtatttggagtgcctgctccctggtcaagcagcctgagccgcctcactattcctggacatagatcatggtgcagtggggtcctctgcattccaagccaagacagatctccaggcacccaaagcacctcattacacagattggcagcctgagctgccaaactctttctgtgaagagatttgggtaaatgcgggccctctatgcttcatgcccaggcagatctctaggcattcagagcacctgtttgcctggtttagcagcctgagttgccccacttttcctgtgcagagatccaagtggagaggagccttctttgctccatgcccaggcagatctccaggcatccagagcatccactctcctggattaggaatttaggcttccccctacatcactgtgcagaggacttggagcctaggaggttttccagattcagacttaggcacacatctgggtgcttggtggctgctcgttggattctccctctgcactgatgcttgtgcctaccatcaagagacctttaggtgagctggctcagcctggccctgcccactgtggctgctgcctccctgggagctgagcagggagttcagaccactgtgtactccacaagtcagcccatttcctgaggcaacagagaacttttgccagtaaacaaggatcaagtatatacccagctgcattggccacagctggctgtaacccataaggtacgtctactggcttctaggtgaaactgcatggcccaatataaaacctgccgacagatgtgcataatagggctatttttggcaaagaaatagggctatttttggcaaacccaaaaactctgcctagcattttctacggtcacattccgtagggaagaggggaaagggaaagaaaaaaactataaggaaagataaagaaaaaattccacttacgtgaaaataattacacaaattagaagtgccagcatccccagatgagaaggaaacagtgcaataattctgacaccatgaaaaatctgaatgtagtgataccaccaaaggatctcgctagctctccagcaatggtctctaaccaaaatggaaactcaggaatgacagataaagaattcaaaatatggattgcaaagaagctcaatgaaatccaaggcaaggatgaaaatcaaagaaacttctaaagcaatccaggaaatgaaggatgaaataaatatctttaaaagaaatcaatcagagtttctggaattggaaaaaaaattgaaatatttcaaaatacaattgaaagctttataataactggacgaattggaagaatttcagagcttgaagattagcctttcaaactaacccagtcagacaaaaataaagaaaaaagaatttaaaaaaatgagcagggaagatgcggtagctcatgtctgtaatcctggcactttgggaggccaaggcaggtggatcatgatgtcaggagttcgagaccaggctgaccaacatggtgaaaccctgtctctagtaaaaatacaaaaattagccaggcatggtggtgtgcacctgtaatcccagctactcaggaggctgaggcaggagaatcacttgaacccaggaggcagaggttgcactgagccaagatcgtgccattgtactccagcctgggtgacagagtgagactccatctcaaaaaaaaaaaaaaaaaaacaaagtctgagaaatatggaattatgtaaagtgaccaaatctatgaattattggcatagataataattctctcctcttctctcttcttctctcctgagagagaagaagaaaaaagcaacaacctggaaaacatacttgagggaataattcaagaaaatttccctaatcttacttagagaggtaagcctccagatacaagaaatccagagaagacctgcaagatgctacaatgatgaaaatcaccaaggcgtataatcaccagactgtccaaggtcaacactgaagaaaaaaccttaaaggcagctagggaaaaaggtcagattgcatacatagggaaccctatcaagctaacagcagacttcacagcagaaactttacaagccagcagagatcgggggcctgtttacaacattgttaaagaaatgccaacctagaattttatatctggccaaactaaacttcataagcaaaggaaaaataaaatgtttttcagaatagcaagtgctatgggaatttgttatcaccagaccagacttacaagagctccttaagtgagttctaaacatggaacaacataactatacctgctatacagaaacacacttaagcacatagcccaaagaccctataaagcaatcacacagtagaaactacaaagcaacaggctaacaacttcacagtggatgaatagtaatcattagttgtctaagtgccccacttaaaaggcatagtgtggcaagttggataaaaaaccaagacccatccatctgctgttttcaagagactcatctcacacataatgacatccatagcctcaaagtaaaggactggagaaaaatctgtcatgcaaatgggaaaaaaaagcagggattgctattcttttattaaataaaacaatgtaacaacagtaaagaaggacaaaaaagggcattatgtgatgataaagggttcaattcagcaagaagacttatcttaaatactcaacattggaacatctagatttataaaataagtacttctgaacctatgaaaagacttagatgtctacacaataatagtgagggaactttgacaccccactgacagtgttagatcattgatgcagaaaactaacaaactccgggccaggcgcagtggctcacgcctgtaatcccagcactttgggaggctgaggtgggcggatcacgaggtcaggagatcgagaccatcctggctaacatggtgaaaccctgtctctactaaaaatacaaaaaattagctgggcgtggcaacaggcgcctgtagtcccagctactcaggagactgaggcaggagaatggcgtgaacccaggaggtggagcttgcagtgagccaagattgcgccactgcactccagcctgggcgacagagtgagactccatctcaaaaaaaaaaaaaaaaaaagaaattctggactcaaatttgacacattaccaattggacctcatagatgtctacagaatactccacccatcaactgcagaatatacattattctcatctgcacacagagtatactccaagatcgaccacatgctcagccataaagcaagtctcaataaattaaaaacactagaaattataccaatcatactctcagaccacagtggaataaaaatcctctgctctctcaaaaaccacacaattacatggaaattgaacaacttgctcctgaatgagttttgagtaaacaatgaaattaaggcagaaatcaagatgttctttgaaataaatgaacaccgataccacataccaaaatctttggtatatagcaaaagcaggattaagaagaaagtttatagtgctaaatacctacctcaaaaagttagaaatatcccctattaatgatctaatgtcacacctagaggaactagaaaaacaagaacaatctaatcccaaagctagctgaagaaaataaataaatcagaaaagaactgaacaaaattgagactccaaaatccatacaaagaattgatgaagcccaaagttggttttttgaaagcataagcaagattgatagactgctagctaggttaagaaagaaaaagagataagatccaaataagcacactcagaactaacaaaggtgacatcacaagtaatccctcagaaatacaaaagatcctgagatgattataaacatctttgtgcccacaaagtagaaaatctagaaaaaattggataaattcctggaaacacactatctcccaagattgtataaggaagaaattgaaaccctgaaaagactaataacaagttccaaaaattaatcagtaatgaaaaacttatcaaccaaaaaaatccctgaaccagatggattcacagcagaattctactagacatacaaagaagagctggtctcaattctactgaaactattccaaaaaaatcaaagaagatggactccttcctaacttattctatgaaaccagcatcaccttgataccaaaacctggcaaagacacaatgagaaaaggaaactacaggtcaatacctctgataaacatagacacaaaaattctcaacaaaatgctagcaagctgaacccagaagcacatccaaaagttaattctccatgatcaagtaggcttcattcctgagaagcaaggttggttcaacatatgcaaatcaataaatgtgattcactgcataaaaatttaaaacaaaaaccatatgatcatctaaacagatgcagaaaaagctttcagtaaatctaacatcctttcataatgaaactctaaagaaattagtcattgaaggaacatatctcaaaatagtaagagccatctatgacaaactcacaaccaacatcataataaacatgcaaaaacttaaagcattctttctgagaactggaacaagatcaggatgccctctctcaccactcctattcaacatactactggaagtcccagccagagcattcaggcaagaaaaagaagacatctaaataggaaaaaaagaagtcaaactatctctcttcacttttgattctatacctagagaaccctaaagactccaccacaaggctcctagaactgataaaggacttcagtaaagtttcaggatacaaaatcaatgtacaaaaatcagtagcatttctatacatcaataacattcaaactgagaacccaatcaagaacacaatccaatttaaattagccacaaaatactacctaggaatacgtctaaccaaggaggtgaaagatccctacaagagaaatgcaaagtactgctaaaagaaacatagatgacagaaacaaatggatgaatattccatggtcatggattggaagaatcaatttcaaaatggccatactgcctaaagcaatctatattttctatgctattcctatcaaactactaatgtcacttttcacataactagaaaaaaaaactattctaaaattcatatggaaccaaaaaacagcccgaatagccaaagcaatcgtaagcagaaagaacaaacctggaggtatcacattacccaacttctaactatactataaggctacagtaaccaaaatagcatggtacactacaaaaacagacacatagaccaatggaacacaacagaaagctcagaaataatgccattgaccaagacgatgaaagaagcaataaaaattatgaagacagaataagaaactatgaaaatcaacaggcatatttaagaaaaataaaggcattttttagaaatgaaagatatatccattgaaattaaaaccatggtagacaaattaggcagcagtttagacacagttgaagaacttaagaaaatgaaggacatatttggggccataacctataatttatgacctagagaaagaaatggataccacagaagaaagactgagagacatggaaggtagattaagttattttttttttttttgagacggagtttcgctcttgttgcccaggctggagtgtagtggcgtgatctcggctcactgcaacctccgccttccagtttcaagcgattctcctgcctcagcctcccgagtagctgggactacaggcatgtgccaccacgcccagctaattttttgtatttttagtagagatggggtttcactgtgttggccaggatggtctcgatctcttgaccttgtgatccacccaccttggcctcctaaagtgctgggattacaggtgtgacccaccatgcctggcctagattgagaagttcgaagaagcttcagaaagagcatagagagtaggaagaagagggcactgtcttaaatatattggctaataattttccagaagtacaaaagatataaatccttaagttgaggataggattaagtgcacttgaacacaccaaagtgaagttgcagaacaccaaatattgagggaaattcttggaagaaaccaaagataaaatacataaaatgacacagtccttgattattgttttctaaaactcaagagtaaaataaggtgttgttataagaaagttggagaaaactatgagaggagaatgttgagaaaaaggaaactgtaagaaatgaaagaagggaatagtttcaagagtgttaaataggggagatcacagcacttaaattcaggacactctactcctggtttgtcacttactacctgtgagaatttggctaggttacctaccttctctgaataagaacatgcatgtgttctggttttatttcgataagcttcaatcatcagcaatcagcccctctcgcacagtgatttttattttccactgaaagagcccaatgtgctgtattgtgaaggtgttagacacaaagatgagagaaagcatgaagttagcttcctgtctggcagaaagaaagggtggagaaatccagaattcgaagaagcagccaaaactcagcctccacctgtgatagagtgccctaggcatttaggactaactgaggctttgaggccagcaaggaagtggtttgcacggagcagaggtgcccattcgatgtctcaaaccacagattcttgctacatctgctccaggctgtgacttacattttactcatggggttgggttctgtttctgcaagtcttgaacatgcttcagttttgagttgctagtcatcactctctgtaacttgcaagagacgcccctgaggtttcgctgattcaagtagagcagaatataaacttattatgaagcataaagcatgagagaatcaaacaagttcagaaaataaattgcatttggagctaagtgaataatcttccctacttcttgggcagactggaacaaggcacttgtctggaataacaactgttgcgtgagagttggcatttgattgcctttattatccagagggctggcatcagcatgaggaggggtgaggggtgtttcatcagtgtagagttgctggattggctggacactttccagctctgatccataatttataccaagatgggaatagcaagcaagacactgcccattttcagggcttttgcttatggacacaaacctatcccactaaatcccttacagaggagacttaatgggggcttttcatagctctgatagttagttccagactggctgctgccttaagaaagagacaaatgaaaggtgctagaggcaagctcctatgatgacacatgatctttgcatacccaacctaagtaaaaattaccttgccatctacttcttcatgtattgatagtcttctagcacaggaagattgtctgaatgagtgaaggggccacaagactctgtatttctagagtgttaggaagcactcctaaggactctggctgtccgggaatggggacaagaattagcatcactctctaggttgaagcattagatggacacacaaaacaatttagaaatcctgggagcatttgtattcccagtgcctctctctttctttcctatgtttatctaataatgtgcacagaattacactagtacactttttgtaaactgagttgctatttgattctcatgtgttattttgtttacatacacagatttacgcaggaaacagacaaacctagtcactcatgttgtgcaagaattcagtgcactgtcttgtattaccagtaggcttttttatattagttctagaaaagaaaaaaaaagtaggaaggaaaagaaggaaggaaggaatgaggtagaaagatgcatgcagaatgtgtatgtccattgccgcactattcacaatagcaaaggcatggaatcaactcaaatgcccatgaatgatagactggataaagaaaatgtggtacatatacaccatggaatactatgcagctattaaaaaggaatgagatcatatcctttgcagggacatggatgaagctggaagccattatcctcagcaaactaacacaggaacagaaaaccaaacaccacatgttccgacttataagtgggagctgaacaatgagagcacatggacacagggaggggaaaaacacttactggggcctgtcgagggagggtggagggtggggagagcattagggaaaaagctgatgcatgctgggtttaatacctaggtgataggttgataagtgcagcaaatcaccatggcacatgtttacctgtgtaacaaacctgcacatcttgcacatgtaccctggaacttaaaacaaacaaaaaatgcacttaaaaataaaaaagaaagatgcatgtagggtattattttaattcattcatttaccaaatatttatcaagtgtctggtatatgccagacacttctagtcaggagagatgcggtgagtaggaagcaaaaaagataaggtcttgccctttgagtttgcaatctagtgaagggacacataaactgattaattgaaatggttctaaaggaaatggaagaaagaatagcaaaatggaggataaggggacatggggacatgggctctgaattatgagaaaaggtcaggaagtctctgtgaaaggtaacagttggaggagagagacttggagaactcttcttggcaaagaaaatagcaattgcaaaagtgcatttgaaaacaacatgttttaaatccccgagacaggaatgtgcttggtgggtcctaatcagggaggtcaggtggctgaatggggagaacaaggtggagaggcagaggtaagttctgagaggtgacgagggcagtttctgcagacactggtagcagttgtagggatgctggctttttctttgagtgatttggcaccattggtggcttgaggtagaagagtgatacgttatgttttatttattaaaggaattactctggctgttatgagggcactgtgaagggataaagtgacccccgaagaatcctttgctctgatccaggaaagcatagtggtaactttgaacagaaccacaaaggtaggggggtggctgtattttggacccattttgaaggcagaacaacagattttgctattggattggacaaaggacgtgcaagaaagaaagtcatcaaggatgactcccaggataaatggtttgaatgggctgcccaaactggaaccaggaaaaccggtgtagagactgttctcagtcatccacgtaaagctagagcttcctggaccattgaaaaagagtcgtgagagtggatctccttgctctgctctcaatgctaggaggacagcactcagtctttcaccattatatgtcatgttaactgtaggtttgttgtggatgattattatcaagttgaggatgtaaccctctactagagggttacaagtgttcctatttttctgagaatttttatcataagtgggtgttgaattttgtcagtgctttttatgcgttaatatgattgtgtgatttttctttagtttgttaatatggtagataatacattgctttatgatccttcatccttgaaggaaattttcactagatacggaattctgggatgaaagtccttttctttcagcacttgaagaatattgtgccacttcatttggcctctggtttttgatgagagatacactaccattcagttttttccccgataggtaaggtgttatccatttcttgttgtcttcaagaacttttttctttatttttcaaaatgtaattataatatgtcctgctctagttttctttgagcttatcctatttggtgtttgcccagcttcttgaatctgtaggttgtttatcgcgaaatttggcaagttttaaaccattatttcttttagttccctttttggctccaccatctttctcctctaatttggggactccaattatatgaatgttcgatcttctattttgtctcacaggtcattgagatttcttcttttatttcagtgaatttttttctgttgttcagattaggtaatttttattgctctatcatcaaggtaacagattcttctttccctccattctgctgtttagcctatttgttaattattttttattatagtaattgtatttttcagttctaaagtttttatttcggccgggcgcagtggctcatgcctgtaatcccagcactttgggaggccgaggtgggcggatcacaaggtcaagagatcaagaccatcctggccaacatgatgaaaccccgtctctattaaaagtacaaaaattagctgggcgtagtggcgcatgccttaatcccagctactcgggaggctgaggcaggagaatcacttgaacctgggaggcagaggttgcagtgagccgggattgtgccactgccctccagcctggcgacagggcgggactccatctcaaaaaaaaaaaaaagtttttatttcatccttccttatatattctacttgtttgccaaggacctttttaattttcatttcttctgaagcatttttatgataactgcttaaaatctttgtcagctaattctgacatctctgtcttctcagtgttagcttctattgattgctctctttcaggacaattttcctgttttttatttttatttttgtgtgatgagtgattttttgacggaaacctgtatattttgagctatgatattatgagactttggatcttatttaagccttctgttttagctagtgtagtgagttgaatattgcctccactgccccccccccattcatgtctattcagaagctcagaatatgatcttatttgaaaataggggctttgcagatgaaattaattaagggtcttgagatgaagtcatcctaggtttagtgtgggccttaaatccatgacttgtgtccttgaacatggaggagaggatacaaaaagacacagggaaggacatgtgaatgcagagcccaagattagggctatgctgtcacaagccaaagatcatctggaggctccagaagctggaagaggtgaggaaaaatttcctctagcaacttcagaatgggtgtggccctgaaagcacgttgattttgatttctggcctccagaagtgtgactgaataacttaatgttgaggtaagccaactaattggtggtaatttgttatggtagtcctaggaaacaaagtggcttcctctatacctatctggtagaggaagggtggggatgccacggttactgccagaattgcgtatccaggttttccactaatcctctgatgatccccaaaggaggtggcctctaccttgcttctggttgggggtgaggattctggctgcacactaagcctgcattggtaccactctgactgggagggcaaggtgcagaccactactcctcacgtggtgtcttctgacacctcattattactggtaggtggtgaaagtccctactctcactagggctcctctgataccaccccagtggggagcagggctaggcttctcattactgctggggtaggacgtgggagtccaggcttctcacatgcaaagtccaggtctccccctgacactgcaggttccctacctggccttttctgacacacctgtgtgctgggaagtggcccacttagggtgcttcattgggacctgtccagagtggaagtctagtctccctgggttttttgtgtggtgtttggctggaatgttattatgtaaaaattttctgacttgctaggctgcccttttcctgactagacagagcaggcttttatgggggtctttttgtttgtgacaattggcatttctgggttgctgacttgttcagctccaagtttaggatgtaggaggcaaaacaagaacaaccaacctaccctgaggtcattcttgggtcctgagtttctgagctggtccaccttcttctcttcacttttcagatactttttatatttgtgttctatgtaatgaccagggattttagctgtacttagtgggaggactcaggaagggtacatctactatatattcccagaaatggcagtcctcaggtgccttttaaagattcctcatgtcttcattcttgccagattgtagaacttatcatttcatgccctttcctcatgtgtatcattctcgggcactacaaagatctaggcaatcctgttagattagaaatgtaactatgagctagagaccaatcgagttgcccaaactcaggagggccccgaaccttgatgagattttggtcagaaatgtcctttgtccttccttgttacttgtgagtaggccacttgagtcattgctttaaggaggaaggaacattaatagtaacacttttttttaagaccaccttcattttagaatttactgtaaaatttatcaaaaaaggctagtccttccagagtgaataagatattattcaggttatatgaatatttcgtgaacccagatgttaaaataagtaattactttctgaaatactggtttgtgaaaagcagtgggctagtgttctcctcccccagggttttctcatgctaatcaaggctactttctgaagatgaacgctttctcaattttgttttctgctctgtatgtttctccgcttgttatctaacatcctttttttactgctacttctctgcctgcccagtactcaatgtgttcatgagcactgtctaagctttttacaggatgaacatttgggagatagccaaattctggtcttccctatataatttggtcatgaactcaattatgttccttgacttgtatatgttggactagcttttctcagaaatattgtacactgtgtgagacccaaggctatatttcctacttctttcttatcttttgggatgatgaagaaaatgctggcctaataactgatggtgaaatgaattaatgaaggaggtaaagagaatctggcttagaggatagtaataaagattaaatattttttttattagattatattattcacccattcatccatccaacaaactctcatgtggatgcctgctgtttattaggtaccttactaagcattgtacagatttcaaaaattaaaagaaacagagggacaggatgatgaataccttggacttcagggtcagaaagacctgactttagatctccgatctgccccatactaactgtgtcgctgtgaaatgaagcttctcggagctttgatttcctcctctgtatgtttgttatgatgattaaatgaaataacaaacatatagaatacctgatgtaagtaggtactagatttatgttgattattaagaaaatatgtttttctgccttaaaggagcttatagtatagtagagaaggaagaatatgttcaaagtaattagaacatttttagattttcctatgagagcagcattttgtaaattcaaaggagaaagctcacatcaaactggcaatgggttgtataagttaaatgtagttgtattgctgcacaccattcagattggcatatacagatgaatgatcttcactaacttagacatagtcttgggggtcaaggataaaggtgggtttttacatttttcttgatgtgctggacattttcatgttacccacctccccagtatcccatatctattctctagccctggagagtgattttatgaattgagaggctaatctttatgacctgcatctttgctggaatggctttgattgggtttggccaatggaagataatacaaaagattagataaagggaggaagagtgacagcatggtttttattctcccagcttcctccttggctatgaatccctccccttaagagtccagcttttggtggggtcccctgcatcccattgtcgtttctaagtacctgtaatggctccctccccttgtgtcttgaggctaggggtcttccagctagccccaggatcctgtactatccttgctgatttctccagtttcatgtgctgtttcctgccaatgcttgaaatgatgccccagtcgggttggaaattattcttgcttctgcatctcctcacagggaagatgcctcatggtagagtggattcaatccaaatagcattgaaatcatgtttgtgctcagaaaacatggattaaaggggccgtgatagattttcatggaagaacaaatattgggagaggaggggaaggcttgggaaatttttcttcttaaatgaattcactggggaaatttgtaccaacttttccagtgcctgtgggttctcaagtttcttcccttttagagaaattcatctctttctctagaatgtgaccagcaggtcctgctgttgccgctgctcgcagggcttttaatcacctgtatgaacgtctgatagggctatgaaatatggcccctgaaggcctctgagctgcctttccccttcctcaaatggtgaataatcattgaatcactccacagtttctgatatgaagctcaaatcaagccatgaaaaaacctatatttcacaaggtagcatatttttgtttcctggcggtaaatttccctcactctccctgtgctgtgggacacatttggaaaggtcagtttggcactgtgtaaattaactggagggccatttgagttgaatgaaatctattgtaaatgtgtattgatgggcatagcatgggctggaggggcatggctcttgtaccagggtgatttggacaaaaaagcagaattgtaccacgggccttagaaccactgttattgtcacactgagtgatcactggaatagtgtgatgagacaatgaatggcagcagcgttcttttccaaagcttcctttgggaggtgagtattgaagttctgccaagcacgaagccaatagcttggtgtcatgaggtcttatcccctcaagtctgagcagtgctatgcattgccaagatccagaggacaccattcccatcaacatctatgtgaatggagccccctagagttgtgcagtgtactggctgtgcagccatgtaggatagccttgagttcacaacaccacagctttaggaggaggcagcatagtccaggagttaagagtgagggctctgaggttgatggtcctgggttggatcacaggtcttctgcttgttagctgtatgacctagagcacatcattcaaattttctgagcatctctgggtatgcattttaaaagtagtgatagtaataacacctccatatgtgattttgattataaaatcagataatgcaaataaggcaccttgctcagcatgataagcagtttcacaatgttaactattaatgttcttattacctaaaatgtaggctctttctggagccccagaacccattgttgtcagaaatgataataattaatggaaaaacatggacgggaacttgatttgccatgccctgttcagagccctttgtttgtacttgactcctttccttttcagagtcatataatgtcatcagtgaacagaggaacataattttcctacaattaattatttaatcaatctattcatttgtttaaagcatattaattgagcacctcttctttttcaggcaccgttttagactctggggagcagcagggaacaaagaagacaataaacaaatcatgtcaaaagttctttacactgcctctactggtctgcttgagctttatattaaccatcttattttacctgcaggaaacatgcgtttaggagagagagagaacatttagacaagactttttttttttaatggaaagtaaagctataactattattcaaatgccttggctctgtgctctttttcaggagactctgctgctgctaagccatccccctggtgtttaacctcccacagtttgtggcaccaatagtgcatcagcgagcaacattaattatgcacctactatgttccaggcactgtgctaggcacaaagaatactgtcgtgaacacaacagaaatttattttcgtatgaacatagacattaaagaaagtttgaaagtaattacttaactaatagtaaatgttcaaagaagtacctctaactgtaaggaagcagtcaagggaggcttttctgtggaagtgacatttacactgagacttgaaggatgaccaggagttgcaggggaaaggcaggtatagggagagcagcttctgaaatctctaactttttctaaaagttgaagatgttgggccatttttctagtaagttttttcccaattgagggcttgacaattgattggtcaataaatatttgttaagtgacagaatgaatagatggatagatcatccatcttcagtgagtgaatgcatgaatacataaaatcttgcattaggaaaaatcctgaagattctctggatcagggtcattggcattttaataggttgaagagagagagttatttaccatccttactccttggccttcttcttgctgatttttggctgctataatttctttcatcaattctctcttttcttttgactagacatacacagctcttccttttttttttttgagatggagtttcactcttgttgcccaggctggagtgtaatggcgtgatctcggctcactgcaaccactgcctcctggattcaaatgattctcctgcctcagcctcccgaatagctgggattacaggcgtgtgccaccatacccagctaatttttgtatttttagtagagacggggtttcaccacgttggccaggctgatcttgaactcctgaccttgtgatctgcccatctcggcctcccaaagtgctgggattataaggcacgagccactgtgcccagcccatagctcctccttttaaaaagtacttagttgatataggatataagctcattctttcttttcttttctttttcttttttttttgagatgaagtctcgctctgttgcccaggctggggtgcagtggcgtgatctcggctcactgcaagctgtgcctcctgggttcatggcattctcctgcctcagcctcccgagtaactgggactacaggcgcccgccaccatgcctggctaatattttttgtgttttttagtagagacagggtttcaccatgttagccaggatggtctcgatctcctgacctcatgatcctaccacctcggcctcccaaagtgctgggattacaggtgtgagccaccacgcccggccaagctcattctttatggtcaagtgaaagctcattctttatggtcaagtgaatagcagcactgctgacctggaaatcttacacattgaagaggaggaatcaggaacttctgaaaaatggaccttttgtaattagtcatagcttaacatccacaggaagaagcttgtgcttgtatacctctgttggaagctttgagaatccatgcccacaatgtgccatacagcaagactctgcctttgggtccaagcactggctgttttgtgttgatctgttgtaggtcaacttggaaggctatgaaaaattaccccatctgatgcttcgtttacacaatatggatcctggtggagctttgagggctttattaataatagcatctgacggtttattgaatatgtggtgcccaattactggatttgacagtaaaaggtatatattaatgacttgttagggctgacctggatggtaattgattactaatgaggcagacttgctttcatctaggcaaagtaagattttgtaactcttttagctagccctgcatgaatgccttaggagaagtgatctactaaatggatgataaatatttcatgaagagcattttacaacacccatcttactaactttttaaaggataactagatggttactagaaagtcccaggtggcaattgtctttggtgttcaaaattcatgatgtgcaggattggcccaaagtaattatagtcattgctagatttatcttgctacctgtaacaacagggttacgtcctagtagactgagcatgttttcctgcaatgggtgagtcattggcaagctttgttttgggttcacagagacaaagcctattttatgcaagcatttcaaatgtcgcaagaaatgaactttttctagccacagctataattgctcactgatacagaggtgaaatattttcctttctttttggttctgaattaagtaaatatatgccttcctgaagatgttgcatgtatattttctataaaatgctctgaatatgttttacaaatttcagttttccatctgacccttttcctctttatattaatgaatttcacctaattgaatgaaatgccacaactgacaagagttcattctgaatttgagcttcatatccccaagaagacattttcttagtaacacttagcaaaatgatatctatcaaatcactggtgcagttagaatttaatttgctctatcagctgccattgtcatgctacttaaccttaaaaaatgtaattttcctcaagacttcataattccttttacatttcttcttctttttttctcattgctttaatttaataaactattgaatgagaaaaggctgggtaagagccattcttcacaaggtgacagggaaggagtgaatctgttgtgtccccatgcgtttccaattcacccctacttctctttcacctcccagctggaatctgatgctttccatgctggctttcctcctgttgctagtccacagcatcttcttaaggaaggggaaaggaacttgccgagaagtgggagagaaaagaagaggcagcaagaataagaaaataaaaggaggaaataaaaaacagaagaaataaatagcaacaaaggggaaagaaaaatgaaagggagaagcaaattgtgaaaagtcaaagaaaccagccccgccttgacccctacctactgtgttttcaccttagtgaatatgcagctcacaaaaatatctccctcttctgagctctgcagggcactgcttcgcaattactggtgatttttcctccaggagacttttggcaatgtctggagacacttttgatgatcaccactggtggtaagaatagggaggagggccaggcgccgtggcttacgcctgtaattccagcactttgggaggctgaggcgggcggatcatgaggtcaggagtttgagaccagcttaaccaacatggtgaaaccctgtctctactaaaaatgtaacaattagctgggtatgatggtgcacaccagtaatcccagctactcaggaggctgaggcaggagactcacttgaacctgggaggcagagattgcagagagctgagattgagccactgcacttcagcctgggtgacagagcgcgactgtctcaaaagaaaaaaaaaaaaaaaaaagcagagaggaggatgctgcagtgggttaaggccaggtatcttgagttgaatagtgcccctcccacccaaattcatgtccattcagaaaactatgaatgtgatcatgttgaggaagaggtctctgtagatgtaatcaagataagatgaggttatactggatcagggtgggcccaaatccaaagactgttgtccttttaagacaaggaaactttggacatggagacacagacatagagaaaagatggcaatgtgaagacagatacagagattgggattgggctgctacaagccaaagcatgccaaaggttgccaagaaccaccaaagactaaaagaaacaagaaagtattcttccttagagactttggaggaaatatggcctggtaacatcttgattttggacttctagcctccacaactctgagaatataaagccattgttttaagccacttgattcatgtggaaacaaatacctaggaaattaatacgctgggaatggtgctagacagtctacaatgcacaagacaaccacctataacaaggaattatatgatccataacattaagaatgatgagattaaaaaaccctgctatagatcttaagtctataggtctcctcaatattttattatgtatgctttgaggtgtttctatgtttgcaatttctcacctgattcctatacgttatttaagtttttgggactttgtgtgttggtatgtcaagtaatttgttaactcttgaaaggcatgtgtttgcctctttgattcctttaatgttaattgatatgtacatagtaggaactcaataaatgcttcctaaataaatgaacaaaaactgttagcacacaagccagttgcaatgaacctgtctttacttctgtcagtagagcatattctgaggtcttgaggttgtacttttccaagttgtgattgatgttccttaagtttgagatgtctgtgtaaatcctgtcaactcagcaaagaagttctgaagtgaaaaagacatagaagaagcatggcctattggaaagagctctggaaggaaagagaagcgttcaatttatatatctttgggcaactcacatgttctctctgaacttcagttttcctttcaatgaaatgcaaatagtgaacctagtttatagaattgttgtgaagatcaagcagcttataacataaagaccttgacaaaagtactaagcaaaacttttaatttttgaccatgcaaaaagtggaagaagcatcttctcctggttcataaaagtgtcacataccaggagacataaatgtctgtatgaggcagctatgagttttgcctgggaaatacagatcatggatgagggagtaatgcttaacactgtgcacctcctgtgtgccagggatgttttcacattttctctttaatttttaggacaaccttatgaggtggcaattgctattctcaatttggaaatatgagggaggtgaaactcacaaaaagaatctcacaaagagctgcagtcagtattgacagactctgatttaatattaaagcccaaaatgtatcaactgaacatgttgcttttcaagctgatgtgaagtcttgagtggttgtttgacaaatcaaagaaaggtgatgagcccatgttgtattggaacagaagatatatgaagataatatgaagtgagcatgtgctggtcgggtgtcatctctgtgtaagacaatgtttctgacccgcctttgctgttccgtatacataggctgtttttctctagtagcagtagtaagttatacatgtgcttggtctccaggatttgcctgtaatgcattaatagtggtatctacggacacgggctagagagaaaatgatgggccatggtctcaggagtcctacaaggcactctgttgagttagctagtttcagaagtttggctatcagagctagagaatgacaatgctaaaggtctggaaaacacgtcaggatattacatggtaatccagaagaatattccaaagcctcttgttatgctcctgttaggaatttatactctggcagcttctctgtgaaactatttatgccctggtggcttatgccctaatggaaaatgtgttaatccgttggagagttttcaatgagcaattcaaagaaaaagtaaattaaaaaataagggcatttaagtgatacccaagagaatactttttgtatcagagaccagaatcagggtgaggaaaagcctgtcttaaatttctctggtctgacctaagcactttgtgcatagttatgccagacctactgtcttagtctgttttgtgctgctaggctaggtaatttataataaacagaaatttattggctcatagttctggaggctgggaagtccaaaatagagaaaccattatcttagaagggtcttcttcttgcattatcccatggtggaaggacaaagactaggtaagagagaggcaaaagggggctgaatttgtccttttataacaaacccactcctatgataacagcattaatccattaatgagggcaaagtccttatggccttattacctcttgaatgtcccccctgttaatactgttaccatagcaattaaacataaatatgggtttggaggggacaggtattcaaatgatagtacctgctatccaaagaatttatgtcagaagcccacatgaagagaaagcatggcgttcctctaccattgtgtgttggtatgtcaactaatttgttaactcttgaaattaacaaatttcattgaaggttgaaggccactcctttgcacacgtgatgctataagtcttgcctttggaagacccagctttcattacttaggtaatgtggcatctgtaaatctgatcatgtgtggatattcagggtaatacttgtaccctgaatttttttataagtttacatccagaagatcaaatataaaatatatttctacatctatttctaccagagacaagtaactttgggattcttttctgtccttctgttcaccttctgccttctctacaagctgacgccatttatttctgtataaatatgacattagaaatattttcacatatccttcctttccagtttacctagttttgacaaaacatagaccaagggtgttctttgagcctttaacttacattaaaagtgtgacatctagtgtagcaggcacatgatttataggactcctcagatattctacctccttcctgtgagaagtgctgcccaatgcctgaacaacattacggacactgggggctgaccagtcacttgttctggaaaggccagactccttctctaatgctgtttctgagtagctaggctggccagtagcaagactggagttcctggttcttaacagccatttctagacttgaacagaacctcacaatgaaggttcggattgtggcatcttgagtcactaaagcaactatgatatagagaagggcttaatactctgagagatgaactctgaccaactagaaacagaagacaggaaagatacagttagaaattattccccatttcttccttttattgacctcttggaatcatggttgatctttgcaacatgtcagtaggcaactcatgtgctgagtgatctgttctatctactcatggaatgttgtgaatcaactggtaatactttcatggttttgtatctttccttgtctcctgttacttttcctttactttttttttttttggaatggagtcttggtctgttgtccaagctggagcgcattacattggcaccatctcggctcactgcaacctctgcctcccgggttaaagcaattctcctgctgcagtctcccgaggggctgggattacaagtgtgcactactgcacctgactaatttttgtatttttagtagagatggggtttcactatgttggccaggctggtctcgaactcttgacctcaagtgattcacttgagtgcctcagcctcccaaagtgctgggattacaggcttgagccaccatgcccagccactttttctttactctttaggcccatggtttgggcctctcaaagaaaggattagcactttatttcttttctgtgtctctattttctagagacctcaggttatgacaacctcttaagttggaaagtagcttaatagtcttaagaggatcatgctttggattgtgttctacatgtcagaaaaaataaaaagtttttgtttcaatgatatgaaatgatattaaaaatctcttttcttgtggagtatgttgttatttttataaagcatctgttgcagtatatatgaaactcaggaggatggaaagatggctgaccaaaacgtttagatgtgatttccaattagttttccttggtccaacaattcatatatccattgtagcttttataccatgctttgcagaaaagctgagtgagggaagtcagttggattggctttgggctatcagaaaatattcaggctgttgccaggaaaagagtaagacagagtttcacaaaactctatttgcaaaattaaattggccaggatcaagatagtcttgcagcttcaatttggttgcatgcctataaacaaggaccatcaatacaaagcaatattcttaatagcgaggatgtatctaatgggctgccactgaggtcagctctaggtcaagtttcatttcctaatgaaaggaaaagagaggactgtggagaacattaatgaaacccatcatgattccaaagtggaaggtcctgcctttccaggagaatgaaatacatgccattccaatttcttcacatttagaaagattttctaattattttgcagtgtgtgtgattttatgataaaatcatttgaagaataagggaaataatgaaagtagcagagaaatgcaggtatgaaagaggtttatcttggaaaccacaagacctatcatctggatgagttactggaattcaatttcggacagacagatttgatagagagaatgcccaaaaatggagtccagacttttagggaagaatgggagtaaaattagaaacaagggagcagacatctcaaaaaacacccgagagatgagagtcgtatgagaacccaatcatttagttatgttggacgataagaaactagagtagtggtgtggttataataaacttgatatatccttgaaaaagtaggtgcttttttctttcatgcatggctcaagacacagtgtgctgatatattacagaacaatactttaatttcagagaatgtagctctgtgaaggacactaatgaggcgggtgatttgcacttctgcatagatgcagctgctaaatggcatggctgtcatgacttccatatacttgagcatgggtattcccacaccttgtacatggaacaacagatactttctcccagaagctggtccctgagggggcatctgcatagggtgttaaggtaaaattgctccaaggtatggttcaggtagtcataggtaagcagaaattcatttgattattaggcaaatataagtggagggccagtgcagtcagctgctaaggcattcgatggttcatggtaggattgttgagagtagatgaaaatcaaagacaagtctttaacgtcttggataagagacagaccaattggcatggcctactcatgttcgttagattgtaacacaaatctgtaatctttgccattgtcagaaaaggaccagggattgaatggagctgaggtagaagacatcactaggaatgataaccaacattaaataaggttaagcggatttacaaacatgtaaaatatgaaaacagaggagagacatattagcatgatgtgcatagatctgcataatcagccaatagttttgaaatgacagttgaagtttagtatatcaaggaattcatatgatatatccattgtggaggtcagatcatggtctctcaaagatgtccttgccctaatcccttaattctgtgaatgggttactttacatagcaaaggaattttgtaggtataattaaggttacaaatcttaaaatagggagattattgtggattattaaagcaagcccaatgtaattgtacaagccattaaaaacagagaccattttgtggctggaatcagacgtggtagaaaggaggcagaagagatgtggaagccagaaaggctaaaagcatgaaacaaacttgatgtgctgttgtggactttgaagatggaggcaggaagctgagagagacacctagttgacagccagcaagagaatggggacttcagctctacagcaaaaagaaatctgaataaggccaaagaagattctccacctagcctccaaataagagcccaggccaggtgactttttgcttggtaaaacctatgtttggcttctattgtacagacctgtgagatacatgggtattgtctgaagtctttagatttgtcataatttgttatggcagcaatagaaaactaacatattcacatatttatgtttacataaaggtatatatgttcttctttagtgtgggaacatacgcagatatttcaggaaaagtatcatacaccatataacatattagagtaaataaatggttcatcggtcaggtatacatagctttatggtcaattgcttctggcacacaccaccaaggattggtctggaagcatgatgcattttgatcattttaaacttcttccatgataaattaaaaaagagattccatgtgtgaaattatcatactatctgcttttgagggctgctggctcctatattttgtcagaaattcaaacccatcttcagccttcacccaagcttttgccaaacttgacaaatcttccagccaatattatatgtatgtatctgtgtttatgtgtctctagtatatatacatgcagatatatagttgccattttcaaagcaattttataatgtgttaagaatacaacagaattggtcctgctgaaacactgagatgcccactttctatggactggggaacagcaggtgaaggggggcatgaggctttggtttcttatcaacactgggcctatccttttctcacagtgacatctcttggaggtttttcttatttgtgcttccccatgttttgaaagctcactcatgattttacccagagaaaacagctcctgcttcattctttgcaaacatcctgattataagaatttaatgatgcactcatgggagccaccactctgcttgcctgtcttcttttcagcaccagactgggatggacagtccccctaggcagttgggcagtatgtgtgcactccttatgtagtcaacagagctatcttctgcgttttaaatctgagtgtggatactggaaaatgctaatttatggtaagcaagagctggattgacaggaagcacatagcagagggagaggccatttgttgaggctgggaaggggtaatggaaatggaagtgagaaatagagactgatgggaataaaatcaaagaggttaaaaatagaatggcttagagttaacccagagaaaggcctaagactttattgtaagtagaataacttagaaaaagctatttggatttatatctacgaagatagacgtgtgtgtgtgtgtgtgtgtgcgcgtgcgcccgcacgcacgcgcatgtgtcagagaatagggaaaatgaaaaaaaatagctaagggagttaaataccttcttggaagatcaactaatgtccagaccttgagtttatatgctgagaaataataagggtggccttgtttttttccaaagctgagaggaaatgagaggcaagcttgctggtcttaggctagaatccaagcagatgtcttagagtggatcagatggactcagcacagatcccatgctgcatcccatgtgtttgatgatcttctgagtctttttaccctgagaattgtactggaaggaagtaagaagcagggctacagttcctgagacaagttttttgagttagagcaagagttaaggctgtctttaccatgggcaaacgaggaggtattccttttggtgatatccccggcaatttgctctgtagctcttctgtggaggatgctggagaagcaaggcgatgcagattctcattttacatttgagtcagctgagtcccacaagggtaccagaattgtccaacattacacagtaagcaacatacgtaccaattgatgcaaatactctccatttttctcaagttctaaaacaattctattcccatgttgcctgagaataaccttgtttccggttttgttgtttttgttgggcaaacattggcactaccagcgtagagcttattcgtgaatgaaagaacatttgaggactcagaatattttaacgtggactaagtaactcagttggaacatgattgttatcttcacctaacagggagtcatgtatgtaaaagagggatttacttaaatccctgtggtcctagagggctgatgaaggattaaagagtagtagcaacaggaaaacagatttcaacctaggataagaaagaattttcttccagttagaagaatctaaaatggaattagctaatttgtgtgataatgaattctatgtcttctgaggtaattaagtcaaaactgaatgatcatttgccaggatgctgtacagagaattatagaattggcgcaacattggagtgggcttgtgcttgataacccagatattaaaattcactgtttctatcaaaattaaaatgactccacctgaacttctttattttattctttcctatttgcctttgatttctactctccatctaagcttttatttctatgtagggtaaaaaagggccttgtggttagcaaagtctaacttaccttcctggattcagtcctctctttttcatttcctgtctgatttactcataaagttatctacttccctcctttacctttctaatatcttctccagggcactttctttgctttaacatagcgtgcttctttactaaaataatgttcccttaactctgccactccttgtatttccaatctgaatctttccatgaagcaataatttgtgaacaattttaaaattaaaaagttggcatttctgcttccccaattcatgcacaggccttaaactcttaacatatgactcttcttgcccctcacgtttattgcggtatacctgacaaataaaaattctatatatttaagaggtatgcaacatgatgttttgatgtgcagatacattgtgaaatgatttccacaattaagctaattaatatatctatcacctcacatacttataatttttttgtggtgagaacaattaagataaactcttttagcaaatttcaagtatgtattaataactcagtattattaactatggtcagcatgctgtacagtgggtattcagaatttattcatctctcttaattgaacctttgcatcctttaatcaatatctccccatttcccccaagctctactccctgaaaaccaccatgttacttttggtttttatgagttagaaatttttacagtccacataaaagtaagatcatgcagtatttgtcattctgactctggcttattttacttaacataatatccttcaggttcatccatactgtcatgaatggcagatttccctcattttaaggctgaataatattctcttatatatatgtacacattttctttttccatttttctgtagatgaacactcaggttgtttcaatatcttggcggttgtgaattatcttgcaataaacatgggggtgcagatatctctttgagatcctgatttcctttcctgtgagtgtatacctagaagtgggattgctgaattatgtggtagttttatttttaattttttgaggaacttctgtactgttttgcataatggctttaccaatttacatatccactagcagtgtgcaaggggtcccttttctccacatccttgctaatatttatcttttttaaataatagccattctaataggtatgacgttatatctcattgtggttttaatttgcatttttctgatgattattgacgctgagcatcttttcctacacctgttggctgtttgtacgttttttcttgagaaatgtttattcaggtccttagcccatttttaaattaagttgtgttttaatttttcttttgagttatttgagttccttatatattttgaatattaaccatttatcagatgtatgatttgcaagtattttttttttccattttgtaggttgcttactccattgattgttttctttgctgtttagaaaatttttagtttggtgtaatcctacttgtctattttcgcttttgttgactgtgctttaagagtcatatccaaaagtcatcacccaggccaatattaacaagcttttcctcttagtttcttctagtattttctagattcatgccttgtgtctaagtctttaaactgttttgagttgatttttatgtgtggtttagataagtgtccaattttattcttcagcatgtggatatccagtttttccaataccattttctgaagagactgttctttcttcatttagtgtcctcagcacattttttgaaattcagttgactgtacttcctcagttttatttctgggctctctgttgtattctatttatcagtattggttttcttttttttttttttttttttttttgaattccactatcgtggtttttgttactgtagttttgtaatatattttgaaacctagaagtgtagtgcctccaacttttcatttgtttgtttaagattgatttctctattcacagtcttttgtgttccatatcagttttaggacaattttttttttctatttttgtaaaaaatgtcattggggttttgacaaggattgcattgaatcagatcactgggatagtatgaacattttaacagtattaattcttacaatccttgaacaagaaatgtctttctattaatctctatcttccttaatttccttcaccaatattttgtaattatatgtaattataaaataagcatacaagtcttttaagtctttggttaaatttattgctaaacattttattctgtttgctgctattatgagtggggttctttcttaattttcttttcagatactttgtttttttgtgtagagaagtgtgactaatatttttatgcaactttactgaatttatctattggtactaaaaggttttttgctgaatgtttagggttttctacatatatatcatctgcaaacagacataattttactttttcctttctgatttggatgtgatttatttatttatttttcttgtcttatttgctgtggataggacttccagtactatgctgaatagaggtggtaagagtggacatccttgccttgtaccagatctttgagggaacacttttggctttccctattgattatcatgtgatctgtgggcatttaatatatggctttagtgtgttgaagtaagccccttgtatgtctattttgttgttttgttgagagtttcaatcatgaatggatattgaactttgtcaaatgttttttggcatctactgatataataatgtagggttttttcctttttttttttttttgttaatgtggtgtatcacattgattgagttgtgtatgttgaaccatccttgcatcccagggataaatcccacttggtcatggtgcatgatccctttaatatgccttttaattcagtttgctagtattgaggatttaaaaatctatgttcatcagggatgtttgcttatagttttctttcctttttgtctctttggtatcagagtgatgctagcctcataaaatgagtttggatgtgtgctctccttttatcttttttggcagagtttaagaaagactggttttaattcttctttgaatgtttggtagaattcaactctgaaggcttctgctccagttctttcctttttggtgaggtttttggttactgattcaatctccttatttgttattggtatgttcaggatttctgtttcttattaatttagttttggtaggttgtatatttctaggaatttatcaattttgttggtatacaattgcccataatagtcccttgtaatcctttttatttctgagacatctactgtaatgtcacctttctcttaagctatctaaaggtttatggattttgcatattttttcaaaaaataaactttcagttttgttaattttgtaattgtttttctattttctatttgatttatttctgctctaatatttattttctttcctctgctaattttgatcttttttaaaaactaatttcttaaaggtataaaatttatttgagatctttcttcttttataatgtagacatttatagctacaaaattatatcttggtattgcttttcctgcatccaataaattttgttatgtagcatttttgtttttgtccatttcaaaatgtttttaacattttaaaaatttttttggcccaaaggttgttagagtatgttgtttaatttccatatattttctcattttcttactgttactgatttctatttttattccattgtgttcataaaagatatttggaataattacaatcttcttgaatttgttaagaattgtttagtgacttaacttgtgatctatcctggaaaatgttctatgtgcaattgagaagaaagtcttctattctgctcttgggcagaatgttctgtatatttctgttaggttcattcagtccgtagagctgttcagttctgctttttccttactgatattctgtttagaagatatatcccttatagagaatggagtattgaagtctcctactattattgtgttgatgtctattttcttatttagatctgtcaatgttcactttatatatttaggttctttgatgttgggggcatatgtaattttaattgttttatctttctattgaatggatctttttgtatataataactttatttgtgttttttgacaatattttttgtattagtctactttgtttgatataagtatagctatccctgatctgtttgggttactttcacatggaatatctttttctaccccttaacttttagcctatgtatgtccttaaagctaaagtgagtttcttataggcagcatattgttgcatctttttaaaaaaattcattcagccattctatgtcttttgattggagaatttaatccatttacattttttgataggtaaggacttagtcttgccattttgttaattgttttccaactgttttgtagtttctttctttcttctttgcttctgtcttcctttgtatttgatgattttttgggacagtatgctttgagtcctttctttttctcttttgtgtatcaactagaggctgccatgaaatgtatgtaaattatcttacagttataacactatttttagctgctaataacttcagtcacacaaaaactatacttttactctctcacacattttatgttattgaagttccagtttacatcttttaatatttttatccgttaacaaattattatatctagttatttttaatacttttgtcttttaacttcgatagtagagttaaactggtttatattacaccattgcaattttagagtattctgaatttgactatatacttaccttttaccagtgagttttatacttgcatatattttcatgttactaattaatgttcttttgtttcaactcaaaggactcacttaggatatatatttcttaaacctagtcataggtttgcttgaggatccataattcggctaagttcagagggcctgctataggggacagggataggcatgtttcctggatgcctggacagagagtactggccctggactgcagcagagcaggactgaaacagaatctcaggtctgcttaagtctccatagctgagactgaggtgggagggcctgccacaagaagcatggatgtgagtcactgggttcccaggcaggcagggctgactctggactgtggtagggcagggctagagctgagtcacagagctacttcaagatctgcagtagggaccaaagtcaggtggattgctaccaagagttgaggtggatgtgtttcctgccttcacccagttccctgggtgggcaggactgcttctggactggcaggatgaagcttggagctagaaatgagtcacaggactgcctcaggatttgcagtttaaccaagggcttaatacctggggcatggacaggtgtggcttctccagagtttcttggcacatcaggctggttgcaggatggtggccaagtgaggctggagctgagtctacaggggaatggggcttctttggtctgcagctgtggccaggcttggtaagactgccactgggacaaaggcctgctttctcaaaggggatctccttggttatgagcgttgccagtgtttttcaatctcgtatctggatcctaaagctcctacaaaggcacttttgtctgcggggaatgattgccagatcaatttttgtgtgggcagatgcaaactgggcacctcctgttctgctatcttactggtgtcatttagacatactactctttcatcatcattttactgagtggtgggtacttagaggtttgttcccatattctttgtaactttctggtttaaaaaatttctcatgattataagcctctctaggatctcttccttgtcaaaacaagcagcattttctcagtccttgtccccacttgaattcttcatgacccttttgtatggatgatacatttcctcaccttctggaagccctctcttcccttgacctccatggcaggatcatactgatttcctttctattccctctcatatttctaacagtagtttccccaggaaacaatattcacctatttttcttctttctctgtatctcaggaatgtttatgattactctgtttcagctataaacctgtatgcaaatggctctcaaattcattaatttaggcctgacttgtctcccaaatccctgattcatatttccaaatgcctgctcgagagctctccttggttctcctaaatacctcagagccagcatggtgaaaacccagttgataaccctccccctgccccactcagctcttcctgctccctcttgacttgctcttccttatatcaccattatccacactattcaggctcaaaatttagtaatcagagttgattctttctcttactccataatcagtgcccagcttttatattctacctataatttctttcaggtgagcatcctgcttttctattcccccatctctattttagtgtgatgcctattatctctcctctgaccccttcttacccataatctctatacacaaagtctctgttcttttccatcataacttccatactctggaataatcattcttttcttcagacgccatcacttagcttcccttactgaaaaaattaaatacagtgtgaaattcaggatcctccacaatgtaggacccagctctccacatactttaaccaccatgaataacagccattaataatagtgaacatgaatgcgaactcactgtgggccaggcattgtgctaagtgattttaataacccaatgaagtaggtactgttattataatttgatagttacattaattatgtgctatagtcagagagttagtaagcatttgagcctatgtgaggggattccagatcctgctaccattttggtgttttattggcttatcacctactcgtaccacatgaagctttaatctggaattttaatgcgtccaccattgactgctgccccacctcccactgattggaatgtttttctacacatgttgtgttagaaaatattttctttcctacagactctttactgacccctgccccatatttgaaatcctacattatttactttgtaatattgatatacaactgtatttatttcttataacaatgtgtgcccttagcatctcagttttaatattttttatctccatagagacagaaactgtgtttcaatccctttttttatgctttaagttacttagaaaagcaccttacctacaacctggtagggtcttcatttgaattaaattggctagtagcactttaactaaatatcagaacttgtcctaattccttacaatgcacctttcatgcttttatgattattacttcttgcattagtgtttagacagcctgcaggagccgcattgatttatatgtcacacatatatatatatatatatatatatatatatacacacacacatatatatatacacacacatatatatatacacacacatatatatacacacatatatatacacatatatatatacacacacacatatatataattgatttatttacatctccagaactgccctgctgaggaaaagaaaagtctatttccacaaaagacaagcagtagtaactgaaaaagtgtcacagcaatgtccagacagaaggaaaatgttttaaaattggattaattagaattaatggcctagttttgatctcctacattagtcagaagagattcatctaagctattcaagtccatgtgtagtagtctgaaatttttctacagagaagttcatctggaagaactaattttgagttatctgaattcttctgatcctaacattttggttgggagaaactgacaatgaggaagtgatgggcacttgactgcttgctgtagatctccatgtctttgttacccaagatggaggggtgcaactgtctcaacaactgtttggaaaaataaattgaaatttaccatttgctagccctgtctcggagagtgggtaattgaatttttgcctcttatgtgaaacctattcttacattctctctctatacccatttatctctttacagagctgcctgaaattattcatatttcttattttttagccctttttctcactcaaaccattgatttttttctcaatcacacccattactttttagttctgctttctaagaacctttaagcttgtttggtgtgtgatgaatacattttttaaaatgttttgtgacagaacatttctggggtaagggagtgataaatatcaaatcaaatggaggctaggaatttaattttccctgtcagggccaatctgtgcttcgttttatcctgacaaaaattgatattttatccctgtgataatggaagactctgattgtagtgccttttcataatttgttggaaaaaaatctttttttcctcctgagaaacttgaatcaaagcagagtggattctgtgcagatagtgaagaaaggcacctgatattcctttagccctttgtgtccccaggcctggcagcaaatattttcataaacttgctcaggttctttattaaatgtgtttttttctggtttaatctgtggttgtcaccaagaaatttatctagaaaaggctgtaacacaatcctcccctacattcttcattcagctccatttcttaaattaaggaagacttgaggagtctgagacaatggctgaaaactgaccttttaagttaacacaccagaatttggttaaggctagagaggaacaaagtagtacttatttaatgaagacccttaaagagcttcctttgagtgaggcaacatttcagagatctctacatattaattcatttaatggtcatcatatcctatatgatgctgatcctatttttaatcctcattttatggttgagaaaactgaggcaaagagaggttaattgtcaatgactcaagttaccagcaagtggtaaagccaggattccaatgcagccaggatcaatactcttaatcacctactctgctgcctccacattaaattgttcagttagatgtgcatctatcctggcatcacccgtctctcccagacatcttgcccgttcttatttgttcagtctctgaactactctttggaaggatgtttcccatcatatttctttacattccccaaacaagttatgccagaagcattcaggagatgtccagactcccaaatcctggaattacttctgcctcagaggtgcagtctcagctctgtcgaaacaaactatatgatcttggggggaaaaaggttcctttactgtctttcttgtccatgtgtaaaataagatgaggctcagctaagtgattgcctttgttccagcaataaggtgttcgccttgaccccatactctgcgacacccgggcttgtggaccatgcttagaaatatgtctcatattcagtctatcttctgggggcgggccgacttgggtcagctaaaacttttcaccaaatctgagataatgtgtctgcatgtgtgaatatgtgtcttttaatttcatttaatttcatggaagcctgaccattagttaagaactgtttagaaccaagtgacaaaacccaattgaaaatggtttcaacgaagtagaaaaatctatgggctcatgtaaatcaaaagtttgggagaatggaatctttaagcatggttttatccaaaaactaaacaatgccctcagaatttagtcttttgccatgctcccctctgtgtggaatgtattttgtcagggaattctaatagacagtctagtttattcctagagatacaagtttatatgttactaattagcaattctaatatgaagggaattgcatgaagcatctttcctattaggtcaaatacaagtcctagagctacctcttaggagactgatttttgtgccagtttttaccagtcagtctgctgggggcagggtggtggtggtggtgggaggaatgatgatataatatgcaagtttcctgtgcccaaaacctagggatcatacttgcctgaaccacatgggctgaaagtagggaagcaattgttaactgaaaaaaaaaaagtttcttttaccagaagaaaagagatgcatggtagggaggaaggcaggaaaaactaagatatgtaatccgtagtatgtgaagctcagctgcctcctcccatatttacaagtgtgatctcagaaaaagaggcttttaggatactttccttgtcgtccaaacagatgacgttggtagataaaatataatttaaacacatgaaaagaacataagtccagaaataagttatcatggaccacaaatagaccagaaatttgaaatgttgaggaagacttaagtcagtggcttgctgggctctaagactagaaggagacgtggtagctagcattttactcctaggctatttctgctaaaactaataaacatgggttagggttctagagtcaggctcactatttgatgtcagagtctggagctgggtttggttcccctcccacaaagaaaagtacactgaaaaaaataaataagtgctgattcacgacttcgggatttgttttttcagaatcaatggacctacaaagtcaggaggataaagatgcatccaggaatagcaccaagatgccatagccctaatatcaccatgggtaaagagctccctaatatttctggactgggggtctgaaggtgagggaagacaaaaacagcaccactagataggtacgatattcacagacggagggagagagataaacataaacaacaaccatggaaaacccactttcaacatgaccctataacaaataaaacttccaaaatatgtcatgagaaagacagccaacaaagccagtaagaaaaccacaaattcactctatatgacatcaaatatataaaaattttatatgaagattttaaagttactacatttaggatgctcaaagtgacaaatgaagaaataatgtcaattaagaagtgtgagaattaactagtttgaaatcttgtaaatgaaaaaagtatagtttattcaaaaaagtaaatgggataaatttaatcctagacacagttaaagaaggaattaatgaagtgaaagaaatctgctcagaggcagcacaagaggaatgggataaaatatttctgtaagcacagttagtagacatgaggatatactgagaggctcgcacatttttatctgatagaacttccagaagagaatgaagggaatggtggagaaacagtattataagatgtaatagctgaaatttttgtaaaatagaggaaagatttgtctttcaaaagtgtattctgaatatcaaacaaaagaaataaagattaacccacacttagaaacatcatatttaattagcagaacaagaggataaaaagaaaatttgagaatctgcgcctgggagaaaaacagatgactttcaaagagacaacagttagactgaaagaaagggatgagcaacaaggcacaatgtcttttaaaagaatgaagttaaaagtggaagttttcagtcactgaagatgaagaaagtctaccaacaagaccctcaataagggaacaattaatggatgcacttcagcaagaagaataataaacaagagatgacaggcatgttatatgaggaatgatgatgaatatagaaattgatacattttatgagaaattacagaaaggactggctacaaaaactaattcattgtttaatttgataaagcaaactcgagatagcaatgccaatatggaagactgaatttaatgggtacttaaaatatgttaaaatttttgtcatattttggggagtgcagatgcattgtaaatacataaattttgttcagaatggttataggctaaagaaaaccactaaagtcaagacataaaatctataatttgattgacactaatagataaagagtagaatatattaaactccatcaacttaagcatgactggaaagtagagggggaaaggaacaaaaacagactgataaacacaaaatcagttggttaaaatgagtgtgtgtatgtaaccagtaataccaataaaaataattgggttaaagtaaattatttttggctaaaattaacagtttgagaaaaatgaaatcgatctccatctctgctaacaagagacatacttaagatgaccctcagagaaggtttgcagatataaacaccaaacaagcttgtgcagtaatattaatattaaatgagaaaaaaattatggaaaatctaatgatagggataacaagggctactgtataataaaaaatacaatcatgtgatctatcaagcccctaccaacagaacaaaaacagaattacaaggaggtaggaacaaacctataaaatggatgatttaaacaaatatttctaattggcatatatagaatttcacacccaacaactggatttacaaaatctaaccatattccgggtcacagaagaaaaattatcagcaatttaaaaaatcaatcaccggttttatgagcagagagcaatttacttccatctctatcataaaaaatatttagaaacttgatttttcattaagaaatcaccctagaatttaaaaatgtcttgaactgaaggacaatgaaaacattacatataaaaacatatgaggtgtagctaaatcagtaattagaaaaaattttctgcccattaaaccagtattagccactctgggtaaatcatgtgtcttggagtgaggatttacatctgcagctacctagtaagcctcattcccactgtctctattccttttttttttttttttttctttagacagaatctcactctgtcacccaggctggagtgcaatggcatgatctcggctcactgcaacctccacctcccgggttcaagtgatttttctgcctcagcctcctgagtagccgggattacaggcacccgccatcatgactggctaatgcttgtagagaccgggtttcaccatgtggccaggctggtcttgaactcctgacctcaggtgatccacccacctcagcctcccaaagttctgggattacaggcgtgagccactgtgcctggcctgtttctattctttaacgccaggacaggtgatacctgcccaaagcacagcctgtgatatctaacctgagctgatctatactactttgcctctacttatctgctctcatggcacatctccatctttcttaccgtagcattatccatgaccttgtttaatcctttctcctccttccactcctctttccactagcagtaaactatttgagggaagggatctgtatatgccctgttccatgtaagagacttgtgcatagtaggtgtgcagtaagtgttcacagacttgagtgccaaagtgatcacagaaggcacctacacatagtgcctctgcatgtgaagcatgtgaaggctcttgggtctatgggtctggggttcagagcagtgctcaagctatagacctgactttgagaatcatcagcattcagatgatatataaagcctgaaaatggttaagatcacttaggcattgactggtgtgagcaaagaaagcccaggttcaggaagagaggaatggcagcacagtccagtacagacttggagaaggggctagctgaagaggtaagaggaaaatgaggtgtgtaagtacctgcaaatctggagaaaagagtgtttttttaaaaaattaagttgtgcttcgtgcagctggtaggcaaagaacaaagagatttgaaaggagttcacaggaataaaagcaatggcggtcattggggcctggagcaaagtcagtttgaaggaaatggtggagttggacatgagattggagtgagctgcctgcataattttgtgcatgaagagctctgcctggagtgccttttcttccacccctcaagtcttggctcacagcctgtcctctgcatgtacttcatatatatcatatgtttttattatatatagttatacatatgtaatatttatcacattgcatatataggatataaataacatacacacatatacataagtttttactactacacatcacaatcattatctactattatacgtcattattatgtgtgtgtggactcccatacctcaccccggctgagaatgtgaggttttggggtcaagaccatttatgtgtgtgtcccagtttccaacaccgtgtgcagaaatgtgttatctttcccttcatagaaaatatttttatgagggtgagagacgcacaaaggggtggtgtggtgaggggaaaggctaaggcaacaacgctgcctctttccaccctttgtaatgtgttttggcacaattttggttggctgtggtaacgtagtagagagtggctgcttgtaggggggaggtgaggtgtgcagagccactgtcagagcagcatctgcctgcactcccggcagtggccacttccatctggggcgggggtacctggcatccctcagacatttcttatgctcctttgcctccccaccctcccagcatttccccgaaagtgcagtgctaatggacccatagctgctgggcttttcatcctggtataatgtggcctggggccaggcagagatggtggataggacagacccttgccttcatcagcatgcctgggcatgaagtgcatatgagttctgtgcagactccatgttgtgcttttccaggatttggaatgagaatgtcccaattcagccaagagtagcacccatttggttggcttagtcttggcctcaaatgtaacataagttaaggtcaaatgtagattgtttccccttctttccctccttccctcctcccattcatcctactcatcatttccccccttggtgtcttttatttgagtgtctcatctgtcttaaggtcaaatgtagattgttttcccttctttccctccttccctcctcccattcattctacccatcatttcctcccttggtgtcttttatttgagtgtcttatctgtcttcctttctgtctttttacctgccactttttctctctcattcattctctatttctctccattcatacatatgcacatgtttgcataaatgcaaatatatgcttatatagttcattccgatttggaatacagacttttggtttttttctcttatggtcgtagttttcctggctacctctacaatgtcacctgggaccaatacctgagaaactgtttccatcggggaggttgctctctgtctcacgccagcctggctggctagattccagatgctacaaaggcttctctggaaaaattaagaagacaaggggtagggcctatagggctctgagcagaaggtatcaaggtagttatagtgaggaagaggtccctcccacccttgctgcccctacagaccagggaatccagctgttactgggtgctaaggatgaaatttggattccagaagagtaaattttaaagtgctgggaagaactgatctaaccctgtaacccctccttttcttcttttcttttctttctttttgtttatagtttctggcacgtaatgaaatggtcaaagcaacaggaagttttgaaactagtcccacatccccttcaaatagcatgcagcctaatgggtcattacctttacaaatatacctcattgaccctcacctaattaactccttgtggtttaatcaacatatccttaggaaaaggttggtgatattttgcttgaaattctctagtctgactttttatatgcaattttcttctagagtgtgtgcctcttataatgtgattaattactttcccccggaagaagtcttggcaccctttcaacacttagaagctctgctctcatgggcagagaaatcaccttgacatgctggggcatgagcagggacagaatagtaatggcttagcatggtggagggcatgggaatcatagaaggcttgctctaaaggccaggactgggagcttggctgtattggatgagggttttagaaagttctatgtgtcagagatgaaatctaagtcttttagcagatctgaggagaaggtacactaggcaggccagtggccaggagtccagggagagcaggcaccagagtgagaatccagatcagagaaccaagcaaagaaaattgaagattcaggtggagattgtggggataacaaggtcaagagccccttggacaaagacaaaggtaacagaggaaaagctgtaggcaaagcacagcatgctggaaagaccaggggttaagtctcacattcggtctgggttcaagttcttgtgctatttacaaggagtttctccttgagcataattaacatctgtagccatttatattttacttaaaatgaaacctataaaacccctttgctttattatggtgaggtttaagtaaaattatgtgtgtaaaatgctaaatacagggcttgctgtatagtagctattactaactgataattcactaccccctgccctagacaaggtcctgtggcatagctgtatgaatgaaagttgaccgtcatacagaggttagcaggtgaggaattcctgtgggtttcttacctaagtccgacttggttgcatatttagacagaaactcaagtctagagtgtttacttgacttggtgaaggtcccagcaattgttagaaacaaagccagaaatataactcagcttttctaaattctaatccgcaggtctctccaattaagcatgtaaatacttaatggtatccattgatacttggagccaaataagatttgtatcttagtgaggaaacgtctgtggatttattacaaagcctatgaagataagtgttattttatgtttcatggatgcatcttaatgactgccctacaggtctgcatgtttgactttaatgcttgcatttatctaaatgtcataaaagtaataggaagaccatatgaaggagatgatgagaaccaggcagcaccttctttggggcatgtgacttgtcttgtgtatacactgctggtgatggatcattttgatttatctgctttcccatcccagtccctctggccatgacaacaatgattggagttagagcacagtctgtggaatggagtgagctaggttgtctatctaaaacccataaattgaggatcatcagtcaaacacttgcctcatgcatctatctggccaaaaggagaacctcagagtccttgactctgcttttagctcctgatttgctccatgggtatctctcatgaaactatttctttggaaatgtagcagggcttagttaagaatgtggcacacaggagccagactgcctgctttagaacccagcctttaggacgttttttccatattatcttgagccagtcacttaactattcccagcctcagtattctgatttgtgaaatggtgcttacagtagcacattcatcatgagctgtcttgaggataatttgggtcaaaacaaccacagtgcttagtcaatgatggatacatagtaaatgtgtcttaatttgttgtctggtcctaaagctacagattcttggtttccctttgtggaatctgtcacactccttctctactcagccacttgggttcaactcttcccttgacttttggtcagacccaaggcagcctatctgacccctggtaagatgatatttgggcatgggtttgctttgaaaggtgctgtattagccattctcacactgcctaaggctaagtaatttataaagaaaagaggtttaattgactcacatttccactcggctggcaaggcctcaggacacttacaatcatggcagaagggaaagcaggcaccttcttcacaagtcggcaggaaagagaagcatgaaggaggaatttccaaacatttataaaaacaccagatcttgtaagaactcactcactatcatgagaacagcatgggggagactgcccccatgatccagtcacccccccaccaggtccctccctcaacgcatggggatcatggggattacagttcaagatgagatttgggaggggacacagagccaaaccatgtcaggtacagaactcatgatcttgatttgtagcatcatattaaactccttgaattcttctgttctcatgtcatgttggccttttcactaatccatccctagtgtctttcatggtacctgatgcaaaaaaggtactcggctgtgctgaccacatgagcaagtacatgcagggaagaaacacagtctcttgtgtagcccttagctggccctaaaaatctgtactttgcactgctgctgcttctgtgttcagttactttatagtttactgagttttggcaaagggtagaagaccaaggtgtgggagccatgggtgaaggagaagtgaaagaatgccataaagaaatgccacttttgggccactgccaatggctaggcagggctcatgttgggaaaggaagggtggagtcctatttgacgcattcacattctcagagtctggtgagccaggcagccaaactgctatggacaagttggtgtgtcttaaatcaagttggatctgagtaggcatttatctaatatagtttatggctatgtgagcatatggagagcagaattatgctagagaggtgccaaggttttagctgagaatatggtatgtgttttaagccttcctgacaagttagagactcaatgggacaaaggagaaagatgtcagaaggatgccactgatgtcagaatcagagacaattgtcagctagatgagaagaaggtcagtgttagggatatatttttacccaaatttcaaagtctgaacagtttctgcaaaactgccctcactctgtactaactgcaagtttgggaacttcccagaatcacccttagtttccatgatttgctggatcactgcacatctcactgaaagttattacactcagtgataatttattacagggaaagaattcaaattagagctaggcaaagaaagagatgcataggacagagtccaggaggaattgaaatgcagagattctgctccttttcttcctgtggaatcctggttggcattacttcctcactgccatgatgtgtgataacaggtgtaaagtattcccaaccagggaagctcatccagtccttgtatggagtttgcattggggcttgattgcatactgcctatgtggctgacctgcagtctctctccttgcagaggctgggctaatacctttagtctccagttcctccagagcttggaacggctagggctagagcatggctcaagctctcatcttaagtcacattgttagacagtcctggtgccaaagcacccaaacaaatatactccaatcaggtagaacattctaggggcacagggggtctcctctatgtagccaaaggcaaaggccagacttatctttgggtaaagttgatgcttcattgcatagttattaactcttaaattccccttttgtccaaaatcaccttgcaaatggtggcacagggcaaaacagattatagggactctaccaagctagaccatattaatttatgatcctatctatatgggaaagccagatagagtgggccaggtctttataagtcaggattatgctggtgaggtttttctggctgggcctaatggtgcagaaccaccacggacccagtcctagccttcactttgcagtctcagatacttgattttatccattcatctgggtgcattggattatatggaccaatgccccaagagatggattttaaaaatcacaaatctattaatttataattaaatatatactcacatatgtgcatacctttactaagaaccagaagaagtcactcacatggcatgtctcagtcttgttgaggtgagccactcaggacactgaaatacatcgcagaaggcagcttattcagcacagaatcagagcagagggagctggctgttgaagatatggtagttctcacggcctgaagactggccttgcctactctagcagcatttttgctctaaaataacagtatcagactcctaaaatgagagcacaatttttcctggtcagtgctaacaagtcctgtttttccaagtctccatttttattatttcttatcaggtcccaaaggcttctctcattacattttgtgttataatttacaagcttattttatataagtgacatctcagagtaagtggttcctagtacattaatctaaggcagctttaagttaccatgtagagtaggttagggccgccctcgtccaggtgggggctgccatgctcactaggtccaggagctagatattcccagcccattcctacaccagggattcaaggacctggtgatttggaggtcatctttgatttctctgtttttatcttctagagataacgtgagcaggtattattcgtatgattgcctgaagataaaaactcatgctcataagatacatatcctgctgtggtcctctcttctttcccatggtagaagagagaccattaaaacaaataacaatggtaggaaaaaaatagattgtaatatctggatgggaatttaagtcctggtgtaacatccaggcattacaaacctgggcttcatgcttcattttgcctacggaccaacttagcatctaaaacagtcataccacagtgtgtacatatgtatgtataatgcaaatatataacactctgcataatacagcaaagaaagagtggggcaaatttcagagtttaaaatgcagtattgtcatctttttagagctggagttaccttaatgtgctgtctgccccactcaggcaaactttaaaataatatcatatttctcaaaaccctattaaactgtcacataaattccctttatttccctttcccgtcaatgctgattaccacagaagatatttctgtgtcagtggaaattttttcccttcccatcggccttcctctcttgccactttcttttgggggtctgtctccaggggccagtcttctagagacccctttgcctcagccgaacagaggaaatacaatcactcagccagccctggtcatccagtgctgtttttcatgtaagtgctgagtagcttcagcttccaactgggccattctgagagctatgctgatttcacaggggcttacaaataggtgatactgagcatttcctatgtatttggctcaggctaagctctttattctgtctcctttaatttttacaatgcagtgagatgggattattattattattattatacccatttcacagctgaacaaattgaggccacatgtaagtaacatatgcaaagtcaagccacaaattcagtggcagggcgagggttcagggcaaccaactgccccagttttcccaggttggaggagttcacctggacgcttgctttcagtgctaaaacttggacagttcttgacagagaaggatagttgatcactttagtttttttttttttctttttttctttttttgagatggagtttcactcttgtcacccaggctggagtgcaatggagcgatcttggctcactgcaaactccacctccttaggtaaagcaattctcctgcctcagcctcccgagtggctgggactacaggcacccacaaccatgcacagctgatttttgtatttttagtaaaggtggggtttcaccgtgttggtcaggctggtcttgaactcctcacttctgatgatccacctgcctcagcctctcaaagtgctaggattaccagcatgagccaccgtgcctggccggtcactttagtttagatttcagtccctctgactacctgaaaaaacccttgttcttaaccatgaaggatactgccttacccacatggaacagaatatgataatattattacataaattaatacgataatatccactcttcattatttccatctttctaaatttttatgttttacagaaaactttttaaagtcaaatttgagtggttctcattcaaactagatatggccataccaataatgtattcactcattcatttgattgagtacagtttgaataataataatataattttccttaataataatgccagtaattatacaacttaactaattacattgattgggcaattgatgtgtgccatgtactttgcaaaatgctttacatgcattatcatatttaattttgacaacaaccccatgagatagggactattgttttccccagttttgtaagtaaagctgtgaagctcagggtacttcaatgactagccatagagagtgggcagagtcgagattctgacccaagtccagcctgctcactgacacaggacatagtgatctcaacacagcttatttgcccttctctacagagtttcagagctggtttcaagggctttgcagtggagcagtccaatcttaaccatgtagctgtgtctcacttaaaaaacaactgtgagaactcttaacttttcagaaagattcatagcagggtgcttcaaaattgagggctttcaaagtaaatttaaatgatgacttgatttgtaaaatattcatttacatgcaatctgtaaggcctatctctggcacaatcctttggcatggtctaggggattgttttaaaccaaggcactagagggatgtcgttaggcttgtattaaatgacttcccggggacttttaaatctatatactgctcaggaaaaactgacgaccaaaaaattctcacatgatagacaactttggtcacacagacagatattctggacccagagttcccttcctccctctctcattccctcccctgcctgcctgcctccctccctccctttcttccttccttccttcctttttttttttttctttttctttttgagacagagtcccactgtgtcgcccaggctggaggacagtggtgcaatctcggctcactgcaacctctgcctcccgggttcaagtgattctcctgcctcagcctcctgagtagctgggattacaggcgtgcgccacctgagcccggccctttccttccttttttcctccctccctcccttccttgttcccttccttcttttcttctttcctttcttttctcctccgtcccttcctcgcttccttccttcttcctccgtccctttcccctccctcactccctccctatggcatattcatccgtctgtgtcattctctctgcttctttggtgtttgtctttctctctgtctctaaaccctgcaagaaaaaagaagtatttccattaacttcccgttcatttacaaggccatttatgcacatgcttggcttaaaaatctgttttatttggctccaactttcaaattgtgtcctttgaaagctactcattctcatttgaatcctctttggagccacatctcttaatggctacacagcagaactttttaaattcttgcctttaatgcctgccttattctcagacagggtgatatcctactcactactctttgttgttctaatccacattacttataaagtgtgtgtgtgtgtgtgtgtgtgtaccagtcactgtgcttgtttctaattactggggaaacaaaattgaattaaacacatatactcaggggccttttaaaatcctttttaggcctgaggtactttaagaattggagggcccatcatatagcatattaaacataataaaatgcaatcacaacccacattaaatatcctttttgtcactgaatttgaaaaagtttcatgtttgcttttacaactatttggctatggatgatatttaatttatgagtgactcttttgccatcattgtctgtaattgggaattcttgtgaagtgtggaaatcttacctacaaattgctttcaaagtcaatgacattcttatgaatactaaatttaacaattaatgaagttgacataatattctattttttggacaattaaatgtttatttcaatttaatagtttcttttcatgttttggagctgatacactttttttttcaggtctcaaatatttttctgaatcttacaaagtgtgttggctccaggaagactggaaacttaggggtaaaggaccctgtgtgtcttccctgccttgaggcttgttctggctcaagacagatagaaaaatctagaagtacaaggcaggatagactgaaatgacccatgctatggtagaaattagggccagacagcataggagaacaggcacaggagaacttaattcagtctctaaaggaggaaagaaggaaatcccagaatgggtgaaacacgacgtaaccagaagtccaagggagctggtcaagaagagagggcgtgagagggctttcctgcagaaggaggggcctgtgcaaagatcaggagcagaacagagcatattgaaccaaattgtactgtgggggtgcaggtgggggtctgtggcatggggtgaacatctccccattgggaaggcagatcatgaagggccttgtgcctcaataagaagtcttgattttatcttgaggccaatggggagccgctgaatatttggaagaaataggaatggagaggacggaaaatatccaaaaggtatttaggaggtgggaatgatgggacttagtaacgctctgggtgccaggtacctctgtgatgtagatgtcttgtgggactcccccaccgccctgccacatttccagaagagttgactagaagggtggcaatgcagggtaccttccccacatcagtcccaggggatggggggcaggggagtgggggacatgcccctgtgcagggttgacacatctttaagccattgtctcaggccactgctggtatgccacacagacccgcaggaaggttttaggatggcagaagtaaactttgaaacgaaggggccagaaataagtctttgagactgtttgcaagcagcaaaagactttgtatgcagatctcaatttcccattttcaggcctaaatgtgtcactaatattctccgtcaggctctctgaccagacctgctccccacacactctgttgattccacacatcctaggagttcttggcctgccaggggctctttcttgttgcccagtcatctgtaaatatacctaattctaaaggtgaatacatttaaacggcttaaacgtaaaaggccggttgcccagcaactggaaatctgaaatacccttgtcaggctatgtaagtggagaactggcaggccaccgctgtagtcattttgagtgaacagtggcaacagtaacaataataataataattattattattctctttctttttatttttctctgatttctttccttcctccctccttccatttcctaccagaaaccagcagctcagccttaattttaaaatataatagctctatttaaattaacataagcccataacagttcttaattctgtttgtggagtaacaaagcagcaaggccacttcccttttgctgacttcccccattccttgaacacctccagaactgcacaaacgacctgaactatgctaagcttcgtgagagtaaaacaatccacctctcaaagcaagtaacctagctatagaaatttcctgacacggtttccattttgaacagctctgctctggtgtcagctggtgacatctgtttttcagcttcagactcttacattttcaccttctatgttattggtccttatggctcaggactgtcatttcttcattgtgctgttctcatgtggtggtttttctgctgtctagatgtcagctgtcttaaatagccggagctggaaagggtttgggggaagcccaagattcctgagagatgctgcactgaagagagtaagcattcagtatgtaaaaaaaaaaaaaaaaaaaaaaaaaaaatcctaattgcttatcttaagtatttcactgggccgggcgcagtggctcacacctggaatcccagcactttgggaggctgagacaggtgggttactgaaggtcgggagttcaagaccagcctgacaaacatggtgaaaccccacctttactaaaaatgcaaaaattagtcgggcatggtggcggcgcctgtaatcccagctactcgggaggctgaggcaggagaatctcttgcatctgggaagtagaggttgcagtgagctgggattgcaccacggtatgccagcctgggcaacggagtgagactccatctcaaaaaaataaaaataaaaataataaaacatttcattgcacgtgagttcacattgtttcactcctcttaccttttccctgccgttcttcgctgacgtgtaagggcatcctgcaacaaaattgacccacttcagcccgctgcagtgctgcaagagcagatactttgcttctagaggaaactctgtcccggagcccagagcctgcttcctcaaggattttggatctttctcctgttctaatactttttttcaggcaaataatgtgggaaagagcagagcaagaaacatatctgacctgagagcaaaattattcactagaatgtatttcaaagttttctgaattaaatcaatagctttctctttcttcaagattgttatctcttagtgctttataatatgtctaaacctagtgaaatgtaataaagtataacagggtgggatgtgttgaatgagtcttcgtggagcatgtcacggtccccttcccatctcattttggtgatgtgtctagattgctgtaccgcgtgggctccattgaggtagtgcttagggcaggagctctggaaggagattgcttgagacttggccatgaacagccaaacagaagtgatctggccttgaggtgtcaggagctttcatgagaactcctgaagcttgagggaatcagttaatgctttcctcctggcagtgctaattttaccagggagatctaggggcaaaggagctagtagcgtgggatacaagtgagccagccggcaggtctgcaccacagttgcaaacatccctaagtgaaatcagctgatagattgatgggggcgggtgcacagcatctgtctgcaattttcctgatgcgattacacacttctcccaagtgactgccgtttctgtgtgtagtaaatttctcaaacccaacccaaatactttattattatactgtatatattacgtatcattatagcacagatgtattattttttattcccagcatattataatataacaatttccagagaaatctgtagtttgatgcagatgagggaatgcagatggattggctcatctttattcagagtctaaaattgttatctcagcctcgattacaccacttcctcttggttatctgaaaattgcccaggaatagatttgctgattttcttttcatttattcccattatgtgagctcactttcttatagtttagagacagagggtacaaaataagaaggcgagattaccctttgcaaagaaatacgagttggtaatattttgaaattggatagttttgtgagaaagaaggcagcaaaacagaatgttttgaggggaaaaaaccttattctgttattcattttctcagtgtctcagctctgttccattggggtatagtaaacttttactattcagcgtggtgaggggctttagttagcaagctggcagagggtctagggctgcatctttcaatccggcagccacgagcctcctgaggctattgagtaattaaaagtgattagtccaaattgctctgtgctgcaagtataaagtatactcccaaaagtctgataacttagcaccaaaaagtctcactcaatatctatgtctcattcatcattttttcatatgataacatattgaaatagtcatttttactatctattgggttaaaatatattattaaaattaatttcaccttacattgctttttaaaaatgtggctactagaaaaaataaaattactcgtgcgccttgtattatatctctgttgaacagggagagctttgctccttaaaagtctgattccttaattttggcaccatctgggggcttggtagaaatgcagagtctcaggcatcacctcagactcattggagcagaatctgcatttcagcaagatctccagaggattcacacacactttgaagtttgagaaacacttttctagtagaggaaaatttctgaaaggcttaaattattttacttcccataaatacctattggtttcccatggggaaagtgggagttctttgaggacagaaactttgtctgacactccttgacatcctcagggtttggtatagtctttgacacacagaagatgatatccaataaatgttgaatacatgaatgggcacatagtcctgtctgccacttcatggatgaagactctcaatggtcacataaagtgaagggttctgatgggcgaccactatccagtccaaataatttaaagtgatgtgtgcatcctttgggtatttgaagcacagaactgttttattttcatatgttaggatcctaactggttttcctatctgacttttaaaaattaccttgtttgttttattctcctcctcctccccctcccctcctcctctcctctccccctcccccatcccccctcctcccctctccctctcatcctcctcctctctccccatcccccctcctcccctctccctctcatcctcctcctctctccccctccccctcctccctctctcccctccccctcctccccctcctccccctcctcctcctcccctctccccctcctcccctctccccctcctcccctctccccctcctcccctctccccctcctccccctccctcttcctccctcttcctcctccaccctcccctccctcctcccccttcctcctccctccctcctccccctcctcctccctcctccctcctcctcctcctcctccttctttgtaaagtgaaagcaagtttattaagagagtaaaggaataaagaatggctactctgtaggcagagcagccccaggccagctggttgcccattttcaagattattttttgattttatgctagacgaggggtggattatttgtgagttttctgggagaggggttggctttgactgtggtatggaaaattatatggaatggagcaaaattacaaatgagatcgtggtatttggcacgtggtacccttttcctcacatactctttgccatccccacttaaattcatttcatttctttaactggccaagtttcctcaatccagagaagtctctgcttatctgtcacctcctcaaagagccttcttttctaaaatgatgattccactcctcctctttcaatccccattacctccctctgctttaagtaaatacccactaatgcccaggacctcaagcctgggaccttcatagtacttacatgatgttattgtctcccttctccacttcccagcccttatttggctgggactttaactctttcaccacagtccctattatagtgcctgttgcatcacaagacctcaataaataaatattctttgaatgaatgaatgaatgaataaaaaatgagtgattatgttgtttatgttgtgacataactgggcatggaggagttaatgacaggagctaattacagttaattgcacctatctactcagcaaatattttctgaataattcccgtgtagacaacagagaaataaggtatggaaagcagaaagggggatggaagagaccaaatatgaaaatggattctagggtcacatggtgagttgtacacagttgcatagatgatgttacatctatgtaacaggcgaaagggagttactctttcgcctggggcatcaagaaaagcttcaggtggaaggacaatgagaatttgctaggtagaagaagtgaggatgaacaggaaaggacacagtgtgttttgggaatagtaaaaatcagaggatgggtatttggttcaggagtgacaggaaaggagaccaattggctgggccagctggagtggggtacactttcaatgaggagactaaggactgtgggttctactacagtgtgttacctggaagatgataccatcagacttaggttttcgttttcacaccttatatgctgctgtgtggctggaccagatgttaaggaagaggttgtagtaacgcagtgaagaagaaagggggatatatgtttgagagagaaggaaagagagagggtggggcttgaaggtcctgaacattagtaggaaaatatgtgtattacttacaatttgtgaagaagctgaaaagatttaagaaaaagatttgtaggctgccaatagaatgatcattatccttcaatcagtttccaaaacttatcagctacaaagggcctgtggtcagccttggcttccatgccttcctccctgctgtccccaagaatccccagtgcggtgagtaggaccatcagaatctctgttccccgctctgccaatgtatgaatccccactcctttttggtgaaaactaagcaaatccatcactgaaagatgtcagagcttcttgggctccttgtcatctggaggtaatggaggtcacatgtcaggttttggggaaaaggcagagtgcaaagttctgggagggacagggtctggggctacttcctgtcactggaaggcgggtagggctgaagaagaacaatttctggtgaaggcaaatggtttggaaatgataatctggtcagtttattattccagtggtatatgggtcagaaagatcacagcttaagagtttgtaaaagatggcttgggtgcagacaaaccctgctcatctgggaaggaattgtgtcccagcaagagaaagccagctcacacttcgttgttctgaagctgattattagccgtgattacctgcactttctattttcttctgctaccacccaactttggaccacttttctgcttattagcactagcatctgaatattggaaaagaggaaaagagagatgaaggagctccatgtaattttgcttcctgttagcagctctattaaaagaatactgaaggaaccaatagaattaaagcagattgaaaccattgggtaaaaagtttgattttcatctaccctgtttcacattgccattgataatcattaaatttagtgcagcaaagacttaggagagccttgctttatgggtagagaacagatttcaaaagattttaattttcccaaatccattcaatcagtgagaggcagaacgagatctcaaaccaaagtcttccaattcatactttacatggtacttcttccctcactatatcatattttgtctcaataagattcattttggccttcctcttaaatctatacaggcaaaataatacataatgaaatgaaaagaatattggattttgattcagaacacctaagtttttcgcttgctttccctcttttcttgccttataagcaagatagtgataattcctgccttgcctacttcacagatttactctcaataccaaaggaataatacaggtgaaaacgccttctctgctgcaaggtgctataaaaatgccatgaatgtgtttacatacaatcccacacatttgaacagagctagtcagaattatttgttactatgtcatatatctaccagttgtaataacatggcatgaatttaaaggattctttttattttgcagtattgagaaaattttgagaaattagaaatgtatcggtaataactgatatagcttttgaagagaagaaaatactttattatttgcaggggttaggattattttcctggaaactttaagagaatcaacagaaaacattaaaaaaataaggagtataagaaagttcaataatctggaaatttcgataaaagtttttttccttgtcttggaaaacatgtagaaagaacacatacaacagaaaacaaaaacacacatttctatttctgaaaatgagaagacaagtttccaggtacctaaagactgttaaaagctgtcaagttcttgcacaatcttggtggaagaaacatggagagatgtggaaaatggagaggttatgagcaagggtgatacgattttatgcccagcaaaaatatttttcaaaactgaggataaaatgagttcactttcggacaaatcagaagtgcatatgttcactgccagcagattcatatcagaagaaacactaaaaggtgagtttcaggcaggagaaaaatgaaacctgatgaaagtttgtagatgcagcaaggagtgaggagtaattaaaagagtaaatatgtggtttaaatcaatattgactttattacacaataaatgtaaatgtcttatggattttaggatatgtagtggaaactaaaatatagtagattatattatactataataaatcaaagaagtaccttgtaatctctgaggtaactgctgaaaaagaatagaaggatgtataacttaagctaatagaggagaaaaaagaaacaatgggaaaaaaacaatcaatccaaatgaaggtcagatgggaaaaagaattgattgtacattaggacaaatggagagcaaatattaaattgatagctatatgccaatataaatcattaattatatcaaatggaaattttgactaaatgcttcaattaagataaaacagtgctagactaaataaaatacaatatacaaccatatggtgcttcaaaagagaaatacttgtaaagctatggaaacactgaaagtgatgaaaaaatatatattttaaatactaaccaaaagaaagccagcaaagctatatttatacacacaaaggagacattaaggcaatgccttaggagaactggagagatataatgataaaaagttcagttaagcagggaaatataataattctaaatctgtatgcagttaataacatagcctaaaaataaagaattgacaacataatatggaatagacaaattcacaatcatctttggagattttaacataccactctcaataattcatggaacaagcagatataatattggtaagaatatagacaatatgagaaatatgactaacaaacttgacctaattggtgtatatgggacattgtacccaacaacattctttgatcctaacacctttattcataatggccctaaactggaaagaactcaaatgtctatcaagaggtaagagaataaacaaattgtggcatattcattgctatgtggtaccttggaatacgactcagtgattaaaagaaattactgatgcatccaacaacatagatagctcccaaaagtattatgctaagttaaagaagccaggcagaaaagttatatactgtatgattttttttttttttttttttttttttgagacagagttttgctcttgtcacccagcctggagtgcagtggtgtgatcttggctcactgcaaactccgcctattgagttctagcgattctcctgcctcagcctcccaaggagctgggattacaggcgcctaccaccatgcccagcaaatttttgtatttttagtagggatggggttttgccatgttggccaggctagtcttgaaatcctgacctcaggtgatctgcctgccttggcctcccacagtgctggtattacaggcgtgagccaccgttactcacactgtatgatttaattatgaaattccagaaaacgaagcactatggtgataaaaaaaaaaaaaaaggcaaatcggtggttgccagaggctaggggtggggtgaaaggattgcctgcaaagtgaaatgaggagaatatcggagatgacaataataattttatcatgatcatttgattttacaacactgtatacatgtgtcaaaatttattgacttgtaacataaaattggtaaaatttatgtctgtaaattatatcacaataaaactaataaaaaagatagaaacatcttttaatattgatatggaaatatcttcaagatacattggtaaatgaaaaatgcacaatgcataaaatgtgcatagtatgtaccttttttggaaaacgtagcatgtgtcttatatacaaatttttctcattttattttttttctcagaatctttccacttccttttccactcctgtttcctgtctccttccttcctctcctgttttccttctatcaggttgtgtacactctcttctaggattgctggacttcatgttagctgcatgattccaccttgaaatcaaacctgctctcctggccatttcttctaccccttaatcccactatctaattcttcagctccaagaagccccgtctgatcatacctttgtataatgttgttgttggtttttttttttttttttttttttttgtggtgcttccatagcatacaagattgttcccaaacccttagtatgccccagaaagggctgcagaagcaggcaggaacttagtttttgtaccttcatttcttctcttgccttccaaacggcctgtgctttagtcacattaaaccatttcatttttccttgggtattatgtactttatgacctcagacgtttgcaaatacgtctacttaggccatttctactacctttcttttttcttttctttacttggcaaacaattaaactggacagaccagatcaaatgttaccttttctgtgaaaattcattttttttactcttcttctcctgtggtgccttagtatttgaaaatactttgcctttgtgaaattgacatatgattgttattctctaaaaaagtaaacattccagatagggataaagatgacctaaaaatcacgtagattacctctacttgcagctgtctgtatgtatagatacctttgtataaattttacagccacatacaaatgggatctttctgtgatgcactctgtcgtctatttttttttcactcactgttatatcacaggtacctttttctgttgacagaaaaagacttatgtattatttttaatggctgcatagcattctgttttgcatattatttcctgaactagtttcctatgaatgtgtgtttaagtcatttacagttgtttgcgttagtataaatgatgtcacaatgaatactccactgtgtttgaaaatatcctgatgaatgtccctgatggcattggattgtaattatctgtgtgcctttctttcctaccagactgttattagtttcctgagagcaaaaaaccattatttatcttgtaatctacagaaccctgcagagtgccagtagaagcttaatatatattgttgaaagaaagaaggaataaatgaatggatgtttatatagttgggtacacatgtttatcatcacacatgtcttcagtttttactcaacttttcattggcctaaaggcctgatatctcttaggcattattcaatcccctacttgttcctaatctctttttacagatgtcattaccactataaattcaatatatagctttaagaataaaaatctgtccaaaccatgactcccccgtagactatggtggtcactgaaacatattttattaattgcagaaaaaaataaatgcaaatatctggcactttttgcctgaccctaagcagacacgagttactaagactgagattgtcaattgcaagaaaaaaccacatggtatgtgtggtgcatactatttacagctgttgtccattatgagttctctggagtaccatttgctgctacaattgaatggtcttgtaagtttaacttaccaacatgactgcaaaattgtcttaaatcacagaggggaagagaggaaagccaactagaactggctaaaatactgcttatgtcttcatgagaatccatcgttgtccccatttgcttcttcaggatactagaacagcctgcaaggtcttgtggtgtattacaatacagcagattatcaacttgactctccaatggaaagagacacattgttgatgtctctctgttagagcttgcatttggcttattgattaatgtactgcgttgtactaggtatatcaggcaatggaagccaactggcccagacaatggaagtgttttgttagtgtcaaaaatttacaagagcttaagccattttttatttcttcttgctgggctgaaagcacttactattgttgtccaatatgctgcaaatgaacatagttcaaaaatcacaaagagagtgatgtggaattatagaaccgaaaataggatactggttgggtacaaattcatcaagcctctttatttcgaaacaagctttttattggcgtgccaacacagcttgctttggaaaaagcgaaaccaactgtgagcaaatgatatagtaggaaagttgacctcccgttaatttcagttgtgcctagctagctaactgtacatctccttctttccaacatttttttttagaaagtttcagttagtgagtcattagtcctatggtgcagaacacctaatctgctatggactgaatatgtatgtcctcccaaaattatatgttgaaatcctaattcccaaagtgatggtgtcagaaggtggaacctttggaagttgattaggtcatgagggtagtgccctcataaatgggattagtactttaagaaaagaggcttgcgggaactcagttgtcccttccacatgtgaagacacagtaaaaagaaagtcatctaagaaacagaaggcggggcctcaccaggcacagaatttgctggcaccgtaatcatagatttcttggtctccagaactgtaaaaaagaaatttcagttgtttataagccacacagtctatggtattctgctatggaagcccagaaaaagtaagacaaatccattgcccagttttttcagaaacttacataactcatctcatgttaaaaatggtgaggctggaatttgaaccctggaaatacggctcctaaagttgttctctaattcactatgctgtactgtccctgattgggtaaacatgtcatctataataatttcagaattcgttttataaagcacagcctttggcatatatttcttctgatgaaaatgcatcatctccctttttcttaagatagcggttctcaattgttcttttctaaaacacacatgtcaaatatcattctccctacaactatttcactcttttctccacaatctagaaagcacacacgaatgcatgtcattcaaggtaatattattataaggatgactttaaacctgatcttacattgagtttaacagggtgtagcaaaaacatgagtacagtggcctaaccaaatagtggtttactgttctcaaacatccagaagtaacgaagaagctggtgaaaatgtggtatagctgcttaaggaatttgccaagaaccctggctccctctacttttatagtcaccatctttagcatgtgactttgattctcaagttggctttctcatctgaaggtatcacatctatgtgcaaaactggaggaagaagaagggcgaaggacaagacacaaaaaccaagtaggcatttaccagatgaaactgtcccctttaattagttttccagaaggactcacactctagtaacacttaaatgtcactggacacaactgtgtcacatggccactcctacctacaaaaggatccatgaagctagtattttaatatggacaaattccttccccttcaaaaatcagggtcctggtaataagaaagaaagggagaaaggctactgggcaggtgaccggcagtttgtgccatgtatgtaatatcataagcacttgcacttttattggtaactgatgactctgcaatatactctgttacttatcacaggatatcagtgagacactgactctatggttgagaatgtctgatctacaggatgaagtccaaatccctaaacaaaatatataagaaaggatcttaccagtttaatattagcctactttttaaaatttatgttccatcatctctagccctttgcttgagccacacataacttgtcttcattttttaattcatcgacttttgcgccactggttttggcatatgtccctttctttgttcagaagaccctcctcaccgtctccatctggtaaataatacttattttgcaagctccaatgtgaataccatcacatctttggaaatggccttacctctctcagtcatatctattttggtgttttgtatacacctccattagctcacttgtaattattttctttcatatttgtcactactgacaaatgctatggcctcttagagaacaaggactataatttattcaactttttctacccagtgctcctgcagttcttggaatatgctcaagacacctgcttaagggaaaatatagctgagtgttacctccagtgtataggtgacctacaaggagctgaagtaacctgttttcaccgtagtcagtaaaaatgcactgatctacaccccttaaatctagacctcagtggattaatggctgtcagcagaaatacggaagagacagatagtctttaggttttattttttttttggtcttagtgatgataataacataattcagtaattttaaagtgttttctttatatcttccattgcctattctttagctctgttatcaaaagatattcaattttttctttctttgtgcacaatttgaaacacagtttgtatcttcaaaaaggctacggctttttagattctgtatgagtaagatcgtatcatgtttgtctttccgtgtgtgtcttatttcacttaacacaatgtcctccagactcatccatgttgctgaaaatgacagaattccatttttttatggttgaatagtattctattgtatctatgtgtgtgtgtatatataaaatcatatattcatatatatgtgtatatatatatatataaaatcatatattcatatatatgtgtatatatataaaatcatatacgtgtgtgtgtatatatatgtgtgtgtgtgtgtgtgtatatatatatatatatatacacacacacgtcagtaaatgaatcaaaacacattttccacctgagcccagacatggctttaaaatgcatttcagcactatgatactccagctatcttctataaacaaaggagggaagacattcctatctttccctcatcagcacattctccataaagactgttcatgtcaatacactacctgtaactgggcagagagtgttttcctgactccctttgcaaagtgaagcaagcattgtaactccaagattgagcttccagatatttaactcttttgtcaaatctctctcaaggactgggttcagggtcttacagtcatggaattccaaagatactgcttctgttacttgccttctatttctgctaaggaatgagagggaccatcccacccacagactttacgaatgaggagggaaagagctaacacatactgaatggcaggcaatatagtgagtgctttatatttacttctttttgttttttataacaaccacataaagtcagtattattgtccccattttatagataggagatagtgtgaaagaaattaattcatttgcctgagatcccagaggtagtgagagatgaagataatcaatctcagatttgtgacatctagcatcatgctattgaactctggagaattagttatttcttttgtgatcttgataaaatctgcttcttgggttcttttcataccatcaaatagttacatttttgatgacagccttgagctgtaccttcatactttcttgagtcttgcagaccacagaggaagatagaaaatgggtaaatgtagatcagatatgtgttaggagcaatccatctatttaaaacctcatgccaatcatgtgaaaatcagtttgtatcttcaaaaaggctacggttttttagattctgtatgagtaagatcgtatcccatgagaaaaagagaatacaagataaactgaaaacattgaaggaaacaaaattcaaaacctacaatggaaaatgtatttttaataaaaattagtatcaaagaagcaaaaaagaagtttagaaaactataaaatagagcaatattaaaatttgggtttaattttcttatgtccctttttctgcaggacatcgtccatatcaggtgatcactgctcgagttcatccaggagagagcaatgccagttgggtgatgaagggtaccttggagttcctggtcagcagtgaccctgtggctaggctcttgagggaaaacttcatcttcaagatcatacccatgctcaacccagatggtgtcatcaacggcaagtatgtcaggcacctggctcagccaaacccacaattatgctaccacagtgacactgtcatttcaccaagtaggcgtgattggagaggcctcggtactctgtcgagaataaactcttggttttctgttttctgctacaaataacaacatactttccatacacactgatgtcagtctcatggtttctttgaatagaaaggtatagaattgacgcctaggcaggaggatcacttgagacttggaccagtctgggcaacacagtgagaccccacctctacaaaacaaattaattaaaaaataggaagctatagaatcacaggcaattaatagcagaggaagaatctagtttaacatttttcttttaaaaaggaggaaactggtgtccagggtaatcaaatgacttgtccaaatcacatggtgggttaatgataaagtcagggcccaaactgtgatttcttcagagtaagaccaatgcttttatttacttattaatatttactacagggaaatctttattctcaattagctctgataggacacagctataagaatggtgtccctctagctaaataaaatgtcagctgaaaaacagaagttgaggttgttcttctctttacctagcccttacagaactcttcgaaatatatgatgggaaagatggctcctgtgcctggtgagctctgttgaaatggaccacattctcagagtttgtgagctgaggcccagacatcagatgaggcacccaaagtcacacaggtggtgcatgagggtgacaggattaacatccacaaagaggtctttcaaactttgtgggcaaaggataaagccgccccttgccatggtaatagatgaataggaatggacattctatcccatgagaaaaagagaatacaagataaactgaaaacattgaaggaaaaaaaattcaaaacctacaatggaaaatgtatttttaataaaaattagtatcaaagaagcaaaaaagaagtttagaaaactataaaatagagcaatattaaaattgttaaatgaaagagacaaaatgagaattataaagaaatgctaaaagcacaaaaacttcaaagaaataaaatgaaaatgacttaaaataaataagaatgatgtaagaaagatgaaataattcaatttttaagaaacaatttaagtgttaaacagccaagaatagactagtttcaaaagataagcaccgaagatagataagttgaaaaggttaaaagtatgaagatgataaattacaaaaagatgaaaagcataaattccaaatgatgaaatatgttaaaccaggttaaaggaaagcaaataaaagctacagaccataaaaataaaatttcagtacacacacacacatacagaaaggaaagacacccatgtacccatgtgttccttacaggtgagctcctcccagcttagctgttgccagacttcattttatttacttttttatagagattatttgagggcagagaatgttgggcagagagcagggtttcttctctttctctgtggtgactgattggcctttaagcacatgggaaaactgggaggccaagttcttcactaagaaactcgatcagaccttggaaagaaattagccttctgagctctcaagctggaaaggccccaaagcagtgttcgctcctggtcaaacagaactcagccgactcttgctatgtgttcctttaatggcagagaacagctctgggacatcagtgaatggctcctccctgcttgagcagccaaagattttactagcaaactttctcagcctaaatggatggaaaacagttatgcaaggcatcttgagggacatgatcccattttgacattttctcatccaagttggctcttttctgaaatctctccttcgctggaattgtctgaggtccagtagagaatggaaagagccctggatctagagtcatatgattcgttgggaattctggcttttctcctgccctagtcagttttctcttctgttggaagaggaagacaacatgctccctgttgaccattctggaaaaggtctcagaaacccaaggcaatattcaagctcagggattaagtactgtagtttcttcaattttaaatgcttacaccaccaaaccaggggatttatccagatctttggtttaaaggttaatgtgatctcagtcactgagtatcctcctggcctggacacacattatttccagctcacagctggttgctttggattcccaaatggcaggccagcttctccttagtgacactggcatttatcatcattaccattatttattatgatatgactaaaattaccttttcatttatatagcatctttcatcatggagctcaaggcactttgtagatcacttggattacccaaacaattttggctgaaagggacttggaaatcatagtgttattctactgaaggaaaaatctacaggtcgtagcacatcattatgaaaaaacttgagactgcctgaatggataatgcctcatcataaaagagcttaaaagtctcagtgcctgacccttccttagaacatacgtaacacatggtttatctaatttctgcttgaactagttctgtaattgacattttatttcagggcatgcccactctgttgtgtatcatcaggtggatttgtgttttactgtgttttgatctttgtcctgtgagcttcacccattttaatcattcctcccttaggatatcccatggataaaatctaatccccctcatccgtgcctgaattttcccatgtgaagttctctccaaccttgatgcagttcacctaaatcttgtgtatatggtatttttttcgatgttctcatcttcactggttttctctgggtatattcttattaataggctcctttttgtgacgctgtggtcttttgtcctttgtaatgtattttaacagttttgggggaacaggttttttttttttggctacgtggataagttattttagtggtaatttctgggattttggtgcacccatcccccgagcagtgtacattgtacccaatgtgtagtcttttatccctcaccccccaactcttcccccacaagtccccaaagtccagtatatcattctcatgtctttgcatcctcatagcttagctcccacttacaaatgataacatatgatatttgattttccattcctgagttacttcacttagaataacagtctccaactccatccaagttgctgcaaaggccattatttcattccattttatgccatgctgatatatatatatatatgtatttctatatatctcacattttctttatccactcataggttgatggcacttaggttggttccatatctctgcaattgcgaattgtgctgctgtaaacatgtgtgttcaagtgactttcatataatgacttttcctttgggtagatccccagtagtgggattactggattgaatggtagttctacttttagttctttaaggaatctccatactgttcttcatagtgattgtacgagcttacattcccaccagcagtgtaaaagtggtctctttgcacatctacgctaacatctattacattttgattttttaattatgacaattgttgcagaagtaaggtggtatctcattgtggttttaatttgcatttcctttataattagtgaagttgagcatttttttcatatgtttgttggctacttgtatatcttttgagaactgtctattcgtgtcctttgaccagtttttgatgggatttttttttcttgctaatttgtttgaattccttgtagattttagatattagtccttcgttgcatgcatagtttgcaaagatttttctcccactctgtgggttgtctgtttactctgctgattatttcttttgctgtgcaggagctttttagtttaattaggtctctttttttgttgttgttgttgcatttgcttttggattcttagtcctgaattctttgcctaagccaatgcctagaagagttgttacaatgttatcttctggaatttttatggcttcaggtcttagatttaagtctttgatccatcttgagttgatttttatataaggtgaaagatgaggatctagtttccttcttctacatgtggcttgccagttatcccagcaccatttattgaatagcatgtccttttcccactttatgttttgtatgctttgtcaaagatcacttggctgttaagtattggctttatttctggatattctattttgttccattggtctacatgcctatttttatgctagcaccgtgctgttttggtaactatagccttgtagtacaattgaagtcgggtaatgtgatgcctccagatttgttctttttgcttagtattgctttggttatgtggcctctttttttggtttcatatgagttttaggattgttttttctagttctttgaagaatgatgatggtattttaatgggaattacattgagtctgtagactgcttttggcagcatggttattttcacaatattgactctacctgtccatgagcatgggatgtgtttccatttgtttgtgtcacctgtgattttttttcagcagtgttttgttttcctagtagagatattttacctccttggttaagtgtatttctaggttatttatttatttatttatttatttatttttacagctgttgcaaaagtgactgagttcttgatttgattctcagcttagttactgttagtgtatagcagtgtgtgtacattgattttgtatcctgaaactttactgaattcattgattagatgtaggagctctttggatgagtctttagggttttctaggtatataatcatatcactggcaaacagtgacagtttgacttcctatttacagatttggatgccctttatttcttgtctgattgctgtggctaggacttcaagtactatgttgaatagaagtgattaatgtgggcattcttagtaggcttcttaaaggtgaaagaaatgtcctgtgtgttgtctgatcagtaaagagacaatccttgcataaagattagagaaccaaaacctgaacttggcacttagcctacaaggctttacttctctctcaccaataaaaatgggccttatggagcttgcaataatgaataaaagcagacccgtttccttttgtggtgatggtgatggagcttctgagagtgcctgatagcttttgataagagtgtccagtgaaataaaggcatgatttcccagcaaaatttagggagtcctgccaagccaaggatctcttagcaacacatgtctgaacagggaaagaaaatacaaagatggaaggttatgttaagttcaaaaacaaacaaacaaacaaacattttgtcatctttctggcctggtagtttgtgttgaattgggctgagttctaagtaaatcaggaggactgatccagcggtttcttgacacttaaaaatcttcccaaggtggggtaaaaatagaatgggcagtcaacagattttcttagagcagaagtgataattggtagctggattagagtgggaagtggggagaagacaggtgattcctgaactgcattaaaggtagacatgatgtataaatgagcacggggtgagggagaggataagtcaagcatgattcccaatctttttatcttggttgttgggtggtagtaacaaaataatttttataaagtcaacacacagcctaacattttatttacaggagaaccagggcatattgattcttagagtatatacaactctaaaaacttgattatcttctttcaaggccattgtggaacagaagcaaacagcaataaagagcaaagactccactataagtaaatacaccaaggtattaaaacataatagttgaatgcactagaggaaacaaatcaagctataaaaatcagatacaaaatcttgaccattttaacaatctgggaccatttaaagttagtgccagtagtgtttactccactgtgggttgtgaagactttacaataagagcactcacagaatccatctaaaaaattattcagcaccttttatgggccaagaaagaagctagttcctttacatatattgtcttacttaatcatcactatagcccaacaaatgtaggtgttctatgcaatttctagataagaaaagttgagcacacaggcgttcagttttgagtgcagtttaaacagctggtgttacagagccaggaactcaagtctatcccacattactttgctgtagatatttaagggagttagaatgtaagaaccttaacatgttcttgcagggcagattcttgtatattatttagtcccagtcattcaaatgataaggaaactgagaccaaagaggtaagtgagttatccacaattacatagctagttcaacatggaactggcataagaaattgtctagatattgaaaacacacacacacacatccatgcccaaggttatatgactagcttgtgggagagctaacttcaaatcctttgttcattttggtctatcaggtcttcccaaccttggatagagatataaatagagtcttagccccatcagctgcttggttctgaaattcatcttgctgactcagatcttcatatccagggtgcctgggagaagccatggcgcagccttgcccagatttctgctattcttgcccgggatgaatgatttggttcatcctcacttcctagctgggcttgatcctggacactctaccttgactttccagctttctctactagagaatgctgtgtccttccctgtcactgccagcttttggctgcaaacacctcagctgactgtgaatatttattgtcatgggacttctgttctatggctcactttcactcaactcgccaggatcaccaggagcttagactgtctcctctgggctgggccaggccttttccttcccattttgaactcagctctacttttgaatgtatttaaagtcctttggtataatgacatgcagcagtggctctcagacttttggatttcacagatctgttgaatttaaataaacagaggactgattagtaagtatgtcatttttcatttgaacaagtaagaatggaagatactctctgagatcccaaacaattgactggggaaagtttcagtctcatttgtttcttgagctgctgccttttctacatgggattatgcagataatctgggagatgtgatgctgggcctgtagatcacggcaatgagcatacttgccatgttcactataagccatgctgctggtacccatgaaggcttctttgtggacaggaagaagtgtgtagtcaataagtgtgttagttattcccactgttaatcatccttttccaggaacagggaaaattctggaagaggaaaatgtacctgaaaaatgggcccttaagggaaagaggcaatgctcttgagctttaaattgggaatactcaggtctaaccagggggtccccgtaggtcatagaggaatgatggcctctgccatatgggggaggccagaggagacaagtggcctcttgagaatgagaacagctatactaataatcagttttaatttttttgagtagttatcttttgctatataattgactatctaagtgttaatcagtcttctagtcttgtttcagctatgctactgggctttaaagaaagtgcctatgcctggccgggcgcggtggctcatgcctgtaatcccagcactttgggaggccgaggcaggcagatcacgaggtcaggagattgagaccatcctggctaacacagtgaaaccccgtctctattaaaaaataccaaaaaaaaattagccagctgtggtggtgggtacctgtagtcccagctacttgggagggtgagacaggagaatggcatgaacctgggaggcggagcttgcaagtgagccaagatcacaccagcctgggcaacagagtgagactctatctcaaaaaaacaaaaaagcaaaaaaacaacaacaaaaaagaaagtgcctatgcctaagattggttaaggggaaaagtggctctcatacgtaacgaaattcctaagggaacagtggaaatagtacaatggctaatacattttaagagatgtactcagtaaaatgagaacatttaagaaaataaaatagatttgttttctaattataaaaatgatacatgatacagccaagataataggtgtttcaaaaataagacttaatataaggaattagtacaaatctaatacaaggttcgcgcaagtggtagaagtctaagttcaaaaggagatgctaaaaaaaaaaaagattaagaactgtagaggcagctaccacctgtaataatggaggaagcaaatgccagaggaggagttaccagaacctagcaggttgaggggctccatgaggctggtgtttggaactctgtgaagggagactgatctggctagggcttcagtgcacagcaggcacagcctagagggtgaaggagtctagagtggcctgtatccaaatagtaaaggaaccatttggttcttcctgctgctgatgcctttgatggagtgcagcaatgctggtactatgggagctgaaggagtagggattgacatatttgattgcagctgctctggtcttcttaactggaactgggaaacagaaagagtgtgtttctttctcaacttgccttcctatctttctctagggcttctcattggcagaacctactgtcaactgtcaagggcatctgagcactgtagtctgcagagttttaacaacaagtgaaaataagtgcaaagtatctatttaccgagtgctcaacatgccgtagtatggttcttagcaccctgtctatgtgacttcattgttttcaaaaaacaaaatgattttattgtttccagtgggaaaaaatgcacatcattattataaacaattcaatatgtatagagaaagcttaaggaagaaatttaaaggcacctaaattcaggactattgcattgtataattccaaagggcatcatttacattataatctattataattacatagtgcctctggaattttgtaacgtagaggctcttcctgaatcaagctgcccagagaaaaacattattagcaagttgaaggagatattttagccatttgtctataaattgacagctttaggtatatcagctatatctttaagtatatttctattttaactttcataagataatatattttgtagtataatttataaactaaccacatcttcctatggcaaaaatacaaattaaatgatcagttttaaaaataaccatctttcagtattgatggggccataattaatgtaaacaattcttcattataaactgtagaaagatgaatattttgtttattcttagcattttttctggttattttcttaagataaatttttaaagtagtcaattgagtcagatgttatacatattttatatttgatacatattgttgccagattaccctccttagaaaattcacagattatattccttgtactaatggatagaagtgactggtcctcatatgcttgttaacactacacattatcaaccttttcattttctgtcaatctgattggataaacatgattttattttcattttttatatttataacttctaattattacaactacctgaaaaagtaaactgtttaatttcattttgcagaccgaaaaatgaaactgaggcaaaaggagattgagtgacatactcaaggtcagtcccgtgtctaataagtttcagagtcagaaattaaactcaggttcatctgtttgcaaagctcttgttcttttcactagggttatacagccccactgtgtcaaagcttctagacaatcatcctggtgtctttcctcttgagtgtttccagcatagaacttgggaagtggtaagtgcccaatatatgtcttgtaagtctagttctgagtgtacctaatctttctaaagtctcttaaaatgtggccctccaggtaaggtcattccagaacagaaaggcttctaaaatgttttactataggtcagataggaaggtaaagtttgtgtactactcattgaaggtatgatttttgttgaacttgtgcgcataacaatcacttagcatttttaattccctttttctccttttagtcatcatttactgtcttgaaagaattactgaagccatactggggagccttgttttatgtctgggcattctccaacaggctaaggtttaataagcatggggtctgtggatccttccaagctggatttatgatcgtgggactcttggatcatgtgggggaatgattccctttcccatgattcgctggtccacatttggcttctgaaatgcacattccctgtatgcctatgggtgtgagttttgcagtgctcacccacaaagctagggcagaggaccaggactcctctgcaggagggagaaggagcgacaggaagaagcagcgcagaccagcaaaggcagagggcaactggctgtcacatggtcagctcccagcaggcgtttctgtctctttctttctttccctgtctctatctctgtttctcaatctctctctttctgtaactcttcaaggcattgcatcccctctctgaaagcttacatgatcacaagctgaagaacctgtaggagaaagttctctatgttctgtggcctctgggaaatgaataattctattgatattctctgtagaaatgatgctaatgacaagatgggggagtaaaattcccctgactcccttgtgaattctcattccaaggtttcagctccaaacttctcctttcaggcacaggctagggcaattcaaagctcctgctgtaacatctctctgtgaaatgtttgctatccgaaaatcataatctcttcgcagttaaagcttaacctctaccagtcatctgttccttccacatggaactcaactgctcttcctgggagctgacaaaggagcttaaacttgcaatcatgtttaattcctgagtttcattcgtcacattttaatttagattgctttgctattttgtactgtttgaaacagagcagaattattggtggatggaaatttttgcttcatttggtttttagaaaaatttaagaattttgagacatgaagcagaggttgagtgtttggatgaaaatgtcaatctgggttctggttctaccctgtttatccatctctgtgtcaagatgctctaaggggagatgggcaaaagggtttttaatcttcctttgcattactttccttatatttaaaaatggggaaaattgttattctgattcagaaggggtctgaggaactacaatttttcctcactttctcctgccctcactggaaaaaaagtaggggtggaggtctcagccattttgaatgtgaagatattctcctagacaaaaaaacaaaaaatgaacattataggaatagtttaatctcacagcttttgtttacaactttataaaatgaaagacagacacatatttaaattttaaaaaatatgcagaagtaactgttttctgccttaaattcctgcctggcaaatgcctgtcagtaattcccaaatcatggtctgtagagaatttgcagggcatccgcaatgcgtcttcagacaagtggaaggaggtggagagacccatgaagaacatggcacttggtgcaaccgtccaaacctctgtccataaaccacagacatagtatggactcagacagcactgagggccctggttctagagggcaacacactcaatctttctgatgaacttgttcgtagagatcaaaatggaaattatttgctctgggaactcttaaggtcctgctgctaagtcatttgcatagtgttaaatgatgcatagtgctggggctggattctgggagtgtgttcccaagggcttcctcacatacaccccattcccaccatcgcctgcatacacagaaggcgtcaggagcttgaggactccatttgccttcctcagacattgccattttgaataaatattactatttattatccccaaatttagagttattaattatatcagcataaacctaatttatgccatcataaacagtgataataaatgctgccaaattctaatacccagctcttgccaactgtgcctgtagttgatgggtttccccccctcacttcccagaagcattaaattaaaaatgattcagtgttgcagaatcattgatcaagttggggctgaggctcctcaggaaatgcacttgttttgttcaatgctttgctctttcattggccgggcagcttctgatgtctgtccgcattccaatgtttctcctttccttcctcccctcctctgatcctcctataggaggaagaaatccgtgcagggatgcagggatagagggaggtagatgagcatctattatttcattctaaatttcccctttagacatctctcttcttagcatccccacttctaactctttatttcaacataaacttagaaatctttataaagcaaacccttgggtataatatagataagttatttctcaatttctaaatacatctatcatgtatttagggatggatgtgatacatggcttcctaaaatacatgaaagcctataatgggaaaataggaagcatagctctgagaacccccaccaaaactgaggaagctttttcttttggtagttactctcaggggtgctctgattttgcagaggaagaggaaaagcctgtccctgtgttatcagaactgtaatgcaatctcactgcttttctcaaggagaaacagtttttacttttccttcattctccctggcttttactttgttttcatcagtgatgattgtggtggtgatgtagtataaaaaaattccaacaagacagtcagaagaagacccactttaggtcaaagttagcttctttatagctgtgtggctttggacaatttacttaacttctctactcctgtttgctccactttttaagggagtagtaagccctaaccactgcacctcacttgattaatatcacaatcaagtaccatagtacttcaaaactattaagtactgaacaaaggtaatggttccttttattgtgttctgatgcctaaatttcagtggtagggcatctatgttcttctcaatggtagggccaaacagtcttaataatctttttcctgcttttcattttttagttttgcaaagagatccaggataagccatggcaataggatagaaattctaaattttgcagaggaagagacaaggtcaaatgtagatatatatatatatatatatatatatatatatataatatactattttatatataaaatatataatatatattataatatatattatataatattatatataatatatgttatataatatatataacatatattatatatatatagagagagatcttgttaaagttttggttatccttttgattttaaaattatggggcaagtatagaactgaataggttgtacaaaaaattcagcaacagagaaagcttggaactgagtagttcagctaatgccttttttcctcatgcttactcatcaaatagatttaactggcaccttggaatggagaaaaaccctggcttcttgccttcagaagccagcctatcatcagcctccatcaaggtatctccaagagcttttcagggtgtctgtaatgagcagcatctgtggtgcatggagtctgtcttccccagccgggggactgcctccctggggtgggtacccaagcctcaagatcacagaagcccagtttcctagaaaagtgcacctatcaggaaccagaaggaattgcacctcgaaggctggcattggaaaattgcccgagagccttctgctctctgttctggatcactctgcctggcagtctggagtttctaagcaggaaagtcaaaggcagcatatatactttgataatgcagatccacctccccaccgcgatttacaggttgtcttttccttggctattcatctctctgagccacatagcccttttgaattattagccttactccttcattgcccaccttccttcttgcaaacatgctcccatacattttcactccacagaaaatgctttcttctctatttacagcttctttctgccccctacccttccctctggtccgataactaatggccaaggagataaataagagacataactctttttggccattttttttgtcattactctgcataataacaaggaaacaaatcttattactaaagtaattacaataaataaaaaataactgagagtggagcttaaagaaggggacatagcagggtagtgattacagcaggattttaaaattttaatttactagtgccagtctctgttactctgttcataccctgcttaggagattgtgtctaattagggattggttgttattggtctttgaaagcacccactcctagctgacttatccctaggtctttaaaggagacatttggcccaaggaatcccttgaaaaatctctttgtcagcagctcaatgttggaaaatagcagcatttagcatgttaagtttcatcatcatcaaagcttgggaattgcaaataattacttggcatttttccctctgtagataacattctcttaactagtctatacagacatgcattcaccctaacatccgtggatcaccaagtcgaggacacagtacacccttttgtagaatacactggtgctgaccaatcttagagttagaccatttttctttatagccaatctaattttatccaaaagcaatttatgtcctttgtttccacagaggaagtgtggaatgtttatttttcttcattaatcatgactattatcctatttctgatagtcatctttccaagtccttttggtatttgagttgcttctctttctttttgaacctaaatcttgtatgttcagtgtttagtcctgatacacagtgttttaactataattgtcagtgtttggtttccttaaccttctccaagttgctcttgagtgtggaaggatgaggtgcagcatagtggctttcccatgcatcttagcatctttctacaacaccatccctaaacttcaagtgcatttattaattcctgtgaccatgtgcccttctaagttgctctaaacaagtggtcttagtcgtctacacatttgaaatatagggcaaatacaaaatttagacacagttactacaacacttcttccctaaaccactgccatccccaccatctctactatcaccaccaccatcagtgacattacaagaaaatggcaaatattgaatgagcatttaacacatgcttgacaatgccaagtactttacatatattatcttttaattctcacacaaccctctgtggtaaatattaataatatcttgactttactaatgaaaaaagtaatattttaagagcaaaataagtgtcccaggccattcagaacacagatagtatttggataaaaagaatattcaattcagtttctttctttttttattttgattctagatcctgcccactaacaactacattatacatggaatcagaagttatagaattctgtaatgttagaggtgaaagacatcttacatttcaacaaaccggccccaccctttctttatagaagagaaaaataaaagatgctcagtaaggtaacagtaggttcttaaatctccacaatattagagttgaatttgaagtccaggcctaaaactttccccactgaatctccattacatgcaaggataacatatttgcaatctagccagacatttatgtaaactattatgcataatattatgacatttgggaatgcaaagcaaagataagttattcattaagacagataacgcaggattgagtggtagttctatttttagttctttgtgaaatctgcatgctgtcttccatagggataataatttacattcctatcaacagtctataagtggtcccttttctctgtttcctcaccaacatctgttattttttaatctttttaatagtagccattctgaatggtataagatattatctcatggtggttttaatttacatttttctgataattagtggtgttgggtattttttaggtgcttgtgggacatttgtatatcttcttttgaaaaatgtctattcataccctttgcccactttttaatggggttatttatttattttttgttgagttgtttgtgttccttgtaaattctggatattagtcccttttcggatggatagtttgcaaatattttttcccattctgcacgttgtctgtccactctgttgattatttcttttgctgtggagaagctttctggtttaattttcccatttacaattcacagtagcaaagatgtggaatcaacctaactgtccatcaatggatgattgaataaataaaatgtggtataagtacacaatggaatactattcagccatataaaagaatgaaatcatgttatttgctgcaacattaatggaactggaggccattatcttaagtgaaaaaaactcagaaatggaaagacaaatactgtatgttctcacttataagtgggagctaaataatgtatacacatgaacatagagtatggaatgaaagacactggagactcaaaaggatagcgaggtgaggaggaggtgggtgatgagaaattacttaatgagtacactgtacattattcaggtgataggtatactagaaacccagactttatcattatgcaatatattcatgtaaccaaattgcacttgtaccccttaaatttatattaaaaagagagaatgcaaagagttctgtgtagagatggtcaaaacatcacaaatattttagcctgtctaatatagcttcccagaggtagttggatgtctaagtgtgctttaaaaggggaggcagaatacccctggaagaagagtgatagtatctccagaccagcattttcttaatggcttctgcaggacgctagcagattggtgctaatagatgtttcacacaagagggtgctatggcttgaaaagttcaaacaattttgggtaaacaaattttcttttaattgtagaaatgttcagtgccattaaaatattaacatgcatggagactctccaagatgggaaaaaatatatgccatttcctgaagttatttgaacagggtcacatttgttgaagtacacctaaactatctagaggaacattaacgatcactcaacttgggcaatgtttccccaggcttttaactgagatgcagacataaaattaagcctacttagaagaagcacattagcatcgtggctaagaacacttagaatggagctgtattgcttgggtttgccatttactagctgtgtgaccttggacaagaaacttgtcataggttgggttatttatgatacagtctccaagatggagacttgctgtaggaaattagttgtgttgagttcttgggaataacacctatgagagcgtaagggaagctggattgggcatagagtacagttgaattgtgatgcatttgctattacgaaggcctcagatgatcagtgggtaccactaactgctgggatgcctctttacccaatggcctttcagtgtctggaattaaggcaagtggactgagcctttcctttgtactccccaccaatgatccgttcttgaatatgagcttcctgtagggagggtatacaaccccagggaaagaagatccctttggctgagggcaattcctaggggaagtactcagttgtgagcttcagcagccagtagcagctgaggaatgaattccttggtcctaacggtactctgagggatacaccacagtatctgctgtgcttcagtttcctcatctgtaaaacggggataatagcaagtaatgacctttttaataaggccattatgagttaagtgagttactatataatatgcctgatacttaatagtgttcttatacatgttaaagtaaacaacacttataagaacagttattatactttaacacctataaaatcactattaaataaactaaatagtgtatttagcatgaagccttattaagctcttttgatggcttaatcatattgctaactcatttttagttcattgtcaaataaaacatctaagattttttaatattaattgtcattaacctgaatgtttcctggtatgtcactgtgtagttgatctaaatggatcaagtcttgaacccatgcttatcccaatttcatccaattagattccattcttctgagaccactttggatctttaatctgtcatccattttgtacactaagttgtgctcttataaatgttatgattattcacatttatagttaagacaatgaaaactggaaaaacaaagagaatatatccttcattcctagtgtattaaaaacaagtgcctatatgtcatagtattttcacatgacttttttttcacagctttttcttagccttggacaaagaggctattactgcattttctgctgtgttctttacctaataatgtagatatcactgttataagaatggcccactctttcagaaggtaccccctcagacagttcatgtatttcataaacaaacaaaccaacaaacaaaattcagtccaggccaagatgtaatttgagtagagatgactaaatattgactcgtttctaagaagtggattgtgattttgacatgacctaaagggaactgtattcatggaaaagatggcctattccaatataatgtcaagagatttgatgctagcatagctgagatcaatttttcttttatttttgtaaatgcggtgttaaatgaaaatgtccaaagcttgggctgtgctttccaatgtcagggcaaaaaatttgagtgtttatgagtcctgatcaggctgggcttctctctagaaggggagactgcagcacattagtgcctgtcatttgtgatagtaactgtggaaactcagccagcaagactcctttcagcagtaatcagggccattgatgtccatctgatctcaggtggggaacacttttttataaaaaaaaaatgtaattcaatatctagctattaatctagccatcttggcagtgcattattgagtgttctaattcagtggatttggccactgagagactcagccataatgcatgtaatgtaacggatatcatctgaaaagcaattgttctccttggctaggttatttaaagccattgaataacataaaatagattatatatccataatagtattgagaatcattttgttcaacctagtttttcattgtatggaaaaagaaataggcttagcaattcgatgctatgtaaaaagtttacccagtttcctggcatagataagatcaagtcaaaagacaatggactcttccattccagtgatatgcaatttctcttggacaaagatcttatccctattattccacagaggaagacagtgtgagctctacatgaatatatttctgtgacttgatcatacaaccatggaatcttagagaacttaacgtctagttcagtttttcaacttgcacttaaaattcctttatagcattcatcacatgtggccaaatagcctgtgctctagcatgtctgtagtgtgtgaacttatttcctctcatgtgaacttatttcattttcgatagtcctcttagaaagtcatttcttaaaccatgttaatatatttcctctcaaagcttctatccttcatgccacatacagtaagttgaattactcttctttggactttcacacaactgaagactaccctcatatcacctctatatgttttcctttctccacagtaagaatctgtagtttcttcaatcacttgtcttgggatgtatttttggatctctccatcattccgattgttatctgaattacctcactcattaatgcaataaatgttcattgaacatatcctaagtaagaaacattggtaaacctgtggatgtaacattgaacagagcaagctgtttacagtagagaggtggaaacagacaattcaaaatagtatcatacagtgttagacatcatctgatggctgttagccatacagatgcccagagaaaggggacctaatttggtcctgaggtctgggacaacttcttgtagcatctacattgagagctgaaggaagggttagccagcggcaaagagtgtgtgtgcagtagaagcagggaggtgtcagagcatgctggtctacatgagagactggcatgttcagagcccaggaatatctaagtttttattatgatggaattcccggatgaccaccattattattctgaaaaccaaattgctattcatgaagcctgaagcatgaagacttaagctcttttgatggcctaatcctattgctaactcattttcagcttattgtcaaataaagcctcgaagttattttttatattaattgccattaacctgaaagtatcttgctgtatcactctatagttgatctagatggatcaagtcttgaatcacacttatcccagtttcatccaattagattccattctttggagaccactttggatcttgaatctgctatccatttcatttggctttctactaatttacatggaaacttcagagctgacaagaatttcttttatctttttatcatgtcattgatacatttgttgaactggagagaaccaaggacagtgtactagaagacatatcaccaaaggcacaggtccatttagttatgatcattcaaccactttctaatctattttagtgctgccattgaacccatctttctttatataacttgcaaggatatcttgagagacttttgcaaattcctcactgaaggcctgttaagctctgtctccttatctaataacctgtcaaagtgtgaaacaaagttgggctggcacagctggaacaattcccaaaattgttcttggttacaggtgctggtttttatgagttctacttcctttcctaagagaccccatatttccctgttaatatgctccagaattttgctgaagatcagtgtcaagctcactggtttcatctgccattttctcttttttcaaaaatggagacatatttgctcatccttagtcttgataatttcccatagattactgacattgtcttaagctaagggtgggctaagccactgcctttgaagagtgaagaggagaccccagctcctgacttaggatgattcagacttcccacaggcacctctcataattgagaacttgcagcacttagtcttacctgtcctcagaatagatcattcatcatgcttgtcgggatgatttagtctgggggtgtgaaactgcaattcctttgaccttggttcactgaactgacatgttacatatgggcccaaatcattgtaacttcaggtgttttaatctagaaaatgctttatgacactacattgttttacttccattgacttaatgctctgtagtactaaccaagttccctcttggatatgagtagatcatagatggcaaagactgaacattttttgatagtgtgatatgctatcaaagatacatgactaagatatgtcctgcatatcttggcacttttgtccacatgtggtaagctttcaggggttaaacggcaaaatttggggggtggctggcaagatggctgaataggaacagctccggtctatagctcctaccgagatcaacacagaaggcaagtgatttctgcatttccaaccgaggtacctagctcatcttcatctcattgggactggttagaaagtgggtgcagcccatggagggtgagcagaagcagggtgttgcctcacctgggaagttcaagaggtcaggaaactccctcgtagccaagggaagccgtgaggcactgtgccatgaggaatgatgcattatggcccagatactatgcttttcccacagtctttgcaaccggcagaccaggagaatcccttgggtgcctacaccaccaaggccctgggtttcaagcacaaaactgggtggctgtttgggcagacactaagctagctgcaggagtttttttttttttcataccaaagtggtgcaggaatgccagcaagacagaaccattcactcccctggaaaagaggctgaagccagggagccaagtggcctagctcagtggatcccactcccatggagcctagcaagctaagattcactggcttgaaattctcgctgccagcacagcagtctgaagtcgacctgggatgctctagctttgttgggggaggggtgtccgccattactgagactggagtaggcagttttcccctcacagtgtaaacaaagccgcccagaagttaggactgggcagagccccctatagctcagcaaagctgctgtagccagactgcctctctagattcctcctctctgggcagggtatctctgaaagaaaggcagcagctccagtcaggggcttataaataaaactcccatctccctgggacagagcacctgggggaaggggtggctgtgggcacagcttcagcagacttaaaacattcctgcctgctggctctgaagagagcagtggatctcccaatacagcactagatttctactaaggaacagactacctcttcaagtgggtccctgacttgtgtgcctcctgacagggagacatctcctagcaggggtcgacagacacctcacacaggagagcttcggctggcatccagtgagtgcccttctaggatgaagcttccagaggaaggaacaggcagcaatctttgctgttctgcagcctctgctggtgacacctaggcaaacagcatctggagtgtacctccagcaaactcaagcagacctgcagcagaggggcctgactgttagaaggaacactaacaatcagaaaggaatagcatcaaaatcaacaaagagaacatccacacagaaaccccatctgaaggtcaccaacatcaaagaccaaggtagataaatgcacaaagatgaggaaaaatgtccaaaaatgctgaaaattccaaaaaccagaatgcctcttctccaaaacctcacaactcctcaccagcaagggaacaaaactggatggagaatgggtttgacgaattaacagaaggaggcttcagaaggtggttaatcacaaactcctctgagctaaaggagcatattctaacccaatgcaaggaagctaagaaccttgaaaaaagttagaggaattgctaactagaataactttagagaagaatataaatgacctgatggagctgaaaaacacagcaggagaacttcatgaagcatgcacaagtatcaatagccaaatcaatcaagtgaaagaaaggatatcagagtttgaagatcaacttaatgaaataaagtgtgaagatgtgattagagaaaaaagaatgaaaaggagtgaacaaatcctccaagaaatatgggactatgtgaaaagatcaaatctatgtttgattggtgtacctgaaagtgacggggagaatggaaccaagttggaaaacactcttcaggatattatccgggaaaacttccccaacctagcaaaacaggccaacattccaattcaggaaatacagtgaacaatacaaacagcaacttcatcaagaagagcaaccctaagacacataaccgtcagattcaccaaggctgaaatgaaggaaaaaatgttaagggcagccagagagaaagggcgggttacccataaagggaaaccatcaggataacagcatatctctctatggaaaccctacaagccagaagagagtggggccaatattcaacattcttaaagaaaaaaaactcagaatttcatatccagccaaactaagattcataagtgaaggagaataaaatcctttacaaacaagcaaatgctgagatattttgtcatcaccaggcctaccatgcaagagcttctgaaggaagtactaaatatggaaaggaaaaaccagtaccagccactgcaaaaacataccaaaaggtaaagaacattgacactatgaagaaactgcaccaactaatgggaaaaataaccagctagcatcatgacaggatcaaattcacacataacaatattaaccttaaatgtaaatgggctaaatgccccaattaaaagacaaagactggcaaattggataaagagtcaagaccaatcggtgtgctgtattcaggagacccatctcacatgcaaagacacacataggctcaaaatacagggatggaggaagatttagcaagcaaatagaaaggaaaaaaagcaggggttgcaatcctcatctctgataaaatagactttaaaccaacaaagatttaaaaagacaaagaagggccttacataatgggaaagggatcaatgcaacaagaagagctaactgtcttaaatttatatgcacccaatacaggaacacccagattcataaagcatgttcttagagacctacaaagagacttagactcccacacaataatagtgggaggctttaacaccccactgtcaatattagatcaacgagacagaaaattaacaaggatattcaggacttgaactaagctctagaccaagtggacctaatagacatctacagaactctcgacctcaaatcaacagaatatacattcttctcagcactgcatagcacttaatcaaaaattgaccacataattggaagtaaaacactctgcagcaaacgcaaaagaatggaaatcataacaaacagtctctcagaccaaagtgcaatcaaattagatctcgggattaagaaactcactcaaaactgcacgactacatggaaactgaacaacctgctcctgaatgactactgggtaaataacaaaagtaaggcagaaataaagaaattctctgaaaccagtgagaacaaagacacaacttaccacaatctctgagacacagctaaagcagcgtttagagggaaatttatagcactaaatgcccacaggagaaagtgggaaagatctaaaatcgacaagctaacatcataattaaggaactagagaagcaagagcaaacaaattcaaaagctagcagaaaacgagaaaatacttagagcagaacggaaggagatagagacatgaaaaacccttcaaaaaaatcaatgaatccaggagctgattttttttgaaaagattaacaaaatagatagaccactagccagactaataaaaaataaaagagagaagaatcaaatagacataataaaaaatgataaaggggagatcaccactgatcccacagaaatacaaactaccatcagataataccataaatacctctatgcaaataaactagaaaatctagaagaaatggatacattcctggacacatacacactcccaagattaaaccaggaagaagtcgaatagactaataagaagttctgaaattgaggcagtacttgatagcttaccaaccaaaaacagtccaggactggacagattcacagccgaattctaccagagacacaaagaggagctggtatcatttcttctgaaactatctcaaacaatagaaaaagagggactcctccctaactcattttatgaggccagcatcatcctgataccaaaacctggcagagacacaacagaaaagaaaagttcaggccaatatccctgatgaatatcaatgtgaaaatcctcaataaaacactggcaaactgaatctagcagcacatcaaaaagcttatccaccacgataaagtcaccttcatccatgggatgcaacatatgcaaatcaataaacataatccatcacagaaacagaaccaatgacaaaaaccacatgattatctcagtagatgcagaaaaagccttcaataaaattcaacaacctttcatgcaaaaaactctcaataaactaggtgctgatggaacgtatctctatcatactgaatagcaaaagctggaagcattccctttgaaaaccagcactagacaaggatgtcctcttttaccactcctattcaacatagtatttgaagttctggcccgggtaatcatgcaagagaaagaaataaagggtattcagataggaagagaggaagtcaaattgtctctgtttgcagatgacatgattgtatatatagaaaacccattgtcgcaaccccaaatctccttaagctgataagcaacttcagcaaagtctccgtatacaaaatcaatgtgtgaaaatcacaaacattcctatacaccaataacagacagagagccaaatcataagtgaactcccattcccaattgctacaaagataataaaatacctagcaatacaacttacaagggatgtgaaggatctcttcaaggagagctacaaaccactgctcaaggaaataagagaggatataaacaaatggaaaaacaatccatgttcatggatagaaagaaccaatatagagaaaatggacatactgcccaaagtaatttatagattgaatgctaaccccatcaagctaccattgactttcttcacagaattagaaaatcaactttaaatttcatatggaacaaaaaacaagcccatatagccaagacaatcataagcaaaaagaacaaagctggaggcatcatgctacctgacttcaatctatactacaaggctacagtaaccaaaacagcatggtaatggtactggtaccaaagcagatacatagaccaatggaacagaacagaggcctcagaaataatgccatacttctacaaccatcttatctttgacaaacctcacaaaaacaagcaatggggaaaggatttcctatttaataaatggcattgagaaaactagctagccatatgtagaaaactgaaactggacctcttccttacaccttatacaaaaattaactcaaggtggattaaagacttaaacataagacctaaaaccataaaaaccctagaagaaaacctaggcaataccattcaggacataggcatgggcaaagactttgtgactaaaacaccaaaagcaatggcaacaaaagccaaaattgacaaatgggatctaattaaactaaagagcttctgcccagcaaaagaaactatcatcagagtgaacaggcaacctacagaatgggagaaaatgtttttgatctatccatctgacaaagggctagtatccagaatctacaaggaacttaaacaaatttacaattgaaaaaaccaacaaccccatcaaaaagtgggcaaaggatgtgaatagaaatttttcaaaggaagatatttatgtggccaacaaacatatgaagaaaagctcatcatcactggtcattagagaaatgcaaatcaaaaccacaatgagataccatctcatgccagttagactggcgatctttaaaaagtcaggaaacaacaggtgctggagaggatgtggagaaataggcatgcttttacactgttggtgggagtgtaaattagttcaaccattgtggaagacagtgtggtgattcctcaagaatctagaaccagaaataccacttgacccagcaatcccattactgggtatatacccaaatgattataaatcactctgttataaagacacgtgcacacatatgtttactgcagcactattcacaatagcaaacacttggaaccaacccaaatgcccatcagtgataggctggataaagaaaatgtggcagatatacaccatggaatactatgcagccataaaaaagcatgagttcatgtcctttgcaggacatggatgaagctggaaaccatctttctcagcaaactaacacagaaacaaaaaaccaaacaccacatgttctcactcataagtgggagttgagccatgaaaacacatggacacaggcaggggagtatcacacaccaaggcctgtttgggggtggggggctaggggagggatagcattaggagaaatacctaatgtagatgatgagttgatgggtgcagcaaaccaccatggcatgtgtatacctatgtaacaaacctgaatgttctgaacatgtatcccagaagttaaagtataattaaaaaaacccagcaaaattccagactattaatagaaattgggaagcaagttaaagtcaatgattcctgtatagtgcagaaaacattttcaataaagtgtgttttatttttcagttaaacttctggtaatttataatcagtgatttccaaatgtagttgatcatcagaataccccaaggagctttctaaaagtgatgtccagggccaacatgctatagtttctgatatctgattcaagagggagaggtgggctctgggtgtctgtatttttaatatactggataattctaaaagtaggcaactctatgctactcatctgtataatctttttaccgtcacactgtcagatgattgtggagagatctttgtccgtctatggatggacaaagacgtgtttgtgtgtgagggagatagagacataaaaataacacacagataattcaccaagagaaacaggaagaaaatgccaaccccatgggagaggtagcaaacatttttttcaaagcatcagctagagtattgttacttctctagtatatagtagaacatatgtagcagaacacatgtagtagaaaacaggaaccaatatagaaatgaagctagctaaaactctatatttagaacttgaacattgaagatttgtactctgaaagactgcgaattctttgaagttaatgtaaaagccctcatacaaaggaatgtcagcttagccatgggtgggtctaagacaaatttgtatgatgtacaaaaggattaaaggaaaatctagaacctttgttaccaaagaaaggtgttctggcagatccaggacaaagaaaatctcttttcccaggtctgtcaaatgattttacatatattttgtgtctaccagctatttgcttaagtgagcaccaagagaaattgtgtatggttccatagtgtgggttcattcacacagggacaatgctgtctaaatacctttggtcctaactacaaaggttctttcaggaagtatcaacttcagccagatggaaccggccaacaactgaagcctcaaacatggtggccaaagtgagtagtggacatgagttatgccctgcctaaatgcagccttaaggctgttctgctgtaagaatacattataatataaatgcacacattagttgaaatcctttgtggatcatatcctaaagctgcccaagtggggctgcttaactatttattttgtccactatgttatgtgttttgcattttatttatttattaagagatggagtctcactctgtcacccaggctggagtgcaatggcaccatcttggttcactgcaacctccgcctcccttttcaagtgtttctcctgcctcagcctcccaagtagctgagattatgagtgcacaccaccactcccagctaatttttgtacttttagtagagtcagggttttgccctgttgaccaggctggtcttgaactcctgacctcaggtgatccgcctgcctcggcctccgaaagtgctgagattacaggcatgagccactgcacctggccttgttttatttaatttgagtcaaatggagatcacctaaagaaaaaaaaattgacttcatgttttctttgtcaccaaatgactttgtttttgactgaattactggggtagacactgcataaaagtattttttataggcaggagggaaaaagaggaacagtttgtgaaatgaaattataaaagtttcattttataagggtgacgacaaatgtgctagacctttttgtaatgttcacagccgaaaaacagaaattgcataaggatgaatattagggtctttcataagatgttttagtacatactgtgtgtcattaattaggcaatatttctatgaggtcaaaactaggacatctccagagtcctaaatgacatttccagctttatgttgccattcagtgtcttttatgctattttatttttttttcagtctgtttgaagcattgagacccacagttcatgataaaatacattcttcaattttagtgcatggttacaaaaaaaaaaaaaggacacctattggcatttagcaaggtgaccattcataaagttttgactatttatagtagttttcatgagacagccccagtttatatttggttttccagtgtaattatttaatagtataccagtttattctcaaaaactgtagatgatatattatgtggcatcccttaatatagttaacagagtcactacttatttgactttaacactagcggtttttgtgcttgtttaggcctattcttcccagctgtgtcttctccaggaattaaagctcatgttcccagtctttccttgggatccaaacactgtgaacatgatagaagtttgcaaagcttacggacaaataccctctcccttttcctttattattcttgacctcgtagagagaagtaacatacaaaatgggatagatcttaaatacgtattcaggtatctctgaccctccattctgtagatgatgtaactgggattcaaagagggtataatgggtttagcccatggatggcttgtctcttagaccagcatgcttttcaatttaattagtatttaaaaagggtcctaaataaactcactaaaaggagggatctgaaaaaccaagccaacatgaaggtggaattttacataaatccaaatgaaaccctgggtatttggaatcctcatgcagcacagctttgggtagaaagactgctaaacagagtaggacaagagggagttcctgttgctctagggtgccacctgcaatacctgggctctaggaaccattcctgtgacagcacaattaactatcccaaagtaggggaaatatattaaagaggaatactccagggaaggcagatacacatcttcttattgatagtcctattttcccccgtctttttttctaaatacacggacttctttaacttccataatcagaaataatctatttctcagagtccttattgtctattggacaaatccagtaaaagatatgcattgtgtttttcatatgtctttgttattttatgagttgatttgagttctacctctcctctgagaaaaccaaacaagaggaactctgtaatagggaagactgtgactagaattaaggactcatatattgaccactggggctgttaatcatgaggatggatcaataatagagttcgcagaatatctgaaggtcattaattgtaccttggatttctaccttcctggaataaattaggaataaactgagtctttccaaaagcaaaggaatacatgaaaccctttcttgctttgtgagtaaataactttgcccttttggagactcatgttctcatctattacagaaggaaagaaaaaataatggaaaggtttatgtcccagaagttcctgattccatggtgtgtccctgacgaggtggtgtctttgggaccagtgctactaacaagtgaatattgagaaataggatagacacaggtgggaaaatatggctgctggtttcacagaagtttccagaaacacatagacaatatcctttcccttcgctctgcctcctcacaaagacattccaaagggcaccaattccttggatcaccaggtcatgaggaccttaggtctagaatagcaagtagagtgctctctctgttgggagattcctatcatactccggatggcaagaaaacaaatatgcaatggtatctctcagaactggtttaaaacatgccaaatgtgggatcttggcctctgcctttctccagggccagtcttatggcaaaactccatgggatgggcctattctaccgcattgagaccaagaaaattccaagactccaccttagcaacatggacgtatgatgaatagaaaagaataagaaagctgtgatttttcttcgaaagtaaaagttttaaaaaatgcattgagcataatagactgtcagccatgctatcaaacttaaaattatagctggacccagcagactcacaatgtaaatctgacaggtagggcaacaggcaagtgttgcacaaatgcctcctgggaccgtaacttcaattcatctctgaggaatctacatgaaagctccactctccctaatactcatgcccctataatttcatgctctgttctcaccatgtggatgaatacaaccttgaaccatgtctacatttttcattttatttcaggcaaatgaattccttgcaggacatattgtatgtgaaatcaggcatttttcttaacattgcctttgagcattgccacttataattctaagaaagccagagacattaaaaggaacccaagggaaattcgtagttgaaacaaataacaacaatgcattgactttgatattctttacccttgtccacactggcctggagttcagtcagctctttagcctgcagtgatgaagcttggagctgcttttctgggggacagcacaatggaatagagcctatttcaattccaacattttagggtgtctacattgatgtagccaatctttgaatttcgaagacattgcgaatcaaagcatcgtatcaatgtcattatatgttggagagtatacttagataaggcaaattgtactttcagtgcatatgttttagttgtgatatttaacattttcttaataggatttactaagcaccttaaagcagaattcagtgattaaagatatatctcagccaggcatggtggcttaggcctgtaatcccagcagtttgggaggctgaggtgggtggatcacgaggtcaggagatcgagaccatcctggctaacacggtgaaaccccatctctactaaaatacaaaaaattagctggtcgcggtgataggcacctgtagtaccagctactcaggaggctgaggcagtagaatggcgtgaacccaggaggtggagcttgcagtgagccgagatcacgccactgcactccagcctgggtgaaaaagcgccgtcgcaaaaaaaaaaaaaaaaatgtgtgtgtgtgtgtaacttttgccaagtgctagacactattctagatcttagggaagcagtgatataatcttatcctcaaaagcacacatcaagcttgaaagagagacccagaagaactaaccacactgcacataggatagatgctttaatagatgcatcagtaatttgctgtggaagcaaagaaaaggcacgctgagaattaactttgctctgaacagtccacaggtgataattggggttttagtggggctttgagagaacaaagacttcacagcactcacttttgagaatgtgggttgtattacgtataactttgtgatacatatacatttttaaaatgaattattaaactggttgtttactatgtaacaataaatagtttctagcattttatactacaaaatctcttttaattcttgtgacagtcctatggaaggggtaatactaaaatgccttatatagataaggaaagtgagactcagagatggtaagtaacttactcaagttctcacagttaccaagtggcggagctgggattagaacctggtctatcttgctccaaagtcccagtattttaatggacctgtttgcttgttagcagtgaccttactgattggctaacccttcgtaagatcccacgatgaacctcacttcccagaacttggcctgaaaccatgaccaggagagattagtgcctgacttggcatctggggattctctgtttctttcagtgtcagtttcagtactcaagtggtcttgggacaagttacataaaattgaatagccctactttcttataagtaaaatgaatataatgttcccttcattatgaagtatttagtagggtaatctttaacctatacacgtggacagctaagcacacagtgctaagcacagggcacataatatggtgtccacaaaagtgtctgttaccatatacatttccgagtaatttgcaatagggcaatttggagtatcccaacctttgcgctaatgccgtccacagtgtctgcttctgtctccataggacaaagtgaaagaactatgtgtaaaatatttctgtaacttagactgactttcacactaattagtcttggtttataagcttttattttactttttgttactaatcctgagttattatgcaatgtctggtaagccaaaggattccacacgcatttctaaatgttaatgcttactgaatacactgtatcagcttttggactgagttgtggtcattttattaggaccctattatagtgcttatgatgttatcccctctttgacttctctgactctactaccttccttgactccacttggttgagactcccggttgctgtgacatgggaaagtcagttttaaatcatctcaaaggcttcccctccctccagcagacctgaacaccccagggctactgggctgtgtattggcaacacgatagctctgaatcccctctccagccagccagccctagaatccagggactcacctgttatcctcccatccttctgctaaggtggggcccttgtgattctcagcaacccagttcccaggatcaggtttttaactctgtggttcaggattctgtttgctaaggacctggcataagggcttgagtccagcttgccctgggatccgaccttctgacaaacaactacatacatgtcaaactgcaattaatgtaagccaatgttaagacatttctattaagtaaagtccatactttattcagatgtctttagtttttacctagggtattttttgttcccagaatcccatccatgacatcacattacatttggtcctctcatctccctaggttcctctgggccatggcagtttcttggactttgtttttgatgacttcgatagttttgaggagtcctggtcagatattttgtagaatgacccttaattaggattgagctaatgtttttctcatgattagcctgtgttagtgtgtatttttgggaagaagactgtaggtgtaaagtgccatttttattgtattctattaagagagctatatcaatacgacttatcactattgatgttgaccttgctgaggtaatgttgctgggtttctgtattgtagagttactctttttccctctcattttatactttactcttgctggccaacctttttcacttaaataatatcaggtcaccaccaaggatagcagagataaaggagcttagataaaagcctgaaggaggtagggagatctaaagcctgaggctattctgctttgggtttaatttttttcttgggtccagtggtgtgaaaaattgaaagaggtttttttttgctttgagaacaatgaggagcagcccctggcaggtggctgtaagccagtgtgtcagcacaggggcaggttgcactgactggagtggcccctgtccccatgtctccctcagggttctggcagggcctggctgcagggctgctaggggccatgctgaggtccagtcctggtgatcatatcaggacaagcgtgcacattcaagatgctaagaacaaagttcccaaggatgactcagctgtgctcaagccagggcaagtctgataggccggagcagggtggatgcaggagccaaaggtcagtggcctgggaggactgagaagaagccacttcctggccttaaaaagatgaggagtctgaataaattcctagaagaagatgaagctcctttcctcctcttcttcttcttcttctcctcctccttctcctcctcctcctcctccttcttctttttttttttttttttttttttttttgccattggccacatagttaatggatgggtagaggaaatttaaacagaaccaggatgattgcatcattctaaatgagcttgtttagccccttctagaaggaggaaggtgaaggcccctgttcaggctgttccctggaaattacgttggcatttcttgtgcaaggaagactgaatgaaacattgaatgaaatatatctgtctaagaaaaccagttgctcccaaatcctgccccttgactgacagagcagcaactttgaccgccattcacatttcttggagagagaagtgtgtcagggtctctacttttaaagcccagtagggatgttcccatgagaactctggcatgcactgtgtggcaattggtacctccagggagggtgcccctcagtttaagcttccagtgtctactcccactcaatctccaagcttcagcctttctctgtgagatgtgctaaatttgttaatgtatccactaatacaatccagaaactaatactgagtgagcgagtgaatgagtaagcagaggcagggatgaaataacagcatctttctcaaataactctcttcctttcctttctaactggaatgtgtccctgtggccttttcctctaagagacagtgatttacagaaacaaaagctattgggacccagtttataaaatgttcctgactatattctaccatccagagtggagcacctgtaattgatccagaaattctagttgatacagccagtggaggaaattacaggcatctacaaacccaactgatccttttatcgtggctgaaatattcgatcattcacttacctagtcatttcagctttcaaaaaattgagtctaggtagttctctgaccaaattaacctttttgatgactgtgctaaccatctggattaatcaccgtggtgaaagctgttgtccacacagagttttacgagtctcatttcctttgacctttattctcaccacccagttatctgacaacatgtgtctaaaaagtgaaaaaaggtccacttgctttacactgaattcaataatgtctgaccttgctcttcagctgtagagtatattgtttagattgtgaaattgatgaggcgagaagagatgctgagaggaaaatagctgaaatgcagggagagcagatagtgcagtttgcttacatttaaattaactgatgctaatttatttacttattatatttatgggatgcacccattacttattagcctctggatacatgttaagaggatcataaaagagacactccttgtcattatggctaattaacattcaaattgactaacatttaagcgctaagaataaaatcggtcatgggccagtcaacattttcatcaaatgtccttaaatagaatccattagtcggtcccctctatttttctacctgctgccaaaatatctgacaccagaggatgtcagagttgataagggaactatatctgtagcattgcagcaactaatatcaggtgtgtctctggactcatgcagggtagtatgcaaagcttgattaaatggacatagcttcctctcagaagaggtttatagtccagctgtaattgatgtagaagaaatgaacacaacattcagggcttttatatcctattgttctgaagttgttttgctcacatagccgcagcaattactaaagcttacaaattagggtgtgtgtccaatagtaagtttttctattgaatatatacgctgaaagatccttgagctattgtaaatccatcgaactgaaatatgtaggacagtgagaaatactgaatggacaactcagatggttcttttcataatttctaggaggaaaggactagaaagggaaggaaatacatatttgtcattaacctaccaagtaaatctctacataagcacatatgagtcccacattaaaatatgtgcatattaaattttctgtccctttttccatttatgttcttgatgttttcactgttttagctctgagttgaggttatgctgaaggcagttgggggtgactgagatcaggcagggagaagataagctgtgaattatgaagatattccactaagtattgtgaggattattgttactaggtgagaaccagggtgatattgccggatgagagtcaatagtttcacttcaatcagacttttggtaaatttacatttttgaagaatcctatgttttaagccatgaaaggtgctccatttaggctaattttaaaagaataatctccatgtgaatcagaagttcaagccaaattagagatttaaggttctgtgtcattttattaaaactcaatgggctgctttagaatttggagcatctgaagttaatttttagattggtcattcacctagtgtagtatataggtgaagcaaatgggctctggagccagaattcttaaactcccaggctagccagaaacctcgggtacatttatttacctctctgcggctcggattccttcccagtaaagtcgtgaagataatagaatccattaattcaatgagataataaggtacagtgcctaacactgttcctagtatataataaaggctcaatacatcttcagctattgtaattctagttaattaccaatatattaccaatatatagcaacacaataataattattaacaactatcattaactaatcctatattaacttaaatttcttctcacagtggttcattagtccaaggaatatttaaattcagttttctttccctaagatggtacttcagggtgattgcaatggagcttctaaactttccattcaatccctttcctctcttttttttttttttttttttgtcccatttcttagtgaaatcctcaattctaagccttgcatgcatatagaaaattattgtcttaccgctctctgtggtggtggagaaggtgtgtagggagatctagtagcatcccagtgagggctaagcttagaggaagtctcatctcctacccagaactgtgccttgctagagtcaggtgggggagaaagggcagggctgcaacaaatgaaacaccaaagaagagattgaaaataaataatgaaagaggtaaatgtggagaatgataaaattaagctaaggaaaaaaatagacataaagatgggataagtgtgtctgttgggtgtatgggaacaaggttcttgttcagaatgatagtcttatccaggattagcttaatgtgcaagaagagtttcagggccaggaaactctagctcatgccatccatttaatacatagttaatgtgttcccactaggtgacaagcactgtgctaagcattgtaaatagagtgacgaagaccagagacatgacctttgctgccataacaattacactaagttaatgggaagacttatattagtaataatatttgttgacaaccatgatttcaaatttattattttgcaaataggcagagcagcagctgttaatgaggaatagggaccaaaagttaattagtttaatggattagctgaggaaagactaaggatgtataaatactttttttagagagtgcctaaggaactgcttatggttctggaaaataactacagggcaataaagagtaagtaatcaccaaagttgggccttctagtatgtttcaagactctgtaactcaccaaagtaaaacaaactggccttgccaaatcttgaaaaagcatcattgtgcagacggatttgagcaggactttgttttttttttttgcatcaaatgactccaaatttcttggggattttccattgaaactatttttaaagcagcttctcccctagttgctatcatcagagagagtggtttttataattttataagttagcttaatttgaggacactgagggtgtgtaagaaggtatggactagagaagctaaataagaaagactgagaataaatattgctgtcaaatattcgatagaattctaaatatcttggtgttgtgaccaaaactcccctctccgagtcctggtatttgtagaaataattttggctttttgtgaagcactagcccagtgatcagccacttcttctctccaatagagaaaagagaaagcgcttaaataagattgaggaggcactgctcctgcttcagagctccattatgttaccattatgagacatttattgagcaccatcattttaaaaatcagagtaagatgtagtcccttcttcacagtctggtgctctcaaagaactaccttatcctgaaccttcaattcattttttttcccaatatgcatgcagtttccccaactcagctgggtcccgccacctagtctgtcacaagcccagctaatcctaatcctggttggtgactaaagtgctaggcctcttacaagaacatcaacagtttcatctaacacggagtgagcacttcaggatggaggttaggctttaaaaagtgccaatcctacccttatgagctcccagtctcttcatctgtctcctcccacccttctgtttctatcatgagtggcgtgtagagtggatgagctcatgccatctgaggtcaaacccagcctctctcaattgccaaccaaatgtcacaggtcagagtacacgatccagctaagcctcagttttcttttttttcccttcttttctttctctttttttggagacggagtctcattctattgcccaggctggagtgcaatggtgcaatctcggcttactgcaacctttgcctcccaggttcaagcgattctcctgcctcagcctccagagtagctgggattacagatgcgtgccaccatgcccaactaatttttgtatttttttagtagaaatgggatttcaccatgttcgtcaggttggtctccaactcctgacctcatgatccatccatctcggcctcccaaagtgctgggacaacaggtgtgagccactgcacccggccaagcctcagtttttttataaagtggtgaatgttataggtggattttgagaaaaaggcaggctaaactaggtaagagagatctgacatgaaatgctcaatatacctaagttcttatttttattatctcattatctcctaatactccacaatcacatgctctgagcagattggaatactctctttctcaggaatatactttatctctctctctactccttaaaataacattcgctttatcagaaatgacctccttatcccccaattcctctatcaccatccagggttaccagatttaacaagtaaaaatacatgacatctagttaaatttgaatttcaaataaacaaccaatagtttttagtacaagtatgtcccatgcaatatttaatgggatatgcttatcctaaaaatttatctacttatctaaattcgtatataactgataatctgtctctttttttttttttttttttcttgaggtggagtctcgctctgtcacccaggctggagtacggtggtgccatctcagcttactgcaacctctgtctcctgggtccaaacaattctcctgcttcagcctcccagatagctgggattacaggcacctgccaccatgcctagctaatttttatatttttagtagaatcggggtttcaccatgttggccaggctggtcttgaactcctgacctcaagtgatccaccacctcggcctcccaaagtgctgggattacaggcatgagccactgtgcatggtctgatagtctgtattttatctggcatctctccctcctccattgtctcctgcctaccaagccctatctgctattgaaaatcttgtttgcgggtggcaaactcaaccaggtagggaatgctgatgggtggaagagtcccgatgaggatgtcgtaatggggcagtgtatacaggggagcagcatctcatctcctgcttgtttctatgtgtgaatgtaaaacttgtgttgctagtgtccccagtatttaagggtagtcagaaattcaaaaaattaagtgtgtgttatctgccaatatttaaacgttgaaactaatttaaaaatcactcaagggtcgcaaatttgaaaactccagccggtataattacatttccccccacatgactttccttgatatcccacacttagagatgacatctcgttcagctgaattccctatagggagctgcattcttatggctcagtattaatggccctgtatggtacattttaattttttccaagtagactataaatttgaagacagtagaaacaatgttcatttttttattctccaaggcttagtatttaatgtgttatcagttgaaagaatgaataaaggaatgcataaatgaataaatacatttcggtttagcaggagtcagcaaagatcactaatagggtcaacaacaggagtgagacaaggcaatactgagcaaagcacagaaatccaacacttttcaaaccatgaccaggcagcaacaacttgatcccgttgtggtattttcttgtggttctcaattaaatacatttacttgaggtgttatgaaatgagttaaattcctcctctctccaacagctgctgtccctcaggcctcagtcgctcaaacagcccacagcagataggctgtgtaaacagaagcattcccagtttacttagggaaaatccttatgtcagagcacagagcacacggccccagtgagaacggccagagggttcctgaagtggccttcatcagtaccctagccagtcttatatctgaagtttttagccataattttttccctggatagaaattaattttaagtcccacaatattaataacagcattaagaactaatataataaaagtttattgactaattttgcaccataatttgtgtttgattcttgtgctgccatgtttttatgaaatggaaacactgtttgtaggctgaataataatgaaagaaaaagagcaaatgatactttgaaaatcattcattgggatttaagatgttttgggtcaggaaacttaatgctattttcatgagggatgggtagaataatttaaaaaataataaaagaatctgcccaaccagagaaatgcttaagaatacataatcacttatggtaggtttatatattatttggctatactcagaaattgatgtctttgtaaaagcctttttagatcatcaacaaaggagaagttgagagtacgatcaagaatctgttatcaagggctaaattgacatgtgtgattgtcctatcaccaccatgggatggagaataataataataataataataataataacagttaatggaagttaaccagtttattccaggcaatgtgcctaccatttcatagccacaatctcatttattcctcataaccatcctatgaggttgattttcttactagacaaggaaatgagtccagtagttagccccaagacacatattcgtgaatgatatcattgaagctttaacccaaggtagagtatgtacctactgtgcctttgacatggtctcctgctataatactgcagcacaaacacaataggaatggaaaccagggagcttccatcaaactccagaacattctcataagtgacagttgaaccaagggaatatagttaaagtaaggtgccttttactgggacatgagataaaagagttgagtagcacaagcatcagaatcagaatcaggcataggaaacaggctcaagaaacaaaaagatcaaacacagtgtcaggagtggacattggggtcagagtcatacattagagcaagggtcaggacagatggagtaaagacctaacatttagaattagaaatatggttaaagaacagggacagaaaccatccattctactataatctctcaagaaagatgattttctcaaatctggtaggtgaaggcttgctggcaagagctgtattataaagggtgctcggtgtggttattgtgccacgtgactgtactacatagccctgagtgatggttattcttatagtaaatttggatgcgtggatataattatcacttgttgttgaagaaccctttaaactagtgaagtccgaatcttactttttttaaaaaaaatattgacctagtgtttttcctttggaaccaaaatcttcaacatctcgtgctatggaaaacaaaaaaaattcttcagcggctctctccaattcctgctcaaacaaaatgtaccaccttttaagcagtgaagagcacacatagtggactgcttttaatgactcattctgtttaataaatgactttgagaaccatcgaagacggtgtgagagtaggggtgccaatgacatagatatgcttctaggagaatatccaggtatccgtaaaggcagacccatgccaaggccttaccattattcctaaaaggactaaatgactaaataacagtgtgtgtacttggacagggggcattgtatccccgttattggaagaggttgggtagcttcccttctccagaatctaaccatagctgttgtccaaccaaagggtccattaccagagatgaatgtaataataatggagttggcagcaggagttaagccagaatcttctgtctgcattgatcacagggaagagacaagtccagcagagatgctagcccagcagcctggtgtccattccacctctcaggtgctgggctgagatccgttcttgaacagggaaggatcagaagaacttaaggaaagttaaggtcatgcttgaaagacctctgtgtatcaaagggaaagctgccaaatccacaagggtggggtagatggtaacacaactgatgaaatttggaactttacgagcccaataccctcaggaactgagaagggagctaagagtcaagatagaagcaaagcatggttcgagacaactgtttgcaaggagccgggaggctgtgccttgtcactgggtaccagctatgtggtgtgtggtattcagctaggtttaaaggcatatggtcaggtcagaaaaagaaaacaaaaatccctggctttgaatctgaggagcaggctgagagtgaaggagatatttcccccatctcttaatattctcagggctacagtataatggaatgagcctgagcctctgaatcagacagagctggtttcaggttctggtttcattccctgttacctgtgtcaagctcgccattttcttttctggcctagatgcctcttcctcatttgtaagtgaatataatcatatttacctcacaaaggttttcaaaatttcattgggaatgtcaaccccggagcctgagtcaaagtatatttttaatcttgccattaataacgataacagtcctaataaaagatcattttagatctgtcattgttggtaagccgctttctcttccttcattcaatccaccattgtggctcaaggaaatggctggaatgaattaactttgggaaagaactagatataatagtgggagaatcagtgctggagagagaagtaaaaagccacctcttatagctctggtggattatgggaagcaaaagaacaacagcaagaaaagcaagggcttcgtcataggcatcctggcctccattctcagggctgaagtgttttggggaaaatgtgttagagaaaggtgaagaggaagcagaggagacagatgtgactgtctctagaactctggaagaaaaagcagagagatgcgattgctgtgtagaagggtttctcctcccaccccctgctcctgcccgcaaggcaaggtggctgcaaggaagtaaaagtgatgggggcaggatcgtgggtgttactgctattctgtctggatctcctgtaccagcctgtgcatctctccccggatactgtattgtctgacaaggagaaactgttgttctcttctgttgttgccctcagctagacagaagtcactgagccggagaaacctagtggctctctctccactcagcccctgtggcccttctgcaatgaccatctgccgcagggcaccagggatctccagatgggactcatggctgctgggggtacagtttgtgctcttagtttccctgtgtgatcagatggatgggaatctcctattgagataacattcttttcttttttccacttttgttacttttaattgatgcacaataatttcacatacttacggggtatgtgatattttgatacatgtatacaatgtgtaatgatgaaatcagggtattagcatatctatcacttcaaatatttatcatttctttgtgttggaaacattcaaaattcaagctatttaaaaacatacaataaattatcgttaattatagtcaccctacagtgctacagaacaccagaatttattcctcctatctaattgtattttgtgtttattaacaaacctctcaccattccccctttgcccttacccttcccagcctccggtaactgctattctactctctctttctatgagatcaacatttttagcttccatgtatgaaagaaaacatagtatttctttttttgtgcttgccctattttaccaaacatagtgtcctccaaactcacctgtgttgccatgaatgacaagatttcactctttttatgactgaatagtattccattgcatatatataggccacattttctttatccatccattcattgatagacacttgggttgactcctctatatcttagctattgtgactagtgctgcaataaacataagggtgcaggtatcactttgatatgctgattttctttcctttgggtaaatactttgtagtaggattgctggatcatatgatagatttgtttttagtttatggcggaatatcagtactgttttccataaaggtggtgctaattcacattcccaccaacagtgtaccagcattcccctttctccacaaccttgccagcacttgatatcttttgtctttttgataatagccattctaactggggtaagatgatatctcactgttttgatttgcatttccctgatgattagcattgttgagcatttctttttgatatatctgttggagaacacaatctcactggctttattctcccctcttgctgggtttcctcattccgcttttcttcaaagaatatcccgccccaataagtcacttggataggaattcttactctagtgttcagggagaagaagagctggggttagccctacctggattcactcagctattgcatgatgggaaaggacctgaaagttttcacatgactctcagaagtggagagttcctggaaatctagctggagagcttgcccaaagggttcactacagggtagtgtgagcctagggccaaaagctatctgggggcaggccaacctgcctaagacctgagtgggagttccaggtactaagaaccaaggtggttcttaggattcttgggagcattgtccatgcagcaaaagcagagctatgaataacagcaagaaaaccagcagaaacatccagcagcagaaagggagagcgtgctgggagtcagcaccagggccagcacctcacacctaaaagccagcccagccctttgcagtcaaaagaccggcacaagacaaggggccacccactccccatgccttcacagtcccatgacaaccacattccatcttgggaaaaaggaaggaggggagaaaatttaattgaaagttaaattgtgagttcacttaatttggtttcccacaaagttgttttaactccaaagacaattttaacaaaaaaataaattgagatacattagattgcaaatttaagattttaattatctggtggggtgggtgcttatatataaaaaggtggaaaccacgttgtctttgcctgtctgagttggggtgtgaaaaaaatctgtattattaccgtgtgcatcttcctatctgcttcacatgggaatggatgtggcttacattaaaggcctcagacaggggtcaagaacaatcacactggcactcagcttgacttgaagcccatcaccctgggggagagcagcccactggcaagctgacaggagtagcaagtcagccatgaggatttggagagaaagaaatccataaagtgtgtgaatgtgcgatagcctttggtgcttacaaagatatgactttttgctatagcgatgcttctgggatgaatggattataacaggaaatacctcaaaacccttttgcttcagccaaagcaggagcagccctcagtgaaggcttggtcaggggaacttcccttgcagttgatgtggtcaactctcttccctatggggacatagtggggcattcccatgtcagtctgaatttatagaatttcaccactgagcactccttgttgttaagtatggcagatgccctgctccatagaaaataaacaagtgcctgctagcgagtgtggtaatagagtgcagcctgcatttcctgccttccactctagacctaccttccctttttcttccaacctgaagcacaattctgtggatgatttttccctccacctgacctcagatgagttcattcatccatttatcaggcacaagagccagttgaaacaaataaatgaagtggaaaggaaagggagcttggtgtcccaaacccctccactgagctgtgactcaggaattacagcacgttgtattaaatcatttctttgtgatgcattggggccgtgtaaaagtcgacagtgacatatgggaaaggccctgttagcaggattggggctgttgtgtgataaatgacacaatatgtcaaagaacatctgttatccatcatgtcggcttcctcagaacacttgagatggagagagagggaggaagaatgaagaagggagagagactggtagacagtggctgagaggtgggtaaatggaaaggaagcaagactatacacagctgggagaagataggaaaatgacctgctcaccataagagagccgacatgattcaagaggatgagctaaagtgagtccctccagcaacctgccactctcctgtccctcacatctctcttccctttatgttttcatgttttttggttgtttgtctaagtttaatcagttgagcatattaaaccttcatgccagcaggtgaggaatgggagctggctgcacagttgttctgttcttttccctctccagacgcactgctctggtgttgcataggatctcttctgagccagagaagctcaagggagcattctgcaacttcattggcatagcaagctgtattagaattgctcaagtgaatgctctgaagccagtgtttgagagcaggttttgtgccagcagggaacttggatttcttagcacttcatccttctaacattcctgtcacacttatgcaaatgcctgcaaagtttctgattattttatttcatcagaagaaacttccatttatatcgaatctctctttgtgatattatatctgtgactctttcaggatggggccagggtacccaggaggatagatttcgactccccttaaagatgcaactgctcatcatgccatctaagagaataaatctgtgttagtaactctgaaagatcagaatcagacatccctgcagctcatatgcttttattttagatgaggttacaggcagaaatgcaattttgaaaataattacactgttatatttacagagttagtttccttggtactcatatttctttctaagcattattttatatcctttaaatgtatatctggattgttgttctgtgttacagaagcaaataaaggaagagacagaagcaagatgctttgatccaacagtctggattacctgagtgggttttataaaatgcagatcgtatactttagaacaagattctgattcagaagttttgatatagggcccataaatctgaattttttgtttatctggtgattctgatgatcaatgtagtgaagttattggtttcagcctaaaaattaattttactcttttcctgccaccagtacccaaatttccttctgtgtatttaatttccgcctcttctccaccatgtggttatttttaaaagatagatccacatttgtaccattcaggccaatggtagagagtaaatcctaaaacctagagctactgcaaatgactcttttcctctgaagacagtggataaagatgtgtgagccgcggaattgtagtggacattttgtttgctatagccagggaaagcctgaagctgttgggcactgccatgtgtagcctgagaatgaagctgacaccgtggaaagcagagaggagagatggaaagaaactggatccttgatgtatcaattgagcttcttgatcaggcttgtctgacttgaaatctatgtctaggtatttcagcaacatcagtcaaagtgtttaagtcaagatgaggtgtgttttaaatcactcaaaaccaaaaaagtgccacctgatacaaatagccacactgaggaaaccttgctctaagtctcatcccaaataggtagggaatccaaaataagcatgaaccagacactagattctaataatacttactgagtatctggtagggccaagcactatttaaggccagcgcggaatatctggagttgagaaggccagttctttgagattttctgaatacaaagagaggacagtataccttgtaaaagaactaataatataaggcaacacaaaaggatcaaaacagggccgggtgcagtggctcatgcctataatcccagcactttgagaagctgaggtgggaggattgcttgagctcaggaatttgagatcgacatgggcaacataacgagacctcgactctacaaaaaatacaaaaactagccgggggtggtggcacgggcctgtggtcccagctgttccggagggtgtggtgggagggtcacctgagccagggaggcagaggttgcggtgagctgagatcacgccactgcactccagcctggacgacagagcaagaccctgtctcaaaaacaaaaaataagaagtatcgaaacagaataaatgcaatcaataaatgaaaggaagttagaggagtaagaagcaaagctcatcatgggccagagatgtagaggaggtagtatttggatttgttagccatcattgtttacgaacgccatttcctgtctccttttttgggctactcttgggtaactcctgtgacaaaagggaagataagacgtcgattatctcaggtcagacaggcatccctactcatgagttaagcatgctgatatcattgagggtagagccatgcgtagttgactactacaaagaagaggctacatgaattactgatctaaaaattacttaaagatccacctccccacccattgtcagttaaggaacaacacttcggatttttagcagtggagagatgcacctggcatatctgggaatactgatatgacagttgtgtctagagtgtcttagaggaaggtgaattagaagaaaggaaggtccctcaagtatctaggctaacatctctttagtctctgattgaatgtgggggcaatcagattgtcagggagaggctgaggccaggtagacacaagaatatttagtaattgattggttatggaggataaagggagaggagggaattagatgtaattatgaaatgtttaacctgagttactatgggacttagtgtgccattaaaatttaactcaaaagaaaaaaaaaggagaagctgatttccgaaggaatataattctttcagtttcaaatattttgaatttcattggctggcaagatatttgtatggagatatttgtggcgagtatatgagaaataaggatgtggtgtactgaagggcagtcgaggctacaggtgcagctttttggggtaacaataaaagttaaagctggaagaacagatacaaagccccataaagagtatataccgagaaaatatgaggatcaatgccaaaatatgagtaaatttctaaagcaaaaggaagaaatggaactcagaaaataaatagagataggctggtcaaggaggcaatggtaataacaacaaaacaacggccacaacagtgataactgtgcctgtttactaagtgccagacactatgcttaagcactacatgaatataccttagaaggatcaaaggcattttttctctcccaagcaaagaaaaaaggatcagaggacagatgtaattacagaaaaatccaaggcaactcatactggctgtctttcaagtgggttatgagatcttcaattggtagaatggggttctgcccttgagaagcatattcaacagtggtacagtggttgaacgtctatgctatggagatggcaagacctgggattgaaaccctggtctgcacttaactagctgtgtggattcttggccaagtggcccagtttcttcctctgtaaaaatgtggaggattttacctaccacacaggctcatggcaaggattaagtaatgaatagcacataaagcatccagaccactgtctggtacagtgctcagcatatgtctattaagagtgtggagaaggtaggaagccttagctgggactaggcagcagaattctgttatgtgtccagctaaggcagcctcctggtgttcagtgaggcagattctgggttgttgcatgcgtgcctgtgagtggagtgactgaggaacggcatgtccaatccttccacccaggagagccatactttggcttgctatgatggccagtgacatccatggctctgtaggcagagaaataagctgcaaataaaacccctttctcttttgctggcgtattaaaaaaaaattaacagtaaattgtggcatttcaagcttcccttctgtgtgccatctgttcacctacccatagtcctgcatgtcagcttactccagcagcttataagtacccctgccatcaatgcccagtgacttctgactccatgaacattggcctgttgaaaatcatgtctctatttatctagataaatcgattgttgcataaagccattcagttcagccacctcccgtgatgcatggggtccatttaatgatggatttgactgttagctatctaaggcagtaatgcttatccttgactatccattagattctcccaggagaggtttatgtttttactccacattttttccttgtcaaatccctaccctggacctggtgcattagaatttttaggtatgaagttgggacatacatatttttataaggctccctggctgggtcggatgtacagtcagcggtaaaatcatacctataaggaaagaagtctttgaaaagttgaactggatttgttggttgactgtttgctctagaatgaagtgtttggggccacatgcttcctgtctcctagattcaacctacagaaattttgaacagtattcattctgtttattcaggccggagaatgactacttacttacccaaaacctaacttttttgactactactatttaagaatagggtcaaaatattagaattggggttagagatatttggactcaaattctggcttagttatgtactgactgtgactttgaagaggctaattcacttctttgagcctcatctataaaatgcagacaacacccatatcacatgtttgtggttagggttaaagaagatgctgcataaaaattctctagctgagtacctaggcatggaatatgctttaaatagagccattattaataatattttatttatcttcattagttactgattaatcaatagatattcttactgcactatccttataatattccagctatttataggtttatgttgattttttttcttggggtttgtcatcagctaattatatcttctaggatatgttttaacggatatccattctttctttgagaatgttaatttagaaatgtatacatatgtacagacatactcaaaagaattagttattgactttctaaatatacagactcattacagaacatttttgtatgccttgagattatgttttatgcctgaactggttagacactttctttcccacccactaaatttcagcatgtgtgactttctcagtacttcttgggcctcccattgcctttgctattttgttctatcattgctggtcatgtaagctaagaagagaaagagtgtaaatgaaggcagagggaaagaaggaccttagagacatctaaagtgtaggaagtttgaggatagagaccttgttctttgcattcttatatacccataaaagttgtttaaaagaaatacttgtttaactgaaattgtgttataattcttctttactaggatctctcagaaaacagcctttcttaggcttctgaatatttaattagtttcttcttttcacctgtggtcacgtggccaaactttggccaaatagggcttggaaattctgattaaaagctgtattaatttgggataccatgggatagaggtaattcctccaaaggaaaacccagttgctgctacctaccaaaaggagaaatgaatagtggaaggcaagagcagttcatgtccccttttccattttccattacctaccagagaccaccttctcaatgtcttttccatgtctccctttttctccaggccttggccactgttctaatgtgctttcctatctcctgcttgttttctcccaattctaatatgatttgcacatgtctgtaaaattaaacttcccaaaaagtgcatttaccatattttaaaaccttccatcatttctaatcctcactggataaagtttgaactcttctgcctggcattcaagaccgtaaaaaaatcttgtcttttaccaacattgatgattttattattcagaaatttctacttgaaccagctgttcaatgaattggctcttatatcctaaagacagcctcaatggattggtggaggagccttatgccagccacagtagctttgcccggacacattatgtagactcattagaaatcttaggaataatctgagcataatctctagactcatctcctaacattcctggaattcttccctgttccccattataggcatgctttgtgtgtctatcatgttgaaaaactcacaggtctccaggcaggccaagtggccacatgtttgtcccttagtatgtggtattccctttcttgagtgtcattccacaatctctttccagtgctgaccactctcacctggacacttgtctcagaaaaattgttcctgatttctcctagtgagtgggagatgcctctgatttgtagcctcatgatgcactgaatattcccttatgacactgtaatgtaatttccatttactctccctgtctcaattacaccaggaactccttcatggaaaaattgagccctccaaatctttatcacctgtccttagcacatgcttagctagtgtagaagctcagggatggtgcaaactttacctatcctatttacaccctgtcacatcctagtgcacagagaaagatggggcacaaggaagctctcaacacagaagtacttcaatggctccaactcagtgatggtaaacaccaacgttcttactgaatgaaacaaaatattccctaagacgtgatcctgctgcccttctgccctcatctcctcacgctgtccctgacccacccttgctatttctgcccactggcctccttgctctttctgtgacactgcagtgtccccgaaagtgacaagtgtgttccagattcattctctttgccctgagtgttcccgctgctggaattgctctttcccctggtatgtacccggtctgctctgctcaataataacctaattaggtccctgattgtctgatattataaagtgctttctacatagcacatcctatatgccttacccttcttaatcatttccactgcccttagccttatgttacacgatatatgttcagtggtgtgtttattgtgtttcgcccttttctctatggtagttccatgagggtagggactttgtcttgtctgcgactctatcctcagcttctagaatatgcctagtacacagtaggcactcaattactgtttgttaagtgaatgaatacgtgctaaagaaataaaaggttgtaagggaacacaaagcatgtaaaataattatgttggacactactgaatatagatagctattcccaccagccattcatattcccttctctacagaaacagacagatacctaaattaaatatagatgcatgttccggaaacttcaaatccaatacaggcacaatggtattaataatacaaaatacatcatgtctaacattgctttgtgaaggagattgggaaaagagaggagagagcccgaacacttctccctacagcaattccgtaccccttttcataatattttggtagcttgatggaggcattttcttcccgaaagcagcctgacatttatccaggattgcctgaatttactgctgcagttaccagcaaaaagccatcaggttttagagttttctcatccgtagtaagctggtcaatttattttattagcatcttttccagtgcctgaccctaaaataactgatttcagtgtttacattcttagaggtgggctaatgaagaatctttggcagctactgccaagccctggatgtttgagtaaaactttgtaataaaagcaccgacaaaaccccagccttacccattggaaaaaaaatagattttgttgtgtgtagtatttttaaaatatcatattttgtaatagatatgatagatttgtgaataggcaattaaaagaattctgtaaattttatggagcttctctttccattcttttccaccttggtcactgacagacataatttgcctttttaaggatagactgctattttttactctttcttgttttcctcaattgccctcacccatctgtgtgactttttcttactctcttcactacgtatggaagactttgccctcacccatctgtgtgtctttttctcgctctcttcaccatgtatggaagactgttatttctgaatctttggactaaccttagaaaagttcccttagaggtgcacactgtggtggcttctgagagtcctatgcctgtccacatggagttccttctactatttttgcttatttcatcattaaaaatgaagctaattgttgccaaaaatatagaacgattggaactctcttacgtggccagttggggtgaactcatatacagccactttggaaaacatttttgaagttaagtttacaaatacactgatcatatgattcagtgaattccactgtctccccaagagcaataaaaacatgtccacatgattgctcatagcagttgtactcataatcaccccaaactgagaagtcaccaaatatttatcaacagatggatgaataagcaaattgtggcaaatccatgcaatgaaatactattcagcaataaaaaggaacaaaatattggtaaatgctacaacacggatgaacctcactgacatgatcagccaaataaaccaaacataaaaagagtacacactgaatgattctattttatgaaattctttaatagacaaaactaaactaaactgatggttgtctcaaaacagggttggggctattgactgcaaaggggcataaggaaactttttgaggtgataaaaaattttatatcttgactgtgagagtgattacagagatgtacccgcttgtgaaaatgcatcaaactacgctttagatgggtgcattttgttgtatgtaaattaaacctcaataatgttaatttaaaataaaaacaaaaaagcaaaactaatgcatgtttgaagtcaattcccactgaaatcttcagtggtcaagccgtctgtctacaggcagactattgcctccctaagacactgctgaccatttacccatcaggagaattttaggaaatttcattaaattattacaaagagcaagctctgattcaagacctgattttcctggcctctccctgggagaatagcagctgatgataaaagcaatgaaaacagtgcatatttattgatttgttgaaataccaggcatttgtaatgctgtgccagtatgtctggttcttagcacagtgcctggtacataggaggcacaccataaatattgattgagtagtagaacaaaacttataacaacgttacaatgaatgtatcaccattttatagataaataagccagggtcagagaagttaagtgacttttccaaagtctctaagagttttcaaagctatttttcgagcccaggtctctagcatcaggctttccattaaattaaaattcaatttaatgcaagatatcctgcttcccaattggttgggttgtttttttaatgtaaaattgttatgattatatctaaatcatatgcctgtattggctatcaaatgatttaaatatgtgaacaatctttgtaaactccaaagctttgtagaaaaacaagatgtaagcaatatggcttagcataaaatttggctttcttttttcctaacataataaaagctaacatttgtgcttaaaatgtaccacacactgttctaagtgctgtgtagtctataaaaatcacttaattctcacttaaaactctctgaggtacatatcatcatcatcattgtcttatctttgtcttcaacatctccattttataggtgagttcatgcattttttcccctgagttatagaggtagtaagtggcagagccaggatttgaatccaaatagtttttattcaaatctctcatagccattaccctatactttctcatccatccatctacctacctacccatccatccatcgttccatccccacaacactagtttttagcatatttccttgcaacacgtctgacaaataatgttcattcagtgatatcctcacctcattgtcattcacttcgatgttctgtatagatgaacagactgcaagttatgtatatttttctatatgtcagttgaaatttcaaccaattttaaaattcagaatagaaactgttcctctagattaaaacaataacaacaagcaaaacaatggcatagcttgtcttttattgctgccaatctgagttgggtaaattttgcattaataagtcacatcacatttatctgaataatgttctcttaaactgaaaaaagacacaaaggacttatcactccagaaagctatcttacatattccatccatactgtttctcttttccttctcttgaaaatatgttggaaaaatctagcatgggatttccaaattttgactcttcaattcaatagttaaagggcttatggccagaaagtcattagcattcttcccaatgaccaggcagcatgggcacagtagatgatgatgcctttgagagcagttgagaagaaaaacctctaactattgtggtattcagaggagaagccttcaaagggctagagaggtttactcttcaggttgacaggcatgtctgtaggctggatctcacatttggggcaatagtccccaaggagaataagttcagaagaggtctgataaaagctgcacattgattaggatatttcagcgaggaaactgtgattaaacatgcctctagagcaaatacaatttaatgtatttcatgacagttttgatgcttcattttaagaaaggaattgtgatttttttaatgaaatgtcagttttaccggattggttttataaaatagagcatatctacaatgctttcttgttcagactttataacctttgctattgtattaactaggttgaatgaccaacatttgaatatcttcaaaaaggattacctacattctgaagacagatacatttattaagtattccttatggattcatttcaaaaattatatatgtagagaaagaacacaccgctatttgccttgttagtaaactaaatggacaaaatccctttcattatgcagcctagctaatattaccacattcgaaaaaaatttcaaaatttaagaatgcacttcaaatacgcattcttaaaaaaaagctgttcaaagggacagaagcaaatatctttctatgtttttaaaatttatttttgcatgctttccattatgaaggcaactcctttcttaaagactaaaacccagcataagcatttggcctgttagatgtgcaacaaactccattttttttgtggcatgaacaaaaggcttttggtttgcaatcaggctatagttgacacactaatttttccctctagtaaagaggagtttcactcaacaggttcgtcgcagcctctgcacccaagaccccgctgggagccaattttaatacctgaaatattctctgctttctgaagagggcaggacatccggagaatacttgacattaagagtgatcgtaataaagttttgtcttaatctattcaggagaattttagagtcaggaaagtatgattagagcatctatgtctcgggaaaagtgtccccactgtgctttaagcttcatatcttgtagaaagatttaagaccaaataatcttaaaatcaaaccagattagaagtgctctggagaagaagtccaagagatatatcttcccagtagtcacattatataggatgatatagttttgttggttgaaaggatgtcaagggattatatgaattatccactttgacaaagttaaagataaaggttaataatctaccagcaaaagaaagggcaatgccagacacacatactccagccgttgcttctcataattcctctaagacctctctgggcctgggattagtgagtgcccccgattcttccatgtggggcccttggcctctttcaactgtcagtgctttcgatcataggggtagtctggtataaaaggaaggctgacggaataaaagtgaagacaatgcaggtttaatagggagaaatgattttcctactttcctttttggaagccaaatacactgtccccgtatattgccacttgaaaaaaatgagttaaaaaaatctgataacaaggctcagaaggctggcttaaatgaggtcaactactatgactaagtagcaatctgaagaaatgtacaaaaatcaagcctgtttttccaatatttggaggagagcttattttaaataaaaatcaaaattttaagaagtagactacaaaataaaaataactataataattttattatatgaaatataatcttgtaatggatatattatgccatatgtagtctatatgatgatgtattataataatttacattcgtgtaccaagaattaagctatccattttgcatcaattttctttctctctttaccaagtgacagatttaatgtaaactgattctgttacaattggatctaatttatagaaacatgtataccattcattccacggtagtcagtctgttacattgtttctatcagagctatcttttttagtgaattgggaacaaagcttacactaacaccatttgtcactgagcaagctgaactctgctttctaaatagtctggccacatcaattttctaacatatttatctcaataattgtatgtgagcaatacatttactgtcccatttaagagatgagaacattaaggcagagaaggttatagagctcaccaaaggcacaccatcactaagtacctgttgcagaggggttaccctaggttgcaggagataatttttgggtttattgcaaggctatcctgtgtagttaagtgctatgaagaaaattgcagctaagaaaatagaacggaaattgcagctgatttttgaggcaaatagacatattaaggtcccactgtgcactgctcaaagcctttatgaattaattatatgctacatgtctcgttaattactaacgtatcactgtactcaccttttgccttaaaagcttggtaaaatctcatacatatcctcgaatgaactactgcttctctatatgcttgcttacaaattatagtttgatccaagaaactagaagtttctgcttctctctggcttatattcacacgtgttgacatggagcatgtgtatgtgcagtaatcacgtgagtgtaataggctcccttgaatagtgcccacctcaaagagaacagctgcagtgttattgttttcagtgtaatatcacatttatagaacttgctgccaatgtggtaagatcaataggaattgcacttttatactaccagttttcctctggcctaatttcatgtagaccaggagcatgcactcacatgcttgagggaaaccgaagccacaacgagtgacaaatgttcatttgtccccaagattgagactggaataacagtactgctttctctagtttcagcttgcctaaaaatatgtggtgattaaatctttattcaatatgcttatatcaaacattggccataaatttcataattcatatttataaatagtttgggtgaaaagaaagatttgggaataaaaaacttaagctcttataaattttttcccagtttaagtcttgattctgttatatgattttattgatcactcatcatgccccagacacagccctccacacaatacatggttatctcaattaatccctaccacatctcaacaacagaggctcagaaaggtcatatgctttttggaaatggtagaatttgaacttaggtctctgactcctaagggtatattctcaagtcctaccgcattctgccctttgaaatcgatgcaggcaggcacagttgccattttttattgcccaacgggtacagctactcttatgaagcaatgcttatagtgaaatcagcttacatagctacagtgaccagtgatttgctatatgatggaaactccagagaatttaaaagtgaggaaaaatttaggatcaaggcttgagcataattgatggcaaaatcttcctgcttctgcaacaagtagagagaatagcttgtaaattgggccattgttatttttggtcagggccaggctggtcagattcagcaatagaagagtgtttacttgatactcggttcaatttggtctcctggtcttaggtgtcacttgcagctacttagatgtcaagggacaaactgcaccattaaaaaagtaaaaggaggccattggatgataggcatctcacacctatcatctcagcactttgggaggctgcggtgggaggattgcctgagcccaggagttccagatcaacctgggcaacatagaaagaccctatctctacaaaaaaaaaaaaaaaaaaaaaaaaaaaaatagccaggcgtggtgataggtacctatagtcctagctacttgggaggctgaggcaggaggattccttgagcccaggaatttgaggttgcagtgagcaatgactgagccactgcactccagtctgggcaacacacagaacaatcccttgtgtcttaaaacaaaacaaaacaaacaataacaacaacaacaaaaacaatggttcttgttaaacatacagcttcccaggttcccaggtacctctcctggagacagggattcagagggcctgagacgaacttgggaatttgcaagtttaacatacaccacgggaaatccttaccatcagagaagtcagagatactctgccaaggcaaagaagatgaagctggcagaattaattggccttccttgccgcttttccttaaatgcttgtctctgatttcctagttcctttagtgctggttctgtgccattgacacttgacctcatacatcctttcctgggttcctagcagctgctccagttcttgtctgtataccactctgcctcttgggtcacaaccgcttgccattttctactattaacgttgcattttgtttccgttgaatttgacccatgtgagagaactggcggttcagtacccaaacagatgatttccaccccagaagttcaaagaatgatatgatcttattttcttctttgttttggatatgagctaagcaaatgcattctaggtcagtggatgtcaaccttggctcagctcctcagggagctttacaaaccaccctgggtgattctgatgtcattgttctgggctatagcctgggatcagggactttaaaggccccagctgcctctaccatgccccatcggtggtagggtgtgggggtaccaacactctagaaagtcctgcaaccactctactagtttttaggagagtggaactgggtttataaaaaatgtttgctttaggtatagaatccatctgagctatctttgaaggaatcagccaaagtagcatattgctcacccaaactctcttttcaaggagagaaaaatcttcagtgagccccttttatgcctagccaccactcttccctggaccgcatctgagaagaacgttttataatatcgtatttatatagcgcttatctccctagagcacacataccatgcagatatgttttaagatctcattaatctcacagactttttcctttaagatttcacaggagtatcacggcaatatataaatgctgaaaacacaattttaaaaatatatataagtgccatgtaattttcaaactattatttacattccataaacatttatatttgggtgtatataaaacccggaaaatatctataacatatataaaacacaaaccatcaaatgtgcttgcattgatcaacatttcctttcaattccatcttttactctatggtaccctattttttctttctccttccctttgcaagaattttcatgtctctttattgctgaaattcctatggctacatttatggttatttcacccaccatgtttgcttattttccacatgctcatggtggcaatcgcatcaaggtgagcaaacggcttgcaacatccgttgcttcaaatcttaccatacaacccctccctgcctcacgcagcccatacaaattcttagctctgtggtattccttttcctttgacaattacttacaaactatgagtagctttatttgttgggcaataaaaaatggcaactgtgcctgcctgtatcaatttcaaaaggcagaatcctataggagttgaaaatatacacttaggagtcagagatctaggttgaaattctgtcatttccagaaagcgtatgacctttctgagcctctgttattgggatgtggtggggattaattgagataaccatgtattgtatggagggccatatctggggcatgatgatcaataaatgatgacgtccttagtagcatctgtcatctacacagacaagccttccagtctcagcccaagctctctcctttatttaagttgttcgctgactcctgctgggagacttcaagacccgtttcctctgctgcatcatttctttctttcttttttttaaaaaaaaacacaaaaaacttttacttctgggatacacgtgcagaatgtgcaggtttgttacataggtatacacatgccatggtggtttgctgcacccatcaactcgtcatctacattaggtatttctcctaatactatccctccccttgcccccacctcccaacaggccctggagtgcgatgttcccctccctgtgcccatatgttctcactgttcaactcctacttatcagtgagaacatgcggtgtttggttttctgttcctgtgttagtttgctgagaatgatggtttccagcttcatccatgtccctgcaaaggacatgaactcatgcttttttatggctgcataatattccatggtgtatatgcaccacattttcacattttctttatccagtctaacattgatgggcttttgggttggttccaattcttagctattgtgaatagtgctgcaataaacatacatgtgcatgtgtatttatagtagaatgatttataatcctttgggtacccagtaatgggattgctgggtcaaatggtatttctagttctagatccttgaggaatagccacactgtcttccacagtggttgaactaatttatactcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttatgtgcttttttgctgcataaatgtcttattttgagaagtgtctgttcatatcctttgcccacatttgatggggttgtttgttttttttttttgtaaatttgtttaagttccttatagattctggatattagctgtttgtcagatggatagattgcaaaaattttctcccattctgtaggttgcctgttcactctgatgatagtttcttttgctgtgcagaagctctttagtttaatcatatctcatttgtcaattttggcttttgttgccattacttttggtgttttagtcatgaagtccttgcccatgcctatatcctgaatggtattacttaggttttcttctagggtttttatggttttaggtcttatgtttaaatctttaatccatcttgagttaatttttgtataagttgtaaggaaggggtccagtttcagttttctgcatatagctagtgagttttcccaacaccatttattaaatagggaatcctttccccattgcttgtttttgtcggatttgttaaagatcagatggttgtagaagtgcggcattttttccaagtcctctgttctgttccattggtctatatatctgttttcataccagttccatgctgttttggttactctagccttgtagtatagtttgaagtcaggtagcgtgatgcctccagcttcatcctttttgcttaggattgtcttggctatacaggctcttttttggttccatatgaaatttaaagtagtttttttctgattctataaagaaggtcaatggtggcttgatgggaatagcattgaatctgtaaattacttgtggcagtatggccattttcacaatattggttctttctatccatgagcatggattggttttccatttgtttgtgtcctcttttatttccttgagcagtgattgtaattcccagaaagacggtcttcgtgtcccttgtaagttgtattcccaggtattttattctctttgtagaaattgggaatgggagtttgctcatgatttggctctctgtttgtctattattggtgtataggaatgcttgtgatttttgcacattaattttgtatcctgagactttgctgaagttgcttatgagcttaaggtgttttggggctaagacgatggggttttctaaatatacaataatgtgatctgcaaacagaaataatttgacttcctctcctcctgtttgaataccccttatttctttctcttgcctgattgcactggccagaacttccaatactatgttgaataggagtggtgatagagggcatccttgtcttgtgccagttttcaaagggaatgcttccagcttttgcccattcagtatgatattggctgtgggtttgtcataaatagctcttattattttgagatatgttccatcaatacctagtttattgagagtttttagcatgaaggggtgttgaattttatagaaggtcttttttgcatctattgagataatcatgtggttcttgttgttggtttggtttatttgatggattacgtttattgatttgcatatgttgaaccagacttgcatcccagggatgaagctgatttgattgtgatggataagctttttaacatgctgctggattcagtttgccagtattttattgaggattttcgcatcaatgttcattagggatattggcctgaaattttctttttcttggtggtagtctctgtatttcctgaatttgaatgttggcctgtcttgctgggttggggaggttctcctggataatatcctgaagagtgttttccaacttggttccattctccttgtcactttcaggtacaccaatcaaatgtaggttttgttgttgtgggaagtcagggaatccgaacggagggaccagctgaagccatggcagaacatcataaattgtcaagatttcatggacatttgttagttccccaaattaatacttttataatttcttatgcctgtctttactgccatctctgaacataaattgtgaagatttatggacatttatcacttccccaatcaatactcttataatttcctatgcctgtgtttactttaatctctcaatcctgtcatcttcataagctgaggatgtatgtcacctcaggaccctgtgatgattgcattatctgcaaaagttgtttgtaaagcgtgtgtgtttgaacaatatgaaatctggcaccttgaaaagaacaggataacagagattttcagggaacaagggagataaccataaattctgactgcctgcggggccgggaagaacagagtcatatttctcttctttcagaaagcgaataggagaaatattgcagaattcttttctcagcaacgaataacctgggaaaacgaatgcattcccagtaggaggtctctaaactggccgctctggatgtgtctgtcttatgcagttgtagataagggatgaaatatgccctggtctcctgcacacccccaggcttgttaggattgggaaattccagcctggtgaaattctagtcagactggttgtctgttctcaaacactgtttgtttcctgttaagatgtttatcaatgacaatgtgtgcccagtgggacatggaccttcatcagtaattctactttcaccctggccttgtgatctcactctgcctctctgcccttgtgatattttattgcctttgaagcatgtgatctctgtgacccactccctatttgtacacccctccccttttgaaaattgctaataaaaccttgctggttttgtagctcagggggcatcacggaacctgccgacatgtgatgtcacccctggagacccagctgtaaaatttctttcttttgtattctttctctttatttctcagaccggccgacacttagggaaaatagaaaagaacctatgttgaaatactgggggctggttcccccgatatttggtcttttcacataatcccatatttcttggagtctttgttccttttcattcttttttctctaatcttgttttcatgctttatttcattaagttgatcttcagtctctgatattctttcttctgcttcatcgatttgtctattgatacttgcatatgcttcatgaagttctcttgctgtgtttttcagctccatcaggccatttatgttcttctccaaactggttattctagttagcaattcctctaaccttttatcaaggttcttagcttccttgcattgaattagaacatgctcctttaggttggaggagtttgttattacccaccttctgaagcctacttctgtcaattgtcaaactcattctccatccagttttgttcccttgctggcaaggagttgtgatccattggaggagaagaggctttctgatttttggaattttcagcctttttgtgctgatttttcctcattgtcatggatttatctacctttggtgtttgctgttggtgaccttcagatggagtttttgtgtggtcgtcctttttgttgatgttgattctattgctttctgtttgttagtttgtattctaacagtcaggcccttcttctgcaggtctgctggagtttgctttaggtccactccagatcctatatgcctgggtatcagcagtggaggctgcagaacagcaaaaattgctgcctgcttcttcctctggaagcttcatcccagaggggcacccaccagatgccagccagagctctcctgtatgaagtgtctccccatctggagtcatggggatcagggacccacttgaggaggcagtctgtcccttagcagagctggagcactgtgctgggagatctgctgctctcttcagaacccgcgtgcaggaacatttaattctgctgaagctgctcccagagccaccctttccctcagggggtctctcccagggaggtgggagttttgtctttaagcccttgactggggctgctgcctttctttcagagaggccctgccccgagaggaggaatctagagatgcagtctggctacagaggctttggagagctgtggtgggctccgcccagtccgaacttcctgatggctttgtttacactgtgaggggaaaactgcctactcaagcctcagcaatggcggacactcctccccccaccaagcttgatcatccaaggtcgacttcagactgctgtgctggcagcaagaatttcaagccaatgatcttagcttgctgggctctgttggggtgagttctcctgagcaagaccatttggcttgctgacttcagccccctttccagggcagtgaaaggttctctctcgctggcattccaggccccactggggtatgaataaaaaactcctgcagctagctctgtgtctgcccaaatggccttgccgttttgttcttgaaacccagggcactagtgaaataggcatctgagggaatctcctggtctgagggttgcgaagaccatgggaaaggtatagtgtcttggccagaatgcactgcccctcatcacacagtatttcagggcttcccttggctaggtagggagttccccaaccccttgcacttcctgggtgaggcgatgccccaaccctgcttctgctcaccctgcttctgctccatgggttgcacccactgtctaaccagttccagtgagatgaaccaggtacctcagttggaaatgaagaaatcactcatctctgtgttggtctggctgggagctgcagactggagctgtttctatttggtcatcttgcccagaaatcctgctgcatcatttctgcttgtttatttcacctttacagatgttcctttattttcttttactagcatgtttctgcccattagactgtaaactccttggggcaggaatatgacttaaatcattttgtccctactcccagacatgcaagtatataatgagagtagggggacagatagggaacttcctacctgcagatacttggataattcacactaaggccttgaagaaaaattgcatgtctgcttctcctcctctccgcaagaagaaagcattagacaggcattcaagtccttagataccttttttctaactggtcctaaattggatctttaggcaaactttgcaaggtctgtctttgagaacggaaatctagaaaccctgtccatcgcacaaaattttggcatgctgaagcttaaattactgagcctccctagagaatgaggcttgttaagcttggggtgtagtttcccagaccgcactgctggaatctgcattctgggcacttggctccctcattttgattcaggctaattccaggggcaggtcaccttccccacagaggagcttggaaacacctgttatggacagacattgccgttcctcttcttctgaggagagaattgtttgatgtgtcttaaatgacctcattattagcccttggtggagcttccatttttttcagatttaaattggactaaacactgactaataaggctcctgtgcttattaaaattgtgttgttcatgttcatagcatttctcttcatcaccaaggaataatgagtagagtttgtaaattctttcgctaataattcagcaattatggtattaaaagagtgttttgtaggatagacatgagaggggatgtaaagaaattaggagagaggaactattcatcttgaagctgaaggggaatagacatttttgcctcccctcttggaacctaaatgaagtggggtaggcagaggggcctatgattgactttttgtctttatcaaggtataatttacaaatacaaattgtatgtatttatggtgcacaatgtgatgtttagatatatatattcattgtgaaatggttaaatgcttatcagtcaagctagttaatgtagccaacacctcacaaagtttgttttttttgtgatgagaatattcaagatctctgatagcaattttcaagtataaaatacattattattaactataggcaccttgaagtacaagttctccagaacttactcatactgtctaactgaaactttgtaccatttgaccaacagctttttgtccatttccttttccaattccctcagcctctggtaatcaacctttgactgactgcttctatgagttagaagttttttagattccacatataagtgagaccatgtagtatttatatttatatgcacagcttatttcagttagcataatatcctctaggttcatcctgagttggaggatttccctgttttctaaggatgagtactatttcattgtatgtatgtatgggtcacattttctttatccattcatctctccatggacacttagattgattctgtatcctggctattgtgagtagtgctgtactgaatatgggagggcagagatctcttggacatactgatgtcatttctgttggatatgtacccagaagggggattgctggatcatagggtagttcattgtagtattttttgaagctccatattgttttctaggatgccggtaccaatttgcttgccaccaacagtatacaaagggtatttttccttacacactctccaatacttgttatattttgtctttttgttcaaaactattctcactggtatgaggtgatatctcattgtcattttaacttgcgtttcccagatgattagtgaagttgaacttttttttatctatctgttggccatttgtatgtcttcttttgagaaatgtctatttaggtccttttgccatttaaaaaatcaggttacttgtttcttgctattggtttgaattccttatatattttggatgttagccccttacagatgtatggtatataaatatattcccccattctgtaggttgttctttcattctgtcagatgtttcctctgctgtgcagaagcattttagtatgacacaattccatttgcccatttttgcttttattgcctgtgctttagagatcgtagccaagcatcatggtccagactaatgttaataagtttttgcctatgtttccttctaatagttttacaattttggatctggattttaagtgattaatttatttcgaattgactttgtatataatgtgagatacaggtccaattttattcttttgcatgtgactatctagttttttcaaaatcaattactgaagaggctgtccttccaccattgtctgtccttggcactgttgttgatcagttgattgtaattgcatggattaatttctaagatctctattgtgtttcattggtctgtatgtctatttttatgctggtaccattctgttttaatttctacaagttcgtggtatgctttgttctttatgctcaagattgttttgaccagtcagtgtcttttgtggttccatatgtattttatgattgctttttctacttctatgaaaaataccattgtaattttgagagggatggcattgaagttgtagatcacttgtagcatggacattttagcaatattaactttttcaattcttaaacatgagacgtcttcccatttatttgtgtcgtcttaaatttctttcatcagtgttttatagtttcagtgtacacatctttcagctcagttaaatgcatttctaagtgtttttttaatgctattgtaaatgggattgtttgattgattttggggggatagttctttgttagtgtatagaaattttactgatttttgtgtgctaattatgtgtcttgcagcattactgaatttgtttattagttccaacagtgttttggtggagtctttaggattttctatatctaaaattatgtcacctgcaagcagagataattttacttattccttttcaatttttatgccttttatttccttttcttgccaaattgcccttgttaggacttccagtactatactgaataggagtagtgagagagggcatccttgccttcttcctgatctaagaggaaaatctttcacttttttaccactgaatataatgttagttgtgggattgacataaatggccttttaaatattatatatgacctttttaatattaagatagttttcttctacatctaattggttgactggttctatcatgaaagcatgttgaattttgtcaaatgctttttctgcatctattgagacagtcatatgattttcatccttcattctattaagatggtgtataacatttattgatttgtatatgatgaaccatctttgtatctcagggacaaattccacttgatctcagtgtttgactgtttcaatgtgctgttaaattcactttgtttgtattttgtgagaatttttgtatctgttaatcaaggatattggcctatagtttttttttttttttttatagcttcctcatctggctttgctatcagatcaacactggcctcgtaaaatgaatttggaagcattcactcctcttcaatttttttgtatgtgattgatatttaaatcacatttctaatatttggtgaggacagagtattacagtggtgttggcttctctttgtaaattttccctctttagggcattccagtgcttctatattcaaagtaaaatgtgcactaatgtgaaaaatagaggaaattctatttttaaaactgagggtcattttaagggtgatgtagtaggtcgaatggtgacctccaaaaagatattggcatgtcttgaccataggaacccacgaatatgatcttgttttgaaagacaatgttggcaaatgtcactaagttaaagatctcaaaatgagattaccctagtttatctgagtaaaccataaatccaatgacaagtgtgcttataagacacacaagagaggacacacaaagaagaaggtcatgtgaagacagaaccactgactggtgtgatgcagccatgagccaaggaaagcctggagtcaccaggagctggcagcagcaaggtaggatcctcccctagagagtttggaaggaggctggtattgctgacaccttgatttcagacttatgacctccagaagtgtgagagaatacatttctgttatcaccaagtttgtggtaatttgttccagcagccccaggaaactagtccagatgactagaggattcatatcagaaagacaaagtgacaaagttcatgggctttggtgattacaagacctggttaaggttcaggcatttttactcctttgcttctatggccttaggctaagatatcctctccgacatctgattggccagtgaattgacaattcattaattggttcctcaacaagcttataattacatctttgtgtgctctagtcacagtggtaggcattgtggtaagtagatgcacttcctaacattatacaattttacaggtaatgcaaagagaccagtattacagtatgtttgttaaatgttctttaatctgactataaatattgcaactggagaacatgctaattggagaacatttaaaaaatataggcaaaaataatagaatagattgggcgccacggctcacgcctgtaatcccagtattttgggaggctgagatgggtggatcacctgaggtcaggagttcaagaccagcctggccaacatgatgaagccccgtctctactaaaaatacaaaaattagccaggtgtgatggcacaggcctgtaatcccagctacttgggaggctgaggcagaagaattgcttgagcccaaaaggcaaaggttgcagtgagccgagattgcaccactgcactctagtctggatgacagagcaagatttccatctcaaaaaacaaaaaacagaacaataaaataacccattagcccagaatcaaagtttaatcacagttaatattttaatggatttctttcaatccattttataaatattcttataactacaatagtatatattactttaacattagattaaatgaaatgttactttaaaatatcattataatgcctttataagtcctttatagagaatactgttctctaattttgtagcatttaggtttcatcccaatttctcctatgcacaaaaatataggtttgggtactggattttgttctaggaacccagaatgggaccctgatccagtctagatggctttccagggaaggactgaatgtgataggaagagtgaggccccctcccagggccattctaagtattcaaggagataatgcaggtgaaaaattattggtcagttgttaggaaaatttttctctattgatctttttttatctattagctttgatttccagtaaatacaaattaaagtaaaaaagaaaagcacaaagaagaaaatcaaattgcctagagttttatttctgtcagttaataactgttaatattttagggtataaagtttcatcattttctatgtgtatgtagtgtgtatatttttttctatttgttttttttaaaaaaggtcatgtgtacatactttgtgttaatgtatgtattttcttcatatcaaaactattctgagacagtatttcaatgactacatagaaggcattttatcataggactggaaaacaatttatttgatcttaataatttttccaaattgtgatgcttatgtttatggcatgactatgctgtttttggaattttagttccttctagtgttgcactgttgccaacgtttgcctatatcattgattattaactcggtattaattcccataatggagtggctggattgagcctctggaaattttccttgtttttgataaattgtgccaaattttcctttggaaaattgtgtggacttgaacttctacatgtagtgggctggaaaacccccacctagatgactggtctgaatttcataagaatgaatatgtgttgctggactcaagtaataaaattgcactgtttggtatttatttttaatgagtagattttggctgattttgacacacacaaaaaatgagtaactagattgggaggttccaagatggccaaataggaatagctcaagtctacagctcccagtgtgagtgacgcagaagacaggtgatttctgcatttccaactgaggtaccgggttcatctcactggggcttgtcggacggtgggtgcaggagagtggatgcagccaactgagtgtcagccgaagaagggcaaggcattgcctcatccaggaggtacaaggggtcaaggaattccctttcctagctaagtgaagctgtgacagatggcacctggaaaatcaggtcactcccacactaatactgcgcttttccaatggtcttagcaagtggcacaccaggaaattatatcccgtgcctggctcagagggtcccacacccacggagcctcactcattgccagcacagcagtctgagatcgaactgcaaggcggcagcaagcctgatggaggggcacccaccattgctgaggcttgagtaggtaaacaaagctgccaggaagctcgaactgggtggagcccactgcagctcaaggaggcctgcctgcgtctgtaggctccacctctgggggcagggcatagccaaacaaaaggcagcagaaacctctgcagacttaaatgtccctgtctgacagctttgaagacagtagtggttctcccagcatggaggttgagacctgagaacggacagactgcctcctcaagtgggtccctgatccttgagtagcctaactgggaggcaccccccagtaggggcagactgacacctcacatggccaggtacccctctgagacgaagctttcagaggaatgatcaggcagcaacatttgctgttcagcaatattcgctgttctgcagcctctgctgctaatacccaggcaaaagggtctggagtggacctccggcaaactccaacagacctgcagctgagggtcctgaatgttagaaggaaaactaataaacagaaaggacatctacaccaaaaccccatctgtacgtcaccatcttcaaagaccaaaggcagataaaaccacaaaagtggggaaaaaacagagcagaaaagctgaaaattctaaaaatcagagtgcctctccccctccaaaggaacgcgactcattgccagcaacggaacaaagatggacagagaatgactttgacgcgctgagagaagaaggcttcagacgattaaacttctccaagctaaagaaggaagttcgaacccactgcaaagaagctaaaaaccttgaaaaaagattagaagaatggctaactagaataaccagtgtagagaagtccttaaatgacctgatggagctgaaaaccatgacacgagaactatgtgatgaatgcacaagcttcagtaggcaattcgatcaactggaagaaagggtatcagtgattgaagatcaaatgaatgaaaagaagtgagaagagaagtttagagaaaaaagagtaaaaagaaatgcaaaaagcctccaagaaatacgagactatgtgaaaagaccaaatctacgtctgattggtttacctgaaagtgatgcggagaatggaaccaagttggaaaacactcggcaggatattatccaggagaacttccccaacctagcaaggcaggccaacattcaaattcaggaaatacagagaatgccacaaagatactcatcaagaagagcaacttcaagacacataattgtcagattcaccaaagttgaaatgaaggaaaaaatgttaagggcagccagaaagaaaggtcgggttacccacaaagggaagcccatcagactaacagcggatctctcagcagaaactctacaagccagaagagagtgggggccaatatttaacattcttaaagaaacgaattttcaacccagaatttcatatccagccaaactaagcttcataaatgaaggagaaggagaaataaaatcctttacagacaagcaaatgctgagagattttgtcaccaccaggcctgccttacaagagctcctgaaggaagtactaaatatggaaaggaacaaccagtaccagccactgcaaaaacgtgctaaattgtaaagaccatcgatgctaggaagaaactgcatcaactaatgagcaaaataaccagctaacatcataatgacaggatcaaattcacacctaacaatattaaccttaaatgtaaatgggctaaatgctccaattaaaagacacagactggcaaattggataaagaatcaaaacccatcagtgtgctgtattcaggagacccatctcaagtgcagagacacacataggctcaaaataaaggggtggagaaagatctaccaagaaaatggaaaacaaaaaaaggcaggggttgcaatcctagtctctaataaaacagactttaaaccaacaaagatcaaaagagacaaagaaggccattacataatggtaaagggatcaattcaacaagaagagctaaccatcctaaatatatatgcacccaatacaggagcacccagattcataaagcaagtccttagagacctacaaagagacttagactcccacacaataataatgggagaatttaacaccctactgtcaacatgagacagatgaatgagacagaaagttaacaaggatatccaggaattgaactcagctctgcaccaagcagacctaatagacatctacggaactctccaccccaaatcaacagaatatacattcttctcagcaccacattgcacttattccaaaattgaccacatagttggaagtaaagcactcctcagcaaaagtaaaagaacagaaattataacaaagtgtctctcagaccacagtgcaatcaaactagaactcaggattaagaaactcactcaaaactgctccactacatggaaactgaacaacctgctcctgaatgactactggttacataatgaaatgaaggcagaaaaaaagatgttctttgaaaccaatgagaacaaacacacaacataccagaatctctgggacacatttaaagcagtgtgtagagggaaatttatagcactcaatgcccacaagagaaagcaggaaagatctaaaactgacaccctaacatcacaattgaaagaactagagaagcaagagcaaacacattcaaaagctagcagaaggcaagaaataactaagatcagagtagaactgaaggagatagagacacaaaaaaacccttcaaaaaatcaatgaatccaggagctggttttttgaaagatcaacaaaattgatagactgctagcaagactgataaagaagaaaagagagaagaatcaaatagacgcaataaaaaatgataaaggggatatcaccaccgattccacagaaatacaaactaccatcagagaatactataaacacctctacgcaaataaagtagaaaatctagaagaaatggataaattcctgggcacatacaccctcccaagactaaaccaggaagaagttgaatctctgaatagaccaataacaggctctgaaattgaggcaataattaattgcttaccaaccaaaaaaagttcaggaccagatgtattcacagccaaattctaccagaggtacaacgaggagctggtaacattccttctgaaactattccaattaacagaaaaagagggaattctccctaactcattttatgaggccagcatcgttctgagaccaaagcctggcagagacacaacaaaaaaagagaattttagatcaatatccctgatgaacattgatgcaaaaatcctcaataaaatactggcaaaccaaatccagcagcacatcaaaaagcttatccaccatgatcaagtgggcttcatccctgggatgcaaggctgattcaacatacgcaaatcaagaaacataatccagcatataaacagaatgaaagacaaaacccacatgattatctcaatagatgcaaaaaggcctttgacaaaattcaacagcccttcatgctaaaaactctcaataaattaggtactgaagggacgtatctcaaaataataagagctatttatgacaaacccacagccaatatcatactgaatgggcaaaaactggaagcattccctttgaaaacgggcacaagacagagatgccctctctcaccacccctactgaacatagtgttggaagttctgaccagggcaatcaggcaggagaaagaaataaagggtattcaattaggaaaagaagaagtcaaattgttgctgtttgcagatgacatgattgtatatttagaaaaccccattgtctcagcccgaaatctccttaagctgataagcaacttcagcaaagtctcaggatacaaaatcaatgtgcaaaaatcacaaacattcttatacaccaataagagaaaaacggagaggcaaatcatgagtgaactgccattcacaattgcttcgaagagaataaaatacctaggaatccaacttacaagggatgtgaaggacctcttcagggagaactacaaaccactgctcaacaaaataaaagaggacacaaacaaatggaagaacattccatgctcatggataggaagaatcaatatcatgaaaatggccatactgcccagggtaatttatagattcaatgccatccccatcaagctaccaatgactttcttcacagaattggaaaaaactactttaaagttcatatggaaccaaaaaagaacccacattgccaagacaatcctaagccaaaagaacaaagctggaggcatctcactacctgacttcaaactctactacaaggctacagtaaccaaaacagcacgatactggtaccaaaacagagatatagaccaatggaacacaacagagcactcagaaagaataccacacatctacaaccatctgatctttgacaaacctgacaaaagcaagaaatggggaaaggattccctgtttaataaatggtgctgggaaaactggctagccacatgtagaaagctgaaactggatccttccttacaccttatacaaaaatcaattcaagatggattaaagccttaaatgttagacctaaaaccataaaaaccctagaagaaaacctaggcaataccattcaggacataggcatgggcaaggacttcctgtctaaaacaccaaaagcaatggcaacaaaagccaaaattgacaaatgagatctaattaaactaaagagcttctgcacagcagaagaaacaaccatcagagtgaacaggcaacctacagaatgggagaaaaattttgcaatctactcatctgacaaagggctaatatccagaatctacaatgaactcaaacaaatttagaagaagaaaaacaacgccatcaacaagtgggcaaaggatatgaacagacacttctcaaaagaagacatttatgccaccaacagacacatgaaaaaatgctcatcatcactggccatcagaaaaatgcaaatcaaaaccacaatgagataccatctcccaccagttagaatggtgatcattaaaaagtcaggaaacaacaggtgctggagaggatgtggagaaataggaacacttttaccctgttttacaggtggcactgtaaactagttcaaccattgtggaagacagtgtggcgattcttcaaggacctagaactagaaataccatttgacccagccatcccattactgggtatatacccaaaagattataaatcatgctgctataaagacacatgcacacgtatgtttattgcggcactattcacaatagcaaagacttggaaccaacccaaatgtccaaaaatgatagactggattaagaaaatgtggcacatatacaccatggaatactatgcagccataaaaaaggatgaattcatatcctttgtagggacatggatgaagctggaaaccatcattctcagcaaactatcgcaaggacaaaaaaaccaaacaccacatgttctcactcataggtgggaattgaacaatgagaacacttgagcacaggaaggggaacatcacacactggggcctgttgtggggtggggagaggggggagggatagcattaggaaatatacctaatgtaaatgacaagttaatgtgtgtagcacaccaacatggcacatgtaacaaacctgcacgttgtgcacatgcaccctaggacttaaagtataataataaaaaagagtaactatgtgaagtgatgaatatattaatttgcttcagtatgataaccttttttaccatctatatgtatcccataacatcatattgtatactgtaaatgtacacaatttaaaaaaagttttactaattttcaaagcactcaaagttcatttttttctcttaaatgcttatgttagagttcaggtttgtggctatttttgtcatgctaatggaaattagtggtgaaaaatcttatcaagggaaattgcaccagaaatgagtcaattaaattctattttataaacattcattgaacatcaatcatgaggataagagtttatttgaatctagtactatgaaaagatgaatgtgatgtcatccttttaaaaagtacacagtgttacagaggaataaaacctacaaatgcctatgaataaatatatatacatatgagagggaagaatgtaatatatactgtcatacagactcaagcagaaaggaagataagatcatgttttcttggaaggtatggcaaagagattgccctctgaggctaggcaggattttaagagatggagattataaggccataggaacagcatgaagaaagcacataaggtcagaaaggctaagaatatttaggcaatggtgagcattctagtctggttgaagcctaggaagtatgtgaagggttttgatcatcatgctaagaacttggaagcttattccaatagcaaaagtactacttggatattcttgacatgttttttctcctgccatttaaggctggtgactattttcaatgggtaggatttatcagttaagagggaggtagcagaacaaaagaggaagaagaggaataaaatctttcccatgaaatgcaacttgaacataacagttgaaggacaatgagagcaaaaaaaaaaaaaaaaaagtcatttttctgtctcattggcttgccatgtttagaggatttcttgagggtttcttggcaataaggatattgagtacctactatgtgctagatgctttcctaagctttccttgaacaatttaggtagatattttaaaccagtttatgaaaaaggaagtcaaagtctattaagttcatgtcccttgttctggatcacacaaagggctgggaataaaatttaaatcagttgcttccagatcccatgctcttactactgccctgtattgaatatgtgaccttctgggagcaggactttctgcgttcttttattattcttatagcttctatctctgaatcctaagacatgttgagcttgggttggaatatgcaatgaatgcatattaataattttccaaattgtggtgcttatgtttatggcacgactatcctgtttttggaattttacttgcttccagttttccagtcttaagaacagcagtgtcatgaactgttgcactgttgccaatcttttcctatatcattgattatttattcagtattaattcctataatggaatggtaactcagaattacctgttttgcactttattttcttcagattctgccaaatcatcatcttagaactagacagaactttggcggtcacctggtttgttgttcacccttctgaaatcccaatatagcatctctgatagatattgtctgactcaagacttgactgcagtagaaggggttgtgttttactcaaatgactcatttaatatagctgagaagtggaatgacagagggaaagccatgtttgcttctagagaggttaaacattgaacagaaaaagtaatgtatagatgctgccagagataagtccagtagtctgctgtgttgttcccagccttactcatcgttcacagcttaggaactcctctgcaaaggagacagaagcaatgtgttcctgacttataactgtgatgagttaacctacttttgtaatatatttataatccttttgagctccttggaggaaagatgcaatatgaatataaaataataacaaggctagccttcaagtacttcctgaatgctcaggtgtagtttgaggcttaatgaatttgggttagtaaaatattctgagatcccagctgaagggagctagagagcacaaatggttattaattattgttattattgactcttgcccagagcatggagatggatggcctctgccatgctttatccccaggagtgtagctgcagatgccagtccagtgtgccataaatgtctaatcttttagaaggattaactctactttggattaaaaaaataatgatttcccataatctattctgaatgagatgcttttttctcctcctatttcatctggtgactttcgatacctataattgaaacaaactgcactgaaaccctggctggacccttcatgttttatattaagaagcagtgtgaagaccgtctacttgaattaatctcacctgcataacatgaggagaggaaacaaatgaaatgtagttttacatgtaaccttggcatatttcacctactttgtgtcttgtagtcatgttcttgccacccagaatgtccaaactgggtctatacacagtcaacatagatcagatttttttttcaatcattttgctttacatgatcttaatcattccaacaaaagcttcatcagccaagcaaagtatgtctcattatgtcagatgaaggatgacaaggttcataaatttggaaaggagagctgtatttctcataaagagttactgtctgcaggggggccattctgacaggctgggaaacatagcctccagtcagaagccagaaacagacacttcaagggagaagaaaagggaacaaaaattatgctgagaggggtggctgaatatacgtatttataagctagaggaggagtcatgaatatgtataaaaggagaaacatgtatatgctcaactgagctgcatgcctctccatggggcccatgttcaaaatatggcggcattggcatgatctgagggtgcagttttcagtcctctgacataaaaatgtgaagcagagaacatgaaaaccctcactgtacatcctctgtagactggccagaaccacttcatggttgatggtctcttatcagcaaggaatgctagttggtagttgggctgaaactgcaaaagagaggggcagtttaaggtggttggtgtcaggggtttggttgatatcgatggtggagccagtctttccaaaggtctggtttatttaacccctaggaaaaaatgcctaatggcagttagcgagggaggaggtataatgaggcttgtctgacctcccatcccatcatggccaggaactcatattctgaggtttctctgcagttcctcttgaccaagagggtgtcccttcagtccattagggagcttaaaattttatttttatttttcattcagtttcaggcttgctccaaggaggcagggggaaaagttgatgattacttaactctgccccaatcactgtctattgtcattgcctgagaaacacaatggaaagatttgggtagatgaaatggttcaagcacatttccaaagtgattacagaaaagtttcattggtttttgagacacaaacatttagctgttaaaataaacaaacttctgcatccctacaattattgcttaccaatgcagatgcagcttaaatgaatcccagctcatcttgaatactgttatgatctcctcaaatgaagcttcttgctattttagccagggagggagcagtcagtattcagctgaatgatcttgtgacaatatcctccctgttttccagttcaagtttgaaggacatttccaatcaggttaatgaagacctgctgctttagtgctgaaataggtttgtttacatctctcctcttatctatccgtgaagagccattctttttcatctgccagccaatcacagcctgccagtgcaacatctggcttgagcagctgctgaaagaggaagtatactttctctcccctcaagcaagtaacaagtgtgtgtaattgagaacctgtaattgcaagaaggcacagactttgggagaaaccatgaggggaaggctgatagaggagatgaatgaagcaaggcaggttttgtacactttggagggagtgtgaggtggaaagaactgcacagaggagggcagcgaatcatttttatttgtgcaccagcagagaggagttattgtaacatgtgttcataatgtcctgggccactttttaatcagatgaacataaagaaaaaacagataaaccttaatattttcccaaattgaaaatgcaagggatcagttatgaatctgagtggtttttgattatgtgactaagaccctcttgagcccaaaggtattctttaaggaagcatgtgttaaaatagaaacaggctggcttcttccacgtttcggtgcatttagttcgcctaagcttgagtactctctcacccttggcacactgaaatactactgcctgagtaggaaatgcatttaaaagagagcctattatcaattgattccatgtcttatcaagaaattccaaagcatctctttcctctattggggtctgtttccttccaaatctgcagctgtattgttcgactgagatgaattctagagaactgctatgagaactttttcaaaactttacatcaggccagatcagaatcactggaggtgactgaaaaacacttgaaatagtttcccggattgttccactctgttttaccttttctacatgccccactttacttagaatacttcactgtatttaagagttcccacttgctagtgctttgtaaagattttggaaaactatctttgaaccttagtcatctttgagaactccttgcagagagaagagcagagcacatccagccaaacaaagcagcatctcaatccctgaacagtctaaatgccaccagaacaggcgggaatagaagatctgctaagccgtcgctacttcaagtgtggtctgtgggccagtatcactggcattacctggagtttgttagaaatgcacaatctcaggcctcgtgccaaacctgtgaaattcaaatctgcattttaccagaatcttcagtgatcttcgtgcaaagtttgaagagtgctgctcaaagccacatctgaataaagaaaagactttaagagccaataccagcagagttccacccatgatttttcactgcttatatatgaacaactatacttattttaatacatgtgcaggatcaaacaaatcctttctgtcaagggcttatagtaaatattttaagttttgcagctacacagtctctgatgaaactttaactctgctgttatagtacagaagcagccacagacaataactaaaaaaatgggtatggctatgttacaataaaactgtatttatgtacactgaattttaaattttacataattttcatatgacgcaaaatatacatctgatttctgctcacccttgtaaaaatgtaaaaattattctcagctcatgggctatacaaaagcagatgatgggtcagatgtggcctgtggaccgtagtttgcaaactcctaaaacatattgagatgtgtttaatttttattctgtgttgcagaggtattcattcaaaatttattcttattctgatccaggtggcctgcagaaatacccttgacaaatcctggtccaaaggtttaaactttgaaatcacacccaaagctcttcacaaaccttgaccacatctctcctttccttctcctcctctttttaaacccaatacattagacactcagaaaggcaggattgcagagcagctaagaggctgagcattggcatcacctgtatctgggttgacacttaggttcttctgtttacgatgtgaaccttagtcacgatacttaacctctgcacagcttagtctcctcatcattaatttggagataattatataatggctggctgacagttttgtgctatttgtaaaataacgatcaagtatgcagggttcttagcacaatgtttggcacatgacaaattctctataaggcttcatgattcctgatccatgctgtgaatatttagctctcgatttcttggcttacgatccttttgcccagtttacctttccctcgtttgtcccttctatttccatattcttctaggttcaggatataagtccctcctcttctaaaatctttcctaactcatcccactgtgccaatccctacttaggcaaaagtaatgattccatgcttttgctttgtgaatcacatcactacatttgctgtcacattttagcatggtcatgtgtatatttgcctcactggctggacgttgggatctgtctgatttggttttaaaacccaggcacctgggcacagtccatttcccagagcaggcaagcaacagctgcatgaattaaagagatacatgcagtagttgtcatgagtaaagaacttgagaattgtgatgaaattacctttattatagtacagactttttattataattttaatttctcaacctcattgctataagtgagatattgaccaatacagtgaatctccatgtgtcttttggagctcaaatcctccctctctctttttatgtctccctgcttatggacacttgggtctcagctgtgcccatctacatgcatttgccctactcctgcctatgcacttttattcgacttggacctctgtacatggattcctgatgagtggccgagttcccagcttgagtcttggatgccaaccctgcatgtgtagctttccagcttctcctctttctgtaacccgctggatgcttatcctcttttcatttcagcccataggtgtccaacggtgccgcacgctccttgctataaaactggccaggatctgtagctgcccaatattctcaggttctaaccatcctgccagcccttgggcttgccagctctttttggtttcagtctttcctgaccttccagaactgtcaccggagagcattttataatcaggaataaagggatggcaaagtcaggtcacaaggagatggccacagggtgcagcgttcatccagaaacaagctcagtccgcatgaaaacttctctcttcctattgtaactctttgcttgaaaaaggagcttcatcctccaagggcagctgcaccccagcccatggaagatgaagtgaagccctaatcctgtgttgctaaaagtgctgtggactccttgccaatgtgcagaacgatggtgaaaatagtaattaataagtgatggggtattattgactcatcaggaacacctttgtagtaggctggatcaatgcataatatgggtctcataaagatgcttcttagaaatgcagatacttctggtaatgaaacgagctaaaaatttgaaaaggccccctgacttttttttttttaaaggaaagtagcttcaatctaaaggagaatgaaagctcatttggcaaggaggccgagaccagtgccagacagcaagcttaatgcatttagtttgcccctaaatcccatctattaaggaatcaactgcatgattaatattatttttctttcagttgtccaacaacgctgcactgaatgttgaatattgaattcatattttctctaagcagccgaacatatttatttggaattaagtctctgagttggtgactttgggaaagcctgggaaaccagaagcctgcataatggaacatcgctgagagaacactggtctgcagggcatgcctgttttatatcggggatgctcaaacatgtctggatgagtttcaagttcccctcctttgctttcttctcaatgagtggggtttacctggtcaaagcaaacaataagagcactaaacatcattaactcatcctgaacttttctactcagccccaaatttggtttccagtcatattggcccacagttttagtcatggtgtttcagctaaataacagctggaagttgatggcaacccagctgtagcctgctagagcaaacacttgagctcctatatgtataaaaatgataaaatggctagacgtataggtctctaattgcagccaggattctgcagctgggaagtcacccgaagatatgtattctgtgttgtaacccagcaactatgcattccatcccaactgaaaagcatttcccttccttcttacccccgagattgctgccaaaatgtgaagtccagttccagctcccaaactatgtttgcttctcattaggagctgacccagctccagtcttgtaaatctagccatggattgagccagggagatagatcagttagagtttgagggtgacgtgatggtaaggtagtaccaggacattagactcagatgcggtcctaagataaaatctatggggtcacaaaggcagccctccaatccagcaccacctgcaccaccatacacatgattgggagcagagcctcttgtttcctcccttcagccttctgacacatcccctcactccctgcctcccctcttctacgttcctcttttccattcctccctacatatatacatacctgtcctccttgcttcaaacagctcctacaactcatcgcccctctctaccgggccctttccaatgatggggaaatgttcatcttccttgaacttctctcacaagcattaaagggctttcctcttcctttgcagaaggaatttccctatagtcaaatattcattcttctgtctttacaattaatccaccaagcattgctcttgataggaaaaaaaaaatcaaatttagttttcttctgcttgaagtctggctttcaagactatcattttattgtggatttaaagagctgagcaatgatttctttgttcccttatcctgaggtactgatctttagcttcttggactaactagtcttcatagcagaagggctgcaggagctaaggggagaagatattaataaaagaggccaagaaaggaaagtatatctgcaagagtctaaaccattatttggctacagtgataagccctggcactgcactgccctggcatctttgcctttgggactagaccaaaatctccttatgataaggagccttccatttgcttttatatttgcagggtcttgcacagtgcctggcataaaaatatgcctaggcaatgaacagtgtgaatgaatgaatgaactgtcaaatctgtttggatctgcttgcgctaatgatagtgccctatatttgtaaaattttcccaagtatttccacatatatcatctgacttgatgtgactattggtaagttgtcatttttttcctgcacttctgtcaatgagccagaaaacatataaataagcaactaatttaattctgagaataaaaccagaaggagcaatggcatagatgatgagatatattatcttctatctggcattcgggtctatatcaggggtcagtaaactgtggcccacgaaccaaatctgtcctatcccctattttggtaaataaagttttgtcagaacacagccatacttgttcatgttgctgctttatcttgacaatagcggagctaactagttgtgagagatggtcaggcctgtaaagcccaagacatttgcgattttgcccttgactgaaaaagtttgctgacctctggtctagatgattaagagacattcgttcagcagggggcacatctcactttttaggatgccaagaaagctagagaaagtctgcctgcctttgaaactcttcttgatagctgggtggtattttctgatcagtgaccaaagttatgtgcttaaaaagaaacagcaggcaggaaaagtggagcagtatataaaacataaaattatcctcttcagtggatgcatgggtaaaggcatactggagtacccaggatttcacactcaggttgccttgtgttacctcaaacagctcaacataaagtgcttcggagggcccattttcccacaaggcagctatgacgtcccgctgagccatcttagccttcttccttatctcgtactttctgttatctttacacttgagaagttactccagatgcagctctgctgaaagtaacataattaggtatgggtccctccccttgctctttcatcatccctgcagtgtgtgcacgctgccttcactctgagagcttaatttttccctgctggatccataagtagatggaacatatgggacctcttgtacctgtaggcattttagcaatttcctctgatgaatccatttgtaaacctctgctcgttagaacgaaaggttcctcttgtttttgcagcctctgaagattttgtcattcacacgggcaggaggtcatgagatatctggttagttgtggggaaatttttgcttttggatgcttatttactttgataagttgagattatttttttttacaggcagttacttttaatttgtctgcatgacaataccaatgttctagaacaagtccaacatgaggatttgcaatctgcctctttatcttggcagctgccatttagccttgctgtttttatcactgagctatagattaggaaaccgaatgcaaactggttaagtgacttcatgattaaagtgaagtcatgcaaataaagagaatactgaaatattgtttctcagtggcacctgctgtattaaaacaacatagacttagaaataagagaatgtggattccagccacatctcccaccacttaacagattccaagtctcttgccaatttgttctgtaacttctgtgagcttcagtctcttcctctaggaaatctagatgatgattgtatcaccagcctcactaaattcacttctattccatttctactgacagaattttattgagcatttactctttctaggctctttgtctagcactgtggttatacaaaaatatatttatttctccttaagtggctagggtgaattgagaagtcagacacatataagaacgagttctatataatttggtatggagcatgtgggattctatgtgagttttacagggatacagaagagggtatttttctcagtctgagggtccagggaaattagtgtcattaagccagggtagaagagaagggttatccagatggggaccatagcatgacaggaagcaagggtgtgcgaaacagcatggtatatgtggaaagtcccaaaatgtttggcagtatttggtcataaagagaaaagcatacggtggcagcctatgtggctggaggtgcatgtgaggaccaggtcatgagaggccttgtaggccttgctaagggatcctttctgactctatccagagagctctgggaattctgtgaggctttcaggcagggatgtggtacagcaattacagtgcacttttgatcactttggctagtgtataaggcactagtccaacagaagagagttttaaagttaagagataattcttacagcttccaggaaagagacagactagatctgtgacagaagggacagaaagaaagggtatggtttttagaatcagtaaagaaatcattaggggtagagaggttgattggatagggtgggtgaagaagaggggatatgtttaaactgatgattaaacaagccattatgagtaaaagcattgcacaaactctaaagcactggaaaaaaattaatgatatttttagtcattcttcagaatatatttagtgatgttatgctcagttttaagccctagctaagttctggctgtgtgtggggggtggggggcgtggagcatagtgaaagaatgggagtacagaaaatagaagggaaattatatttataaaaaatgttattccagacactggcctaatactacacattcatgatttatcttggttctcacaatagcccttgaaagttgattttaccttcatttttggatgagagatggagacttaaagataacacaatccctaccctcaaagtgctcctagaatagtgagggaaatttgtataaattgaattataactcattatgagtgaagctatgatgaagatgaacatggagtgatgcaagcatatagaagaaaagtgctgacctatatttagggaaacttctcagaggtggtagcatctgtaaggtgattgagacttgtccacgaagtaggagggggcagcccacggagtcacatgttcaaaatttgaaggactatgaacagagaactgcaaatggatcagtatggctcataggagtagcaaagggaggccaaggtgggtggatcacttgaggtcaggagttcaagaccagtgtggccaacatggtgaaacctcatccctactaaaaatacaaaaattagctgggtgtggtgatgtgcatctgtaatcccagctacatgggaagctgaggcaggagaattgcttgaaactgggaggcggaggttgcagtgagctgagatcacaccactggactccagcctgggtgaaagagcgagactctatcaaaaaaaagaaaaaaaaaaaaagaaaaaaaaagaaagtgaaactgtaggatatgctaggactgggccttatgataaaagaaataggaaaccattgatgagttttaagcaagtgtgtgttaagataaaataaatacttaagaaagattattttgagggtagtgtagaagggaagaagaagatcagggaaaggcaatttcaaggtcataggaggtagaagcttgaagtagtatggtaaaagtggagatgcggtaggactaacattcaggaggtgaagagagacaacatggtgatcaggggttttagaaagagatagatataggccaggattataggctcacgcctgtaatcccagcactttgggagactgaggtgggcagatcacgaggtcaagagatccagaccatcctggccgaaggccaacatggcgaaacctcacctctactaaaaatacaaaaattagctgggcatggtggtgcacacctgtagtcccagctactcaggaggctgaggcaggagaattacttgaacctggaagggggaggttgcagtgagctgagatcatgccactgcactccagcctggtgacagagtgagactctgcctcagaaacaaacaaacaaacaaacaaaaacacatacaaaaaaacattcaggaggtaaagagagacaacacggtgatcacgtgttttagaaagagatggatataaatgccactcactttcttgtttgggggctgggtagatggtagactgaaacctccatcagatggaggctacaaatggaggagtatttcggaggaaaaggggttgaaagaagagaatggagagacatttagaagacacataggagaaggtaaactggtaaaatgtgaaagatgaaggggagagcatgcccaaggacagtggcatcatttacagagaaggacaaccttttgtcaggtggcatctcttggcccattgagagccagaataattgggtcttgatctcacattcctcacttttggaggtctgagtcttccccaacattttcaagatttcatgaagcttaagttctcatgatttcagtccacacactttcttccgtaatgctgtgggtttttgcacaatatttatccatatgtaaaacttcccttcacttgtccctgcaaaacacacacagacacatctctaaacatcatcgactccagtgaagagcttatggtcttccacgaaagaaagcttgaaaaattacttcctttacagtcctacactcaaacatccccttgcccacttccccctcccctgactgccccgactatttagactgtttagcttcatatcagtgcatggctcctctcttcactctatccttccattctcctttcttttctcatcctctttactccttttctggagccacaaatctctttcccaaacctctccctttcgcaggcatactggttcttccttcatttctgaacccttgacgctcactgacatctcagtccttgtgacgttggagcatggggtaagaggtgggagatgagtcatcttctactctaagtgtttatcaagagtattttcttccaaagataattgaggtcctggctataaagtgattctaatctatctactttattatgtggttaatatgaggcatggttgatgtggggtcatgtttgtaacagaaggtgacctgttttatcttagacaagtttcatttgacatgtctgtggcacattaaaattacccttatggttacagctaatctcctccctcctagaagatttttcttataaagtgtagaattttgtaggtggttctgttctttcttatggtcacacctcaacataagaaagttgactatggagtatcattattctttcccctcactggctcttcccatgctggttttgtatgatctgcaggatgatggtgtgcttagagtgttgatgtctccagtctgggttgaggaactcaactttctcctcagtcaacctaatcttgacagtctcttcagacctaacttattatcacctaccgatcaggctcatgacttaaaaacatgagcagtttatttacttttgtttaatcataaactctgactcagcatttttcagttagtacttttatttagaactatccttgcttgaaaagaagatgtcatcctttactctagaacattgacctttaaaaaataagtctagatagtgattatttttatacaggtatatcaggagccattattactcatgtgtttgttttgttttattaaataattcacacatcaagtaatgtgcaaaggatatgtaaggaacacacttacacttaatgctaatatttaacaaagtttaacatttttacgtatttgcttcagggttttttttttaaataaataacatattgtagataaagatttaagccccctttgaatccattcacaatccaattttcatccttgcttcaccaaaattgcaacatcctgaacctggcatcagttttacctgccccctagtgcgctccgtctgtctcgctcactctctctctctctctctctcgctttctttctttctctctctttctctgtttctgcttttgtattttttctttgatgtctttggttaacttttaatgcttgtgtatggctaatttacaatgtttatatagaaatttttattaaattcttctttaattaaaagcaaacaaacacaccccattccaagaaaatttctaaaattcaaaacaaaacgaaactctaatgtcgtttttttccagcttgatctatcagtttctgtgaaaggtatttttttttaaatacctctatcttttttttaaaaaaaaaaccttataaaagaaatttcattaaaaaaaccttataaaaatttgattaaaaaaccttacaaaagtagtttgataagcattattttcttatatttctacattttataacttccatcatttctttaacccataaattgatagattctgttttttgatgccagaaggtcatggtagaggtaactattgttggaacgctgttcttataacttttaaggtgatgcttgatttctaattcaattccattttgattaaacaacctggtctctacagtaattttttgaaatgtagtgagtcttatttttgacatagcatgagaacatttttaataaatattcaatatatggtataaaagtatgcatcttctctgtttggtatataattttttaagatcaaggttttttgatgtattatgtagatttttttatcttgctttttctttttttttcctatttgatctgtatctctgaaggatgtttataaaaatatcccaatattatatctccttggaactattttatcctgttccatgtttttgccctcaattctatttcacccccaatactagtattgctacaccaggtaaaaatatgcctattgagtcttttttttaaattttcaacctgatatagtttggctctgtgtccctatccagatcttatcacaaattgtaatccttataatcccggcatgttgagggacagacctggtgggaggtgattggatcatgggggcggtttcccccatgctggtctcatgatagtgaatgagttttcacaatatctgatgattttataaatctttgacagttcctccttcacacttgctctctctctcctgccaccttgtgaagaaagtacctgcttcccttttgccttgtaccatgactataagtttcctgaggcctcctcagccatgtggaactgtgagtcaattaaacctcttttgtttgtaaatcacccagtctcaggtattctttatagcagtgtgaaaattgattaatacacagtgtttttctgataatctgttttaagtatgcatccagcagagatgatatagcttttttaaaagatccaatatatagtagtgtcttttaatagattactttaattttatatttattgtgagcattcctgtatttggattaattttttccatctcattttgtgctatttaacatcattttttaacttccttttaatattcatttttgataccttccttggattatacactttttaacaatgtattttttttcccttttgccagtttggaagctactaattatattttattattttggtgattttgctttaattcaaaaataacaaaatacaatgtacatacatacaattgtacatgacagaaatgaatgatcacaaaattaacattcatgtaactgtcatacaagaaataaaacatttccagtatttcagcagtatagagcattaatgcattttaaaaatgcatcttttcccttccagttttaatgaagtataaatgacaaataaaaattgaatatacttacggtgtacgacatgatgttttgatatacatatacagtgtgaaatgactaccacaatctaaaataaatctttatattttgtttcttatgttatctaaagttgtgcaatatctctataccttcccaattgagatgaggacattagcaaagctgacttatctagccatcaaacactctttctcatcttctgtgatattgtttttaattttaataagacttatttgaagcaaagaaagtcagctattttatattcagtagttatataaattttgcatctcgcttcccttctctgtgccttttttgcttctttctaaagtacatcctttagtagttctttactactaatttacaagaattctaaacctcatgtctgaaaatgtctttatttcattttcattggaatgatactgtatccagttccaaaattctaatttaaaaattgtcttccctcagctctttgaaatgtttctctgttgctttcaattatttattgttactactcttaaatctactcacaatataattgccattgctttgaagagaatgtggcttttccgtttgataattttcaaaacatttctgtttattttcactgaaatgtgtcctcctgtttttattatgggacctcacccttccctcagctgtgttccatgcccctaggttagggacctggggccccatcatttgggaataaatctcccattttctgaactggagtgggaggggatattgcttagtcatataacctggagtatgggactcgggatctgattgttcctaatgcagactttcaaacaatccttctgtgtctggaaattttctgtaagtctcacattcagagctacctggtgcacccagttcctgacctttttctcatgtaaattgccttgcttccttttggcacataagtttgagggatctctgaactgctaaatcacataccgctacaccatctgctttcagtctctcaatatttagatatttcttgtctgttatcatcctcctttgctattttctttgtgtctgaagatttataaatatttctaaaattccttacagtaattttggagggggtttcttggaggtataatgaatgagtgcctatattcaatcttctacatttaaacaaaatttttttccattaagattttatagactttggaaattctattaacagaagatagggtccttcatttcataattagaaatatcccagggagacataacacattaacttataattataaatggctgtctgctttcctctttataattgacccccaattcagaattaattgcttccatatcttggttttatctccttcacatatttatggttttggttggcaggcttcaataactagacagtagacttcttgggattatgtcttagtaccatgacaggtactaaatactcatttgagtgcctggtacagaggttgcaccatacatgcttcttcaataaaatggagtgatttagaatcagaattaacacaaaaattttcctctatgacaagagtgtttctcacctattggcaagaaatttgaaccagatgttcactatgttaccatatttttctcccagatttgtcacatgatttgattgattactgggcttagaaaatgacattatgagtagatggaaaccctgtaataatggaatgacaatattacttggtatgtgtataatccttttattgtttaagatatttctatacccataattttttaaagtcttcatacatccctgcaattttggagaatagcaaggcctatttacaagatactggtgagaataatcatcatcaatttaggaaaaggaaaggaaattcccatatttgacattttatataaaactatgagcagtgaaggcaggaaactagaagggcttcttaaaggggttttaaaaagtatggatcacttgccaattgccaaagtacaggcctgaattttcctttccgtattactcttctcctaaggaatatgaccatgaggcagttagcacacacctgctttttgaagagaaatagaaaaggggatttggtgcaacatgtatctatctacagaaacggcctgtgtgctagaccacctgcccatgaagagtgacacagatatacttctttacccaattccacattctgaccagaaatggattacagctctgagctcatcctctctaatattttaaatggagggagtagagggacctctccttatgcagagaaacaaagttcttatttagtaaaaatattatagttagacacaattataaccacaaagatacttgacaaccaacagttatcagcaaagggaataatgataatttttgcctggcatagaaaaacacgctattgttaattctgagaattgtctaatctctcctcaagaagtgggaggcctggggattctggctaggctgggattctggagaaaagaataatatgggtttgagaagggttggggtctgtggctatgcaatttcgaacgaagtgtaatggaaccaggaaagctgggcttagacaaagaaatattttagaagttgaagaagagtttccaaagcaagaatcaaatctgtggaaaggattaccacaaagaggttgcctggtaggagctttaaagtctgctgattcagtctgaaaggaggattgtacattgacttgaggttatttatcgcagaatagcaaacaggtaatgcatcctctactaattagtattacagttcaattctggactggtcccatagaatgaggttttaagcatggattcagctagtaggaggtatacattttaaatgcattaaaggaaactaaagttttaaattgtaaataaatcattatgccatcttaaactgccaacaaggtaagtgaaagtagtgacctggttagcagtcagtagacacagtttcaagtgagcagcagaaacattctattgttatataaatgaagggagcagggaattgttgttcctccttcttcagtgagatcaaattaactaacatcacatcatagcatcagggaagtcacctgtgaatacctagcagctttacaggtgtgactctcttggttactgaaagagcttgtcagttgccaatctgagctatttttatgttgtgtgaaagctgaagaattcctgggtttgtggtcctgctgatttgccagacaaaatggacaactggagaaaatggtgctatttccttcttctaaagaatagacagatacctgttcatcacagaggtgggacttgagagctttatgaggctggcggttggagtcattcctggaaattccttttatgatgcacaggtttgtggagggagtctttatgtgtgtctcatggcttcttgataatcattaggttttagagaacttgctaataaattgtggttgacttctaaaaatgaaagttgcagattcacacaagaaactggaaagttaagaataggttatcccaagttctagtatggaaataggtagccatatgctgaaagagtaaaactttggtaattaaggggctaatgtatggactatttggaatatgaaatgtagttttcataatgtttgcaattacattttaaaaatcaggatataattcatataccattgctattcagttatttcaagtgggtaaagtggtttttaacatattcacaaattggtacaaccactagctcattccagtacaattttcatctccccaaaagaaagctgttaaccatccttccctgttttcctctcctctcagtccccagcaatcactaatgtgcttcccatgtctacggatttttctattctgggtgtttcatataaatggtatgatataatgtatggccttttatgtctgccttctttcactcagcacaaggttttcaaggtttcatctatggtgttgaatgcatcactattttgtttctttctatggctcaataatattccattgtatggggataccacatttgttattcatcatcagttgatggacatttggcttgtttcctctttctgactgataggagtaatgctgctataaacatccatgtgcaagattttatgtggacatatatttttagttctcttggatatatatccaggagtagaattgtcggatcatatggtgctgggtcatatggggactatatgtttgacactttaaggaactacaaacctacttcaaagtggctgaaccactttatatttcaccagcaatatatatgagtttcaattgatccacattccctccaacacttgtcattttctatattttagccatcggagtgggtatgaaatggtatctttttgtaattttgattttcatttacctaatgactaatgatgttgaacatcttgtaatgagcttattggtgatttgtatatcctatctggagaaatgtctattcaaatattttacctagcctttgattggattgtttgtattattgagtataagaaaatattttctcccattctgtggggtgtctttttcactttcttgatagtgtcctgtgatacccaatagtttttacttttgatgaaattcagtttatctgtgtttttaattgattttgcttttgatgttatatctaagaaaccataccctaacccagggtcaccaagatttattgtcatgtttcttctaggagttttataattttagctcttacatttagatctataattgttttggggttaattttcatgtgttacttgaggtgaaggtccaaatgtactgttttatgtatggatattctgttctcctagcaccatttgttgaaaaggctattttttcctcattaaattgtcttggcatccttgtagaaaatgatttgatcaataatatatgggtttatttctggactctcacttctgtttccattgatctatgtctatctttattacagtatcatactgctctgataattgtaactttgattttgaaattcggaagtgtgagtcctccagattcattctttttcaatactgctttgtgtattccttgttcttttcatttccatgtgaattttaagcttagcttgtcaaattttgaaaataaaaaaacccagatggacttatgatagagattgtgttgaaactgtagatcaatctgggaagtagtgccattttaatatcaagtcttcaagttcatgagtacaggatatcttacatttgttgaagtgctctttaatttctttcaataatgttttgtcttttgtggtgtaaaaaccttacacttctttggttaaatttattcctaagtattttattctttttaatgctattgtaagtaaacttggcttttaaattttatttttagattgttcattgctgatgtatgtaaataaattgatatttgtgcattaatcttaattctggaaacttgctgaactagtttattacctctaattttttgtagattaattaggattttctgtatacaagattgtatcatttgcaaataaagatagtattactttttcctttcctatctggatgcttttaatttcattttcttgcataatttctctggctaggatccacaatacaatgttgaatagatgtggtaaaagcagacaaccttggctcattccaaatcttggcaggaaaattttcagtcttttatcattaagtaaaataacagctgtgggtttatcaggttgaagaagttcccttcttagtttttttttttttaacatgtttttattatgaacatatgctggattttataaaacgttttttcagtagctcttgagatgattgtgtttgtcttttattctgttaacatggtgtattacattgatggatttacatacattgaacaaaccttccaatcctgagatgaatcccacttgtttgtgaactacatatataatcttttttataagttgttagatttgatttgctagtattttcttgagcattttgggcttatatttatcagggacactgttctgtagcttttttcccatgatatctttggttttgctacccggctaatattggactcacagaatgagttgaaaattgtttccttcttatgtatgttttggaaagttttgtgaaagattggttttaattcttccttaaacgcttggtagaattcaccactgaggccatgcagaattcaccagtgaagtcctatacttggtcttcagctttgatttgtgagagctttgttgattaataattcaatcttttatttattataggtctatttcaatttaatattttctatttcttcttcagtcaggtatggtaaattgtgtctttctaactttttgtccatttcatctaggttttcttatttgttggcatgaaattattcgtagtatttctttacagcctcagtaaggtcattagtaatgttccctctgtcatttctccttttaataatttacatcttttcttcctttttttccttgtcagtttgacaaaaaggtttatcagttttcaaagaaccaacttttagttccttgacttttctattgtttttctattctgtattttatgtatttctcttctaatctttattgtttcttttcttctgcttgcttcaggttttcctcttcttttctagttttttaatataaaaggctagattattgatttgtgattgttatgttttaaaataatctcttttaatacaggcatttacaaatatgtattttttctgcttttgttttatcctataaggtttggtatgctgtgttttcatttctattaatttcaaagtattttctaatttatattgtaatttcttctttgactcattcattatttaggagtgcattgtttaatttccatgtgcttataaatttcccaaacttccctctgctattggtatctaatttattttggttttggtcaaataatatatttgtatgatttaaatcatttaaatttattaaaacttgttttatggccaaccatgtgatctactctacagaatgtgtgcacttgggaaaaatgtgctttctgtttttgttggaccaagtgttctatagatgtctgttaatctacttgtttcatattgttatgcaaatcttatgttgcctttttgattctgtgtctagttgttctatccattactgaaagtggggaactgaaatctccaacaatttttggtgaattgtctatttacttcatttcttttagttattccttcatgtatgatggtgctttgttattagttgtgcacatatttacaatctagcttcttgatgaattaaccctttatcattatttaatgtccttctttgtttcttgtaactgtttgtgagttaaagtacattatgtctgatagtcctatagccactctgtctttcttttggttactgtttgcatggtgttttcttttccttcttttaacccattgtgtctttgaattcacagtatatctcttatagccagcttgtagttggaacactttaaaaaaatccattctaatctcaatctttagattgaattgtttaatccatttacatttaatataattactgattttaaaaaaggttttatgtatgtcattttgctatcagttttccatatttctatgtgttttttgttgttttttcattcctctcttatttcttttgagttaataaatattcaaggcactatttaaatttgttttcattagttttatagtattttttgaattcttttataactgccttggggatttataatattgatatataacaatctagtcagattaaaacaaacttaattgcaatagtgtacaaaatatgccattatatagcttcatttccttcccctttctttgtgctattatcatataaaatacgtcttcatatattgtagacacatcaacacagtttataattacaggttatgccattgttttttaaatcagggaagaaattttataattaaaaatacaatgccttttatatttacgtatgtattaactttatcagtgattttttaaatgtggattcttgttactgtctagtgtcttttcatttaagcctgaagccttccctttagtgtgtcttgtacagcagatttcatagcaataaattctcttattattttctttgttaggaaacaaattaatttctccgttaaaaaatagttttgctaagtatagaattcttgatgttcagtctttttgtgttagtactttgagtatatcatctcactgactctggtctccacagtttctgaaaaaaaaattagttattaatttcattgtaggtttcttgtatagcattagtcaattctgtcttgtagctttcaaaattctctttgtcttttgatattttggttattacatgtctaggtgtggaccctgagtttatctttcttggagtttgatgagatttttggatgtgtagattagattaatgtttttcactaagtttaggaagttttcagccattacttttttttaactatttgttcgttctgtctctttgtctctctattgcttccccttttattttggaactcctattagatgtatgttggtatgcttgatggtgtcccagtggtgtctgagactctgttaattttttagatcctttcttctctctattcttgaaagtggataaccccttccagtcactgaatactttttctgtctgcgcaaaacttctgttgaggatctgtagtgatttgtaaatttcaggtattgtacttttgaattccagaaattatatttgattattttgtaaaatttttgttttttaatgatagtttctatttgctgagacatcattctcatactttcttttagttcttcagacctgtttttctctctctttttagttccttaaacatatgcataatagcttatttaagtcttagacagtaagttcaatatctgggcttccacaaggatagtttctattagctgttatattttctgtgtatagcctatgcttttttgtttttttaatatctcataaattttttgctgaaaagtagaaattttaaatacataatgttgcaattctggaaatcagattcttccccaaacccaggatttattgttgtttgtttagtgacttcttgaagtaatccgtaaagtctatgttcttgtcatgtgcagccattaaagtctttgcttggctagcttagtggtcttctaatgattagacagagtttcttagtattctgtaactaataagtctcatagcgtttgctagggaacctactgttgatgtctgggcatgccttcaacactcagtcagacagtttacatctcttctttaatcttcacttcctgcttgttcagaacctcaaggtttgtcaggattgagagctcagggcctttttaggtctttcctgagcatgcacatagccctgagtgtacatacaaccctatgcatgcaggtttctagaaatattttagagctttcaaaatctccctgtggacattttcccctcaccttttagttttaagttcggtggtttgcccattggttgcccaacagttttctactatctgggagacccatgatgtttagcaattgcctctaatttttttcaacaaatgcccatgggaaaaagtctgtttccattcgggaagatttgagtcatgtcaaataaggaccagtgctgctgattccttttgcctgtgaacagagccaacactcatccaatagcttttcaacaaaacaaccttaattgaagagtcttgacagaatttgcaagacatcactaattggattccacttgccatctgctgcactatacctgacagagcccagtaaaatgtaaattcagaaccgatgacagagtgaaaggagaaaacaaccccttcctgataattgtggttacccaatctggagccttagagggaggggagaggtagcatcttgagtcttgtactaaggattgacattgaataaataaatgtgtacattttatttcctcaagatttatttgagattttctcacctttaatggagagcaacaaagaaggaaagcaggtatcatatcatgtaggataatttttcttaaggaatattattttgagaattattttcttttataaatatatataaaagtcatattgcctatgtttagcttgaagtgtatattttagtttaaaatacccagtgaactgaagatgacatttttctgatccatgagacctaactataaagatgttttgatttctcatattgcaaaaatgactccctaaataaaaagacgcagccaagctactaatgataaagccctctgattttctccttggatcttagtggaaataaattaaagtaaaataactttaaaatgttaatgccatgtatttgaaggagctagaccactgaaaagaatcaagcttacttatcagtaagaaagatgaagatctaatcatttcatggaagatccattaataccatatctgtactcaaactgcaactattctaaaaggaaaatatactcagaccataaaaatatgtttcccagaaactagagactggagaattcatccattcattctttatcgataaggtgatttctatgtgtcacgaattgttttttggggctgaggatacagtagttgaacaaaataggtaaggtccgtgttatcattaagcctacactctagtggggaagagagaacatgaactaaactagggtagatatgtaatacaatgatggatagtgttaattgtagtgaataaaataatgtaggttggaaaatagagggtaatgagcaggtgaaaggtgggaagaagatcctctatgatgagatgacatttgaacagaaacttgagagagtaaaccatggatatttggggaaagagactgccaggtagaatgaaagcagttaagaaacccttgacatagtccaggtaaaagaagatagtggcttagacagggtggtagtgttgaaagtggtgagttatacttggtttctgtatatactaaatattttgaagatttgctattaaacaggattaggggtatgtgataaagatgcctcaaagatgactataaggtatttgacctgagcaactggtgattaggggagccatttaatgaaaatagagagagggtagttgatgctccttccttctttgtttaggaagcctaaaagtgatttgccttttttttttttttttttgagatggaatctcactctgttgctaggccagagtgcagtggcacgagccaccatgcccagctaattttttttgtatttttagtagagaaggggtttcaccatgttggccaggatgatctcgatctcttgaccttgtgatctgcccaccttggcctcccaaagtgctgggattacaggcgtgaaccactgtgccccacctgtgatttgccttttaatttcctggaaccacttgtgtatgtgattcagctgaacaataccaacaggttgtggaagatctggatagaattgaaaccaacacaaaagcttttctgtaacaaaacagtacaaagtgtgttaagagagagaggggaaaaataatgacaaaaaagaagggattagaaaaagattgtgctttaggtaaagaaatttccagactttttccaggaaacctatttttcattggctaaagacctgggatcaaattcatgcttgaaatacatgactatgaacagttacataaaccttgtgaattgcagtttcttcaaatataaaacaggatttttttcgaggattaaatgataaatatagctttttctcctcttatttttattttattgttatgatttactgaaagtctcagaaaagccctatattgatgatccaattagtctctaagattatatattacaagtagtaactgagatccattaaatgtaggacatgatgatgagtattgaagcagattcaataaacatacaagatgcagtactatcctcaaatgatttatagtctaaatctgtagttaagcgaaaattcagaacagtattgatggtgatgcaaatgtgaatgctaaaaagaactgcttttaaaaaatgcaaacatttgttcatcactgagtacatacgaagcattttgctaagtgccttaagtgtgttatgacacttaagcctaagaaacaaacaatcaaaaatcctgtgagttaaatactggtatcacccttaggtcgaaataaaaagacaggcttgttcgtcatctgatactgagagtctaaaatttaacaaagttaaataacttggtcaagtttatacagcaagtgagagatccagacttgaatgcacacagccagaatccggtgacacgcacatacacttttcaccatttttgttttctcaaggaattttagaagttggagaaattgctacagattgtagtcaaaggaagtctcatgaaaggggcgaggcttgataagtttcctgaaagacaggtagaataagaaagagatggagaagaaaaagattgggtctgcagacatggctccatcagcaggtgaggggatttgagagttgggagagcacatagtggcctgggaacaataaggaaacatggtttgcttggaccactgggtttgtgttgggcagtaatagaagattgagttggactggtgagatgagactagtttgtagaaaatcttgaatgtcagccaaagtagtttacacatccttttttaggtaacaggagtcagtgaaagaatttgaatatacttttggaattatgtcaaattggaggagaaacattacgatagatagaagatgagaaaaacggtgaggaggcaattgctgtaatttatataggagataataaatcttagacaatttttcttcttatgaatttggtttcaaaaaataaaaccttataacctacctcccctctctttctcttcccttatttatgtcactgacactttgtcttttcttttgcatgcctttacctagaattagcattttcaaaggagaaagtcaccttggatagagatcatgtgttctaattttctgctttaaaaacaacaacagcaaaacaaacaaaacaacatctctgagccaaccaaaactacggagcttgcttaggattacactgtagcaagtgtcaaaacaaggctgaagctcatttttttttttttttcctgatttcttctgtggcactgagtgctatccattttctcctaccaggaaatcaaggaaaaggaactccagaattccaagatgactcttgacattcttttacctaggaaggtattggcagtcagcattgctttcagggaatgggataaatgtttcctagctatttaaagacccaatcagcagaaattatttttctgtacctgtgtcccgtgtcctaagagactaatcaggattttattatacatccagagttaaacacattgacatcctctaaagaaagcataagaatcaccttcttttctacatctgctagttagcaggaaagagaagagttgttactctctagagacacattttggcttgatcaactcatcaggggaattccttcatggcctgcaaagaaaacttacctgaatatgaagaaggctcttaggcatagaaaaagggaacaagtaaaaccccatgcattcttcccacctaggaaaataaatatggggtcttatgattcattacaggactctaatttctgagcttctttgagaaaactcagctctaaatttctttatcaacttttttgcagtagggatagaagactagaagttctattgcaagtttatacaaaacaatgtctatttttcttaatgttaatgatttggaacattacatgatatttttctattaaagatttctctccaacaaggaatatacagtgacttttaatccaaagcagactacagcagcctagaggaagccccagctgagatggagatgatcaggaacaatcaatatttcataattaaacctgttgaattcacagtaataaagctgcagttttaatttagagttgactgtccagagaaaaaatattctgacagcagtagaatggggagttgactttcatttattcctcagataaaggtgaattcattgtctatcaccttctgaccactgtgatgggttggtgctgagaaattgtcagaacgagagagacataatatcagcttggagctggcacttgataataatccccagaatgtaaattcctggaaggacttattcactgctgtaatcctcagaataagaatagtatccgacacatagtaggtgttctagttgaacaacaaatgtgtggtgaattagtgaataaagtgtttttatatgacatttttgtcttttgaatataattttgtacctgaaacaaacttgtcaaatgggaagaggaatattaattttacatagaagaaaaccacaaggatgtcagaagatttctaaggcttatggtcaggtgacagcactggcctcacatcccatccatttttaaaatattaagcagtgaaatcctttcttcaaacaaaattggactccagagttcaacaggcaaatcagatagaagctgagacacattggttcatataggtgtggggagcagacacctttcatttctgtaggcttcttccccatcccttttcatccattgcaaacactggataaatcatgctaattagatggttaggacatttgtgcttcttataagtaactgtcctctctgttacatagtttactctttattcagaggctactctagctgtgtgaccttaggcaggttacttaacatctgtaaatctcaactttctcatgtgcaaaatggaaattataattataaatgcctctagggttgttgtgaagatccatgaggagaatacatatagcagttaataaaaggcatggtacaaaataagtgctcaatgaatgtgaactataatggtggtgatgatgatgatgattgagataatggtgattgggaggaagaacagcttttgatactcacctggtctaaaacaaaacaaaaggatgaagtagggctcatttatttttcccgtgtgataggagctttcaatattaaatgaaatatataattatccatttcattttacattacagacatgacaaccaagatataaataaatgtagagaataatgtgttcttgcttttgtggtgtcagaaagcatttattttgctttttaggtttaacaaaaaggttttgagcacagtttaggacattaaaatatacaattaaatgccattttaattcatgtgaatatacgtttatgaaataatatctgtgttccagctactctttcaggctctggggacacagaggtacacaaaacactatcttgtctttaaagtgctgaatgtctggtggaaaaaaccattatagtaaggtaaaatcaagtctgtcgctgaggtgtcctcaaattacttttgcaaaaattgaaaatgtccatatctttctgctcattttgtttatctgggttttttctaatatatttctaaggacaaggcttatggggaatgatatttcctaggttcttgaatattgataagaatttgtctatacctctatatttgaaaaatcagtttttctggacatcaaatcattgtctcgcattttctttatttaaatatttttatttaatactttgaatatccttgttcaattttcttttgaaacattgtcctcaaaaaggtgtaatctaattttttccttggtaagtcatatcctgttattacctagatttccaatgagtttctttttctttaaaatccattaatatcactagattatctcttggtattggttgaagtcttagtatttcttttgatccttggctttttctttttcagaaactactattattcatatgttagatgttctttgcctgtcttcaatatttgtcactttgccttgaatccttgttatctttttctacccttctacagaattaaaacaaagtttttaattttacatttttctctaaaggcattatttgtcttatttattcatgtttgtgttctttctacactaggttttatttacaaaatgatattttctttttttaaccatttattatcacctaatttttgagtttttccagttattattttttttaaattatagattttttccttttttcaagttataacttttaaaactcttttaagtattcattttgaaataatttgtatctgtcaaagttacagtaatagtataaaaatattcctgcatatctttcacccagcttacctaaatgctaacattttacatatctgtaagataatgatcaaaaccaggaaactaacattaatatactagtattaattacatacattattcagatttcaccaatcattccaataatgttgtttttccaggatcatatattgcatttagtagttgtgtcttctcaatctcctctaatctaaaatagttcctcaggttttttttctgtttatcttgacttttttgaagagtactggtgagttatatatagaatatcccttgaattgggtttgtctgatgtttcctcattattaaatagtggctttgtatttctggcaaggttgtcacacaggtgatgttgtacccttctcagttgtatcatatcaggggcatgtgatgttgacatgcctcacaaatggtgatgttaactttgatcatttgaataaagtggtatcttccagacttctccatcataaagttactattatttgctttgggattagtaagtgtcttgtggggagatactctgatgtgaatcttctgttgctcattatagttttacccactaactttagctacattgctgattgttgcttgtatcgattattactgtgatgtttgtcaaatgataagttttttaagttttctctaaatgtataaatctacttctctatgtactaattggaattctactaaaattaagagctattccttcttccctacttatttatttaaatcactatgaatttatgaatatttaatttattctatgggttataacatagtactattgttcgtggtcaaatcttactgcatttcaccattgtggttcccttagaattgatctctgcgtcatttcaacatgtctccattatttaaaaatacttccttattttttggcaccattatatattctgttccagactgatattcttttcttctgccccacctctgaaaccaggcatttcttcaagcagccctggtttcttttattcaataatggtatttagaaactgatatctgggaactagatatgtttcttgcttgttagtatttctcggttcttctagcagacagagctgggaaatagatgtatgaatacacacacaaacacacacacacacacacacacacacatacacatctatttctttatctatctgtaaatttaaaatcatgagtttatgctgatacctctgatttcaatacaaaatcacagagttaattccttatttgtaattcctttctgtaacagtgagaaacctggttgttgttattcataattgatttacttatttattcaatcctagaatacacataaagtagttttagaattgccagctcagaattgtgcactgctatgaaaaacaaatttgtgtattgttctttttatccttagctttaccatttatagccaaaattttattttctaaagttactcagttcagttcttttcttcttacttcgtttagtgttagtcacttgtgacagagtttatttataaatgtttgtaacccatttgggttttctccatggctcttgtgtttgattatatttatttatttattgatatgaatatgtgaaatgttaacttggttctaaaagttgaaattagacaaaaatatatgctcagggaaatgtcacttgcccctcagtcttcttaccccattcccagttacccattctctgtttgttataccccatgtccaccccatgtccattaggccatcagtcttattagtttctgatttatctttcttgtattttcttgcacaaaggaataaatgcatgtttattgttcatctccttcattcttagctatgctattttatcccttaactgtatatttttatttgtaaaagttatatttcattcaactttatcatttaactccacatcctaaaaattaccactccatatcaactcattgggattttcctctttttttacatagttgcataatacttcattttgtgacggcaccaaattattcaactactctcctttatggaaatttacctttgtatgctaatattgtatcctgctactttactgaattcctttactgtttgagttaatagttggttttctaggtatgctgcaatgttatctgcaaatacacatggtttcagatcttctttactgatttgcatgcttctgaataatacctcttgtctaggttcattgggtaatacttctaattatacattgaagagttgtggagagagtgatcctcattaccttgtgcctgctcttagtggaaattcctctggagtttctccattaaataaaattcttcctttaagacttttagaattcctggctttaggaatgtgtgcatgtgtgcctgtatgtgtgtatatacacacatacacgcacagtatctatcaattcttattttcttgattgtctttatcaggagtgggtgtggaatttttcaaaggtttctatttgctttaattattataaaaataataattagttcttgatttttaaacattgtcttttattatttcctattctaacaattttttgtgagaattaaaaagaatttaaaatttcagattttaaataaatgacccttagttttatctactaaataatgttatgttgttcaaaatgtcagctggttgcaatggatgacttcaagtggttgttggctggctggcctcagaattagtagcacagcctaaggtttcactgttcacttgcatgtgtatttggcaaattcttcacaaacagttgttggtcttgtgaacacaaaagtatctgagacagatctcaatcaatttaaaaagtttgttttggcagtgttaaggacgtgcccgtgacacagcctcagcagtcctgatgacatgtgcccgaggtggttggggcatagcttggttttatacattttagggagacatgagatagcaattaatatgtgtaagatgtacattgattgggttcagaaaggtgggacaactcaaagcgggggagggagcttccaggtcataggtagataagagacaaacagttgcattcttttgagactctgattagccttttactgaatacacaagttccatgtgagaggaaactagaggagtagtcacttatgcctgagtctggcttagtgaaacaacagggcagagaaagccattatatatgcatttgtctcaggtgaacggagggttggctttgagttccgtcatctttgtccacaaggaatctccttgttggcaaattgtgaggcaggtatgtagcttttctatctttgtagctatcttatttggtaataaaatgggaggaaggttgtgcagttcccagcttgacttttccctttagcttagtgatcttgaggtctcgagatatattttcctttcagtctggtgacgtaactttagaaacttccaacgcagagggctgactgtttcacagggagtaatatttaatttattcagtcagttgtatgtgggaacaagtgttgtgtagaaatgtgaattaactggctgggtgcggtggctgacgcctgtcatcccagcactttggaaggccaaggtgggcagatcacctgaggtcaggagtttgagaccagcctggtcaacatggcgaaaccctgtctctactaaaaatacaaaaaattagctgggcgtggcggcacatgcctgtaatcccagctactctggaggctgaggcaggagaatcgcttgaacccaggaggcggaggttgcagtgagccgggatggtgctctagcctggttgacaagagtgaaactccatctcaaaaaaaaaaaaaaaaaaaaagtgatttaactgatcacgtgttcttgattgatgcaagtgatgcggtagggctctctctatatttgcagctaatctggctcatcacttaatctggtctgagctgatttcagctgaagttgtcctggtcgtgtgatcttttgaattgccccattgaatagctgaatgatattatgaaatcagactagtgaaaataacttagaaatgaaaaccacattttaatcttctctattggtgttcaaattaaaacatgtaagagactaacacaacagtgggaaaaatgggttgggcaagtatgtaagtgggagtgtctccaagcttttggagctggctctgctccagatgagatgctaaaagtcctaaatatgtgttctagttctggaagcatggtggcaataaatccctttataaagtaataattcctttgtgaatgttaattttcttcttaccttaaattctagtagaaagcactgcttctttcactttaatgtgcatacacagtccattaggatcttgttaaaatgcagactcagggttgggactagagtttctacatatctcacaggctaccaggtaatgttgttgctcctcctttgtgactacccttggaggaacaagggcataaagaactattttgtatttagacctaccaaagttcaaatgttaactatgggtaatttctttcacaaagatgacatttgaacccaggtcagttcttctggcttatctttaaagattttggctttcccatttctgggctctggggtgatcatgcctctggtaacccatttctgggttcctggaggtgtgtaggaacacctgtgttagatctcttatcttcccttgctctctggattattgactctcctgagcattttgcgtgacaaaaaatatcctgaacataataacatgtccctgacaaccctggttgttttgagctttagaacaactgtagctttgaaatgaagttgtcttttggttttttcctcttttttcttttctccatccaaaccatgtttatttggaaagctctgggtgcagtgtctggccgatagtcccccatgctcttcgtcgtgttcttgaagctttcatgcatctctttgccttcatagatattctcctcctgcacccttcctgccttcttcacctaggatgtacagtgaatggcgaagctgctgcctaaatctcaaacatgctgcctctctttaggctccagagcttgctgtgctgcaggcactaatattatctagcctggcatcattcattcagtctgatgggctctatccctctgtttttcagtcatggacggatgggagatttttgaatcctcttgtattgggacggcagccctatagattcatttttagaaggtgactcacttttcctctgtctctgcttgtggtcctttcttggctttaggagttctggtagttcaggatctagttgttaaagcccgcggttatgttacttgtttcccaacctctggaggatccctgttctcagtagataaacgagatccacaattaatgttaaaagaattatttttcgtggcatcattgtcctttagactgtccagcctttaaggttcccttttaatcagaatgtcatgcagctggtggcttctattcagtgaccctttagttaggactagtgctgctgattgactcttcgataatttcagttgagatgcttttgtttggtcataaaatgaccatattttctggagatcagaagctgtcttctcttttcttaaggaaaaagatatgccccacaaaaacctcagttttaaggatttccagacattggctgcaaatgcctgaaaagaacagaaagataatgcgtgtgggaaacaatcaaggtaaacataggcaataaggatgcctgaccctcagtggcatatgaaattcccacctaaaaacattcagtcagtgcaaaataattcagtctagttctggtgaagtattccaactctgtaccaccttctaaaattaaggatctaggcaaggttatcacatctctggtgtgcatttgttgagagagttacagggatgcaagcatttcaaagctaaaaatgcagcattcctagacaaactggatatctgagcatcctagatctggcatatttagtgcctataaactttatcttaaactagctatttaaactaaagctttttaaaataaggaggacaagtcagatcaaatgtctttatttgtgaaaaacaaaatgaagtggataatttttccctgtaacttattttcagtgaagggaaaaataacatcatcctttgatatttgcagattattggttccaggacaccttccccacacccacctccatggatatcaaaattcgtggatgctcaagcctcttatataaaatggcttagtacagttggccctccatattcatggatacagagggccaactatagcaataatcaccattttatgattcttataaagaaagcagaacttcaaactatttgagagaggaccacttttcagaaattataggcactgaatttattgccagccagtcatagctgtccatctgctaattctccccccatagaaggagcagctgtcatttcagaaatgctacagtagataataagatagggtgcatttcatcttcaaatgcttaaatccctgggaagagcagcaacagctcttctgactgcatgaatctctgatattattaacacaaaatgccaaatggattcagagatcagaagcaaatggattcactttaaaaggaaaagcactcaagttaggtgttgtacatattataataacctgcatttgcatagatacagggactgccaaagccctagtcacacacagagatactctccaaatcataaccaccatagagtcctgaagacaaatacaatcacatgggcttcccaaatccacacaacctatctacacaaatggaatgattcattgcctctacctccaaaacagacaacaaacaaaccaaattttccccaaaataagagctttcttaagttctgtatgtctcacattggcccaatttctctccaaatctctatgtttaaatattcttagatgtggtcctcctttgtgtgctgtttaacagcccaaatttcaatcagcaatttctactgattatttctttgcattttttcttagatgaattcttttctgttcagcctactgcctctacccttaggtgtgtccaagtacactgttacttaaaaatgaccacagcctcttgcctggagttcttagtcaagacacttctcccttccattcaccctgcatatagctatctgattattctttataagaaaaaaaaattaggatgaggtaaggaaccaatgaatgtagtcaaagttgtgctatgcatccttgagcattttagatgtagatgaagatgtagacatagatacagatgtggatatagtcatgcacacagacataggtagagatagaagtatatgatatttctctatagggatatctaaaatagctatttcattcgatcctcaaaataaacctagggggagatttgacttatttatttcacacatgagaatgttgactctcaaagaggtctcaaatcctatatctggtagcagcttggagttggaactaggtcttattcaaatttgggcttctggtttcagcacaaaactttattttttttattcttggaaattgtgatctaaaatagtatttctgcaaagtggtaatacgtgagccttctccatgtagatgttgcccctgaacttggtttccatggagcatagggaaagaagatgtagagagagttcatacagaattgctggctgctggacacatgtatgcttgcattttcatttatacaagcagaaatgcttttaaagggcctcaactaatttcgtcacagtcagtgttacaaaggaaaaaacaaatccccagtgttgatgagaatccaggtcaaggcaaggagaaatcacagagcagtcaaagagaatcctggggctctgggatgttgtgcctgcaagtaccttgatttgagaaaagcaattcatttaaacacagcaaatgtgcttgggagcaagtctgggctgcctgttcctttctgttgctatcggcattgaaaatctgcttcatattttaccttcatccttggtcaccaggcagaactgataaactctatttctagatgtcattgctattaaaaacagaaagggagaaaaaaagcaggcaaagaataaaaaatgccagagaggaacatgcacaagacctaccatttatcaagtcaaaatattttaatggagaaatcaggataagtgattaatctgaagatttttagtttccagtaagttgtaagaaggtctgacaggcaacaggaagctaatatttaaagataatttcaggaacatggaaatgaataagtggtaaaaggagaagactgaagactgaaccttctttttacctccaatgtttattgaaaacactgtgtttcaaacaaaacaaaacagaaatcatatctgattctgcatatgaatgctggtaaatttattctttccaaattatttatccaatatcaactcttgacagagttactatattagagttttgatggtgaccaagagactatcactgtccctgcccccaggaggctcctagtctaattgggaagtcaagagaaataaaaataaaaatccatccaaaatggttttataaggactctgatcaagggggcctcaggatgttattgcagcaaataggagatagatgcaatggcctggaaaatcagggaaagttcccctgcagattgatcccctaaacgttgaagaggtaggggtacatgaagatggaggagccccagccaagacctatgtatgataagatagaatgggtgatgtattgtgtactggtttcttagggctgttgcagcacactacaacaaactgggtggcttaaaacaacagaaactcatttcacacttctggaggccataagtcaagtgggaactgttagcaattccactgagcttgggtgtggaaggacaatggtggaggatttgggaggagttgggggtgctggaggtgttggggatgctgtgctgatcctcccaatctgtggcacttagctcattgaccctactgagtaaataataccttagcaggactactgggaatgtgtcctgtgcaggggctgcccttggtaatctctggtggttgtgggtttttaggatcactctgcctgacaactcagcatctcagtttcctcactgtgagtggcagtcaatcctttcactaccagctaggtcacttttgtaaagtaacttggtacttttgaatacgaacatcatcattcccccaaataagggaatgtatgattttgagctcattattgctctaatataccatgatgatatagttgaaaaaggcactctgattctcttggtaaatgtcaagcagtgcaatagaagagagagaacagggttagaagcaaataaatctggggggaaagcctagctccttcttatggcctagatctccagccatttaataatttataagcctcactctcttcattggggtgttctaatgtctaccttgcagagttattgaaccagctggaaatatcatatgtaacacaccaagtatgatagattgaatgcaacttaattatctgtagaactgaagaacgcatagcctagagaaatttattaaatgtattccccatggatgtatataatggggaactacattttccaactttgtcttaaaactctgataatctgatagcaagtcaaatatggtttctagttcatttgggggttgtgaataattatgatactttggagcttaaaggacagatctacagctttctagacatctgaaattgatgccaattgggaagaaatcagaggaaagttttgaagtcattagtttaattgtttatcttgtggagctttattttctcaagttattttcttctgaatgtgtatttatttgcttattatttgttcctgtagccacagatgctcactgagcggggaagatttgaacagacaatggctttctcccagtgctcatctgcagccaaccatttaccatgccaaaggcctcctctaccacctgagcagcattggccgaagtcccgtggtgagtcacttccttctgcctccaccttcctggctgcttccttctaccttccaggaagcagagtatattctgccaaggcaagaatagacaatgaccaaaaacctatgtatgacaagatagaatggaggatgcatggtgcattgacttcctgggctgctgtaccaaactgccacaactgggtagctttgtgtaatgccagagaaacttatctcacatttctggaggtgtgagtctggaatcagggtgttggcaggatcatgcccactctgatggctctaaggaataatccttctttgtctgttccagcttctggtggttgctagcaatctttagcattcctgggcttgtggcagtgtaactctaatctttgcctctgtcttcacaaggccatcttccctctgtgtccaagttgccctcttctaataaggacattagtcattgtattagggcttattctaattaagtatggcctcatcatagttttatcatacctgcaaagaccctgtttccaagtaaggttacattcacaagtaccagggattagaacttgaatacatcttttggggggacacaattgaccccacaacaaaggcaaacccccagcgtagtagtcattggtaaaaactgggcaaaaaatcatatttcattccatatcctgagtcttcatttttctggtatctcagttattgcataagaaagaaaatgtatatacctattaaatagtgtttggaacgaaatcctctaggtgtttatgttcaactaatacttatattccaaattttattctggcactgccccagggatttttatatctaggctgttttcccaagcctctagtactatacaattgattgaaaaaacactatttgaaaccagaggacttggctcaagataataaagagaaaatggcagccaagtaaccatatgaaaatgctcatttattaactacaaactgtgaacatacctgtctacaaacatgtagagggacatacgtccaaattcagagtccttacctaacctaacaaacttaaaatagagtgaagaagctcacatacgggccaaatcaattaatcatctctacctttagccactttttgaacatctactatgtgacaaaaaggtggcacattcaatgaatatttatttttaaaatggatgaatatataatgtagaatcttatttaaatctcaaaagagatgaacaagtaaactgatttcaatgagatcacccagaggtgtatggcagagtgggaattcagttctgatatgtttttctaccctgcaacatagcctctcttcattacttactgttgaaagcgtgtgttggggagctccatgactatccgcaggctcagtgattccttagaaggactcacaggactcagaatagcagttatattcataattacagtgtattaccttcagaggacacagattaaaatcagaaaaggtaaatggcattcatggcagagtacaggagagacaaggtacaaatttccaggtatccttgcccagtagagatacacagacagtgcttgactctccagcaacaatatgggttgccaaccaggaaacctcacttagctctggtgtccagggtttttgttggggggtcagttatgtagccatcaaatatcctacgtggctgatcttagttactctgtctcccatctctccagaggtcaaattgatatctcatggtcctagagccccaccataagtcacattgttagcatcaaccatctggcatggcccaagtcccaaggtaaagaaagatctgttatccagcagaatattccaagagtgtgaagtttatttcctaggagtcattcaagggacagatcttatttcagagtgtgcaggatttgaaccctctagtcttgctgagtcaatctttttttgcttagagaacaaagtggattcttttctcttaagaatcctcattctgaaagtcctagccagagcaatcaggcaagagaaagaaataaagggcatccaaattggaaaagaggaaatcaaattatttctgtttgctaatgatatgatcatatacctaggaaaccctacagactccctcaatagactcttacatttgataactgaattcagtaaagtctcaggctacaaaatcaatgtacactaatcaatagcactgctgtataccaataacaaccagctgagaataaaatcaagaactccgttttattaacaatagctacaaaaaaaaaatacccaggaatatatttaacaaggaaggtaaaagatcactacaacaagaaccacaaaacactgataaaagaaatcagacatgacaccgacaaatggaaaaatatcccatgctcatggataggaagaatcaatattttgaaaatcaccatatttcccaaagtgatctacagatttaatgcaattcctatcaaaatactaacatcatttttcacagaattagaaaaaacaatcctaaaatttatatggaaccaaaaaatagctgaaaccttagcaaaaagaataatctgaaggcatcacattactggatttcaagttatactaccagtctatatttaccaaatcagcatggcactggtataaaagtaggcacatagaccaatggaacagaatagagaacccagagataaagccagccacctacaattaactaatctttgaccaagtagaaaaaatatatattcagtaaatgacgctgggaaaattggatagccacatgtagaagaatgaacctggatccctgtctctcaccaaatacaaaaattaactcaagatgaattaaagacttaaatctaagatctgagtctgtaaaaattttcaaagaaaacctacgaaaaactcttctggatataggcataggcaaataatttatggtgaagactccaatttatggtgaagacaacagaaacaaaaataaataaatgggacctaattaaactaagtaccttttgcatggcaaaagaaataacagagtaaacagacaacctacagaatgggagaaaatgtttgcaaactatacatctgataaaagactaatatccaaaatctacaagaaactcaaacaaatcagcaagacaaaaaagaaataatgttattaaaatgtggttaaatgacgtgaacagatatttctcaaaagaagttatatgagtgaccaagaaacatgagaaaatgctcaacgtcactaattatcagggatatgtaaattaaaactgcagtgagataccactttacgccagtaagaatggccgtttttaaaagatcaaaaacaacagatgtaggcatggatgcagtcaaaagggaatgcttatacactaccaatgggaatgtatgttagtacaacctctatgaaaaacagtatggtgatttctcaaagaactaaaaggagatctactatttgatccagcaatcccactactgggtatctacccaaaggaataaaaaagttattgtattaaaaatatacctgcacatatatgtttattgcagcataattcataattgcccaaagatatggaatcaacctaagtccccatcaattgatgagtggatgaagaaaatgtggcatatataaatatgcacacagatatgtttgtgtctgtgtatatatatatatatatatatatatatatacacacagagtatatatatgtatatagtgtatatatatataaatacacagtatatatatatatttatacacagatgcacatatacatataccatggaatactactcaaccttaaaaagaatgaattaatattttttgcagcaacttgaatggaactggaggccattatcctatgtgaagtaacccaggaatgaaatatcacatgttctcattaagtgggataagctacgggtatgcaaaggcatacagactggtataatggacacttggagaaacagaagggggttggtgggagtggagtgaaatgaaaaattacctgttgggtacaatgtacactattcaggtgataggtacacttaaaggggactttaccactatagaattcatccacataaccaaaaactactaaagctattgaaattacaaagttaaaacaagaatactggttctacactgctgaaaatgtacaatcttttcattctgaccttctccctcctgcaatcttagaaggcactgtaatctctgcagtctaccctctggaagcaagcacatggcctgcacagcaggtcacaatttgaaaaaagtatgtttctctgagtagaaagctttagcttctaagaggagagacagagagtgggacttaaaaggaagaaatccctatataatacacatttaaacacgcacacattcaatccacaacaaaacagaattcctctctgctctgacaacctctaattgaagagcagaacatttattttaaagcatgacaggtgaaagccttgtttaaaaatataaataaacattaattagctataaacatgacagccacagacatgtttcctgctgggaccatctgagaggtgggtgagaaacagctgagcactaaatgctgttcacagtgttacaaagctctctaatgggctcaacatcaccttttagttacctaggaggctatatttaatgagtctcctgctggcagcagaagcgctgccactcactcagcactcaggcctatcctgtactgggaagatttccactgcgacgagattaactgtgactctgcccaaattctggctcttatgaaaatgttttctgaagcactgggaagccactttatggtggctaggaagatccaccggttctagatactattcagccatttgcttattggtgagtggattaatatgactcccaggaccaaaaagaatgtggtactgtgagaaaaagcagtaccctgagagcgttgagcattgctaaataccagacaagtcattcactttatagtgaatatggcaatattcacatattgtgtaattcctccactcatccatatatctgtccatccactcacctagccatccatcatccattcatccatccaaccacttatccatccacccacccatccacccaatgtaggcagtcattcatttcttcattcacttgcatcatatatgtataattatggtgctacgtgtcagggatacaaagaaaatattttatttaagattgtccttttctggggggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgggtgcacgcaccgggcgcgaaccgaagcagggcgaggcattgcctcacctgggaagcgcaaggggtcagggagttccctctccgagtcaaagaaaggggtgacggacgcacctggaaaatcaggtcactcccacccgaatattgcgcttttcagacctgcttaaaaaacggcgcaccacgagactatatcccacacctggctcggagggtcctacacccacggaatctcgctgattgctagcacagcagtctgagatcaaactgcaaggtggcagcgaggctgggggaggggcgccggccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactacctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagccgatggagctgaaaaccaaggctcgagaactacgtgaagaatgcagaagcctcaggagccgatgcgatcaactggaagaaagggtatcaacgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgcggagaatggaaccaaattggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagagcagccagagagaaaggtcaggttaccctcaaagggaagcccatcagactaacagcggatctctcggcagaaaccctgcaagccagaagagactgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaacgagcaaaatcaccagctaacatcataatgacaggatcaaattcacacataacaatatcaactttaaatgtaaatggactaaattctccaattaaaagacacagactggcaagttggataaagagtcaagacccatcagtgtggtgtattcaggaaacccatctcacgtgcagagacacacataggctgaaaataaaaggatggaggaagatctaccaagccaatggaaaacaaaaaaaggcaggggttgcaatcctagtctctgataaaacagactttaaaccaacaaagatcaaaggagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataataggagactttaacaccccactgtcaacattagacagatcaatgagacagaaagtcaacaaggatacccaggaattgaactcagctctgcaccaagcggacttaatagacatctacagaactctccaccccaaatcaacagaatatacattcttctcagcaccacaccacacctattccaaaattgaccacatagttggaagtaaagttctcctcagcaaatgtaaaagaagacaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactcaatgcccacaagagaaagcaggaaagatccaaaattgacaccctaacatcacaattaaaagaactagagaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagaggagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagtcaaagacaaaaaccacatgattatctcaatagatgcagaaaaagcctttgacaaaattcaacaacccttcatgctaaaaactctcaataaattatgtattgatgggacgtatttcaaaataataagagctatctatgacaaacccacagccaatatcatactgaatgggaaaaactggaagcattccctttgaaaactggcacaagacagggatgccctctctcaccgctcctattcaacatagtgttggaagttctggccagggcaatcaggcaggagaaggaaataaggggtattcaattaggaaaagaggaagtcaaattgtccctgtttgcagacaacatgattgtttatctagaaaaccccatcatctcagcccaaaatctccttaagctgataagcaacttcagcaaagtctcaggatacaaaatcaatgtgcaaaaatcacaagcattgtcatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcatgaaaatggccatactgcccaaggtaatttacagattcaacgccatccccatcaagctaccaatgactttcttcacagaattggaaaaaactactttaaagttcatatggaaccaaaaaagagcccgcatcgccaagtcaatcctaagccaaaagaacaaagctggaggcatcagactacctgacttcaaactatactacaagtctacagtaaccaaaagagcatggtactggtaccaaaacagagatatagatcaatggaacagaacagagccctcagaaataacgccgcttacctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggtgtgggcaaggacttcatgtccaaaacaccaaaagcaatggcaacaaaagccaaaattgacaaatgggatctaattaaactacagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaacccagtcaaaaagtgggcgaaggacatgagcagacacttctcaaaagaagacatttatgcagccaaaaaatacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccattggacccagccatcccattactgggtatatacccaaatgactataaatcatgctgctataaagacacatgcacacgtatgtttattgtggcattattcacaatagcaaagacttggaaccaacccaaatgtccaacaatgatagactggattaagaaaatgtggcacatatacaccatggaatactaggcagccataaaaaatgatgagttcatgtcctttgtagggacatggatgaaattggaaaccatcattctcagtaaactatcgcaagaacaaaaaaccaaacaccgcatattctcactcataggtgggaattgaacaatgagatcacatggtcacaggaaggggaatatcacactctggggactgtggtggggtggggggaggggggaggggtagcattgggagatatacctaatgctagataacgagttagtgggtgcagcgcaccagcatggcacatgtatacatatgtaactaacctgcacaatgtgcacatgtaccctaaaacttaaagtataataaaaaaaaaaaaaaaaaaaaaagattgtccttttctttgaggaacccagattttactttggtagaaagtagagtcaggtctacaaggaaactggagtggtagaaaatagtaagcactgtaacaaaggcccatgtgagctttgataggaacatagatgaagggttgagtcattttctctcagggttatggaaaagccagagattagaagtaccatttgagctggacttgcatgaagaagagtttcccttggattttattctagtaaggctgagaaatattctttcctcaaagaatctgtaggcctatgatctcttgagtcttctgccctgtgaaattgaaagtccaggagttttctgtgcttggggttactacacagggcaaaggaaaagaagcttctcatttgatgggtcgcagagattcatttgatatcacacagaccttcttgtgactccattcccattttctttaacccaggttttctgtctcttttgtttgttagagagtccagatgttagatacagaagcccagacacagcaaagtttggtatatttatgcactggaatattattcagtaactaaaaccaaaactaaaccaaaaaatgaactatgatatagtcaataacgtgggtgaatctcataaacattatattgagtgaaagaagctagacactaaagactacatactctattctctatgtgtctgtttatgtaaagtataagatcagtgaaagtaatttatggggacataaattgaacagtgtttgcctctgaggaagagcattgaatagtaggggtcaggagggaactttataggttagcagagatgttcaatatcatgatcagagtcggttacacaaaaactcattgaactatatattcaggatctgcgtttttcactctaggtacacatttacctaaatgcagaaaattaaaattaaagcaaagtcacagagatttaaaatgcaatgaggagacaaagggggctcccttaaatgaagctgactagcatacaggcatgtgagccaaggaaaacagttttcccaggaaagagcagaaaggttgtagaagaaggtctgtttagaagtcagaaagatccagccagagaggcggcctataagcagagaagcccaaagaagcggacaagctctacaatcagctagcagaaggcattgaaccagtttccctttgtggagctccctctaaaagccaagaggctcatggccaaggaggcagatgaggacagtcggggacatccctgggactggaagaaagttcttaggctactacagcaagctcctggggagccaggtggacagcctcttctgagctgccatattgcagctggcctggcccctgtgctgttcaagtaattggggcttcagaaatgggaatgggatcgattcctatcctcttggctctcactatgtgagtgcattttggtaaagggatttcagtcctctttgaagagcgcatcaatttctgtttataactcacacaaactgagctgccttctgccagaggacagggtgggcatattgtagttttgtctttctctggggcccagtggaatagaatttttagctacttaaatgatttttctggttttattttgtccctctggcatatgttttgggttaatcagcttcttttaaaagaagcacaaaaggagatgaaaaaaaggatggcgtattcctttctataacccttgtcgccaagggcctcaagatattttatacacatgaattgttttatttccactttattccttagcagtagcagaagaataagtgttatttttgcttattttcataactcgtgttaaggtaccacatctagaatttccctttttttacatttgaggatatggtaggaaaagaacaaacactcctgttccatagtcaggaaggacagaatacccataaaggtcctgaattaaaaatatttcagtttgcttccatattcttttatttggaattgttcccatgctatcagaatgaaggttaaacaaggcttctttaccataccagaaaccaagttttgtgtatatttttactgacacaaaaaaactacatttaattgaattgcttcagtttcttgataaattttagtgaaaagcaaagggcattttttctcttgctctcaacagtgtcttcaatgtagtttctgtgtaacacaagagctgaaaatctgggatattcttttttgtttgtttttttgagatggggtctcgatctgtcaccaggctggagtgcagcggtgcaatctcagttcactgcaatttctgcctcccgggttcaagcaattctcctgcctcagcttcctgagtagctgggactgcaggcacgtgccaccacacctggctaatttttgtatttttagtagaaacggggtttcaccatgttggctaggatggtctctatctcttgacctcatgatctgcccgcctcggcctcccaaagtgttgggattacaggcatgagccactgtgcctggtcaaaaatctgggatgttcttagagggagggcaagtcagaattttcaaagaagtctaaacaaatttcttatgttttatttgttgtggaatggaatgaaatgaggagatggaggggaggggaaaataggagggtaaccgcttagaaagcattcctcttcagcctttgtgaaggtccctctgcccagagctagtggaaataggtgaaagcaagaaatacatagagatggggccacagggactaattttgccataaggctgctctccgtgaaggccagaagtgaaaacagaggcttccgatgaagacacggaagagacttgtgcatgtctgaagaaaactaatctggtaaacacagcaaggtagcaatgatcgtggccaagggcattgggcgtagggcttaaagttctcatcgcagacagtgagggttgcccagagcaaagcacagtccatccttgggggccaaggcaatcaacagttctcagttaggaaagcaactcagaaacagaggcaaaagccaagggcaaatctctttacagggactgagtaggcatggtgataggtcagtattcagtccccagcctaccccaagggtttagccagacaatatagaagccttgttataggtcaaaaagactagtctgaatcccacattatggtgaagacagaggtcccaataaccatctgctctgattgggcttggtacaccaaatagattaatgcttctacctcgagaacttcagtacctgcaactgagcgagacagatggcaaaggcctctcaggctgataggttgcagggattgtgtagaaaggtgacatccaggctactgcttctctcccttcaatgtctgaaactggggaaagggaacagatttaactcttgaggaatcttcccaggaactcactgcataagtgccttctcagggcattaggcttaccactcatggagggatggctggccagagatggagagtggaaaaacgcaagaccactcactttcaaatacgcgaattgagagttttgttatattgttcttcatcactcgtccatcaaatgttttaaaatgtcgtgtttggaaaacttttagaaccacactgattagagtttgagatatcacacatcactttctaatgggtccatctgcaagttgcttaacctcctttaactttagaagaaattgaacctcatctctatatttggataacatcctcctttaggacttcttatactgattatagaggagtgtaaaatctcagcatggtgaccgacacatatctggcattcaaataaataatagacgttaaaatcattacttactagaagggcattagatacaaaacaaagccacatattagattgtatgtttttgggttgatttacaggcgctctttcattgtaactgaaatattttggaaagaacattataatacatgctgctgaggtgagatggccaaaaacgtccttcagcataaagggtcccactgtgggcagtctcatgagcagttggttattgatacattctattgagtttaatgtgaaatttttctccccaaagtggccattggaggggtccaagactgatctgtaagtaaaggctgcttttctaaggccatgttgaaactttggcccatgatgacccaatttaagtgaaagtctgagtctctcgctttgggaaaggaaacagagcataaaatccctttcaggtggttttaggaataaattctgcatgtgcctaatgtggttaacctcagctaggactggatgttgctgatgactcagatgaagcacttactaaggagagagtatggctatcaataaaaagactaggaaatgtggtcttgcaaattggcctcttggaaggtagctgaacgtgtcaccaatatcatttccctcaaagagatgttaactccatttaggaacttgggctgaatgccatctgcacaatattgtgcacaagctggaacctccagggctttagttagcctcagttggtttaattggacacattgctgttttgggtttccatcatattctcaaatatatctcctctaggcttcagccttgccttcattttcctgtgacaatggtataaataatgcaaatgtcttgatactgggaagcaggaatgagacccagatgtcagaatggaaagcacagcagtttacattggcaaagcagagcggtaaacacaatcaggaataggtgagccctggggaaaaggggaacggctaagggagaggtgtttgagagggagagggtaacctcttgaacaagggggacctattaacttgcagaggaactagaatgggaccaaggaggaaggagatgaggaaggcatgtgagaagcatggcaatctggtcctcatcagcttctttgcggagcaagaaatcatggaactcatgtttgcatgaactaaattaaccttgcaatttagctcagacaagaatgcattggaaaaggtcctaggaagatgcataatccaatccataccttcctgatgaagaaactgaggcacagagaggggaattggtttagtcaaaggcccaaagttcaaaactaaacactccagctcaaaggaaactagatgaaactacacaaagtcttcaattctgcatttcttcctatgttccttgcctttgcggaaaggcacaatcattgcctgtttacttaatctggaaatcaaggagttattcctaacctcttcctttcttagcctctaaatccattgtctctaactcctgtagattttacttctttactctcacaaaacttcttttctttatatacttatatctggtgccttaagctaggcccttctcatctcacttgcctagtctcagtccctcccatcttaacacttctgttcttcgttctaatgatctgatcatcttgctccttcttgcttagtttaaaggctccttcaccaccttcaagaaaatgtctcaacattctagaatgatgtacaagtgcattaacgatctgaccactgcccacttctatagatacctaatttattctcctttcactctaccctcttattccaaattattgttaatacctcaaatctacagatccttcttgctgttttgtcatttgcttggatagctctcactcagtaaggttcatcttatgtataacctcccttgagaatcccagaagcaccacatagcacacttccaaggtgctgctcccttggagtgcaatgtgaatgctgccccctggaagtgtgcaactgttcttattgggttcccagagaacgctgcttatctctacttcagctcttctcttatggtaatacaatgacctcttggcttgtggtataatatcaacaaatcagcttctggatggggtaatatagaaatgaaaagtgttttaaaacattgtctctgggttagggcaaactggggctccaatatttattcacacaataacaatacaaacttgggcaagttacttattttatctggaatttagtgttctcggccacaaaatgagcataataatagcacctacttcaccatgggataatctagattaaatttttagcatgctatctagagtcttcaataaattaactattgttgctattattattgttacggagagcagtgctgtgttatattaaaattttaacttctcctattacgtagcagttacccagtaaatatttgttgaatcaattgataaacaacaagatagggctattgaggtggggagcggtggctcacacctgtaatcctagcactttgggaggacaaggcaggcagattgcctgagctcaggagtttgagaccagcctgagcaacatggcaaaatgctgtctctactaaaaacacaaaaagttagctgagcgtggtggcaggcacctgcagtcctggctactcggaaggctgagccacgagaattgcttgaacctgggacatggaggttgcagtgagctgagattgggccattgcactccagtctgagtgagactctgtcttaaaaaaaaatagggctattgattaacctgtaaatattgtattgggaacagtttctgcttacctgttaaagaattgtactgaaaagaagtataagtattaaatcttatggtagaaaagaaaaagcttccttaacttaaataattggataattgccttgtaattgcaccctgcaatttgaagaaacacatgtttcttagaattaacaggcatttgttttcagggatatcgtttgagaaacaagcagaacaatgtctccttctccttcactctgaatcttctgtggctactagaactcaccatgtttattcctgcaggtgaatggctctataatttgtcgtttacttcctttttcagagtctgtaaggatcagggaaggaagaaaagctattttctccagttgaatttagtatttaaggagtgcctatcaccaaggaggcatagcttctggctttattgagaaatctgttgctaagacacagttttaatttgtttgcacacttttcataagaatggtgagtgtttattcacagagagaaactaagatgtaagaggtaaaagttggtggaaaattagtgatagtagaggattaaacctcaaacaattattttatttgttcctttagactagaggctttgaaagtaaggtcctggggctggggcatgagcatcacccggaaacttgccagaaatgcaaattcttgggctcaacccagacctacttgaatcacagaattgccagggtgtggctcagcagtctgctttaacaagacctccaggttattctgatgcttattaatatttgagacccatcctgggcaacagagggatatcctgtctctacaaaagtattttaaaaattagccacgtatggtgtcgcttgcctgtagtcctagctactttggaggctgaggcaggaagataacctgagcccaggatctcgaaggttgcagtgagccatgattgcaccactgcattctcagcctgggtgaaagagtgagactatgtctcaaaaaaaaaaaaaaaaaaaaaaaagagagagagagagagagacccactgctctaaagtctagaataggacatcatgcaaatcatgcaagcctcacgtattagtagcaatagtaactgaggagactagctttcccctgctggaaaattctgtaataacatcacctggaacagatgcctctagagactgagccaatttttttcaagacccacaacaactacctcatgttgcctcctgatctcctaactagaatcaaatatcagcatgatcctagaagataagtacatgctgttacccaaaaagaaatagcttgcacacaaaagaattacaagatttgataatatatatcattagaaacgtgggcaacatgtgtgggagtattctaataagggcagaaattcactagatttggctgacttcattgacatgagtatacaatctagaggttctaaatttaatgtgttagcttgcgcagctggaagtggatctaacagcttaattgggtggttgaatgaatgttgtgctcaacaatagtctacatttagtaaggtcaagattccagagctttgctggcataatgtaggggagagtatgcaaagtctctaggagatagaaatgtatactgagtttatcctgtttatgagagggctcagaagacactccctccatgaagcaatgagaaatacagtagtgtcttcatccttgacaaactctgtagttgttctcctttgaaggccaggtttgtaggggatgccaccattgagatttttttttttttttttttttttttttgagacagagttttgttctttttgaccaggctggagtgcaatggcacgatctcggctcactgcaacctccacctcccaggttcaagcaattctcctgcctcagcctcctaagtagctgggattacaggcgcatgccaccatgcctggccaattttttgtatttttagtagagacagggtttcaccatgttggccaggctggtctcgaactcctgacctcaggtgatctacctggctcggcctcccaaagtgctgggatttccaggagtgagccactgcgcctggcgagatggggtctttgattttatggagattatgcaatcctagagtacagaggccaagtggtagcacttaaccaccaaagacaggagggatacatcaaccatcgtatctcgctttatcccagataattcttcttgttctgatgtctactttatctgataattaatatagctactctagcattcttttgttttgtatttgcatactatattttacatccttttactttcaacctatctgtgtctttttatttaaaatgaacttcgtgtaggcagaatatatttgatctttcttatttatccaaactgatactctttaccttttaattagtgtgttttgaccatttacaataagtaagattattgatatgtttgggttgaaatctaccattttgctgttttctattttttcatgtgttcttagagcttcctatcttttctgctttctcttttattcattgagcatttttatgatcccaatttatctccacatttgaattattattcatgccccttaaaagtaatttagtgtttgccctattgtttacaatatctatctttaattaattagagtctaccttgagataacatactgcttcctctctactacaaggaccttatgacagtatataaccgtttattttctcacattttataatacgattgtgatacatttacttttacatatgctataaacatgcagtatattgctactatttttctttagactgtcagttgtgttttagagaaattaaagtcaagaaaaaaagaaaaatatattcttttactgtcgtgtgtttcatttccattcttttaatgttttgattcaaagagactgtgactttttcagaccaaaatgatctttggaccccaaacttctacatcaggaactggagaagttagaggctttgccttaaagtaggcaatattgttcaatgcccttttcatgcatggccaagaaagatacaggaaaaataagtacctcacaaggaaagagtaaatatctgtagaaaaaataatactggacaactaatgacagggagcagaaccagggtctaatcaaccaactggccctacccaaaggatacaggcatctcacaatgcctggatgaaagcattacagaattgttatgaaccagcaactgctatatccatcttattcatctcctttgaaacatgagtgttactggggatattatttcctcattcaaccattgtaggtagatgaacagaaaacaggtggcttgcctttttcttcatagataaggagaaggcatacacaggatatagaaactataatggaattttgggctgagactgatactgtaatggaatgggctctttaagtgtattttccttggagaataggtgagtgtattttgtatgtggaagggagggaaacaaatatttagactaggaggagagattattctaacacttagcttttgttgtataataaaccacagcaaaacttagtggcttaaacaaaagctatgcattatgattcctctgctctgacccaggttggctaggactggatggtctaagttagattcattcacatacctggtggttggcttgatatcagctaggtcaatcgggatgactttgcagagagtctcatcatccagcagcccagcctatgtttactcacgtgatggttgttgcaaggttcctgggaacagcaagacagcaaaccccttaatatgcctcagcttgcatcatatttgctcagtcttattgaccaaaagatgctacatagctgtattagtctgttcttatgctgctaataaagacatacgtgagactaggtaatttgtaaaggaaagaggtttaattggctcacagttccacatggctggggaggcctcacgatcatggtggagggcaaatgaggggcaaagtcacatcttacatggcagcaggcaagagaaggaatacaggggaattcccctttataaaaccatcaggtctcatgacacttattcgctatcaggagaacagcatggcaaagacctacccccatgatttaattgcttccacctggacccacccttgacatgtggagattattacaattcaaggtgagatttgggtgggaacacagccaaaccatatcaatggctaagtgcatattccagaggtgaagaaatgtactctacctattgatgaagatgaaacatagtctactgcaaagggtcatgcatacaagaatagaaaaaaagttgtggtcttttttagattttattatttttctccattattagcatctctccttataataagattttgcatcactgcccttgtcatatgatttgcagaacctccctttaggaggaacgtacttacctacaccactgataaaattggttatgtgactttctttgaccagtggactttgagcagatatgacgtttgccacgcttcagtagaagctttaatggccattacctgattctacctttgacagtttttcccctctaccacaagagtagcatgtttcaaattagggcttctttagcctggatcctagaatgaagaaaacatgcagagcagagtcatagccgatctctagtatgaatgaaaaataatcctttgtttgataagccattgtgttttgatggtcattcttttccacattggagcctagagaaaaattagagtgattgattagcttctgtttttgtatatttcaccaattcccttttgaaggatctttcctattgacttttattttaattttttttaaccttcaagttcaggggtacaagtacagatttgttgcacaggtaaacttgtgtcatggagctttgttgtacagactgtttcctcaccccggtattaagcctagtacccattagttatttttccttatcctctcccttctcccactctccacactctgaaatgccccagcgtgtgtgtttttctcctctgtgtgtccatgtgttctcatcaaattgtttaaaatactcatagatatcttaaaatgcccttgttcctattttcttttccagctttgcccattcctcctacccagtcacaagtaaatttatcaaaagagctatacatgacttgcgtttcttcgtattctattcactcctaagacccttaaagtctacattctcctctgataactccatcgatacaatcaatgccactcttgccaaagacaccagtgatccgcacatggctggtctgctaactcaacagcatccgagaaagttgacattgtaaactttctttgagccatggaacatgagtagatacgatttaagtggatttaagaaaccaatgacctgacctggttttattttctcctttgttgggctattgtaggttttctgtgacttccatggccactcccaaaagaagaatgtgttcctttatggctgtagcatcaaggaaaccttgtggcaagcagcatgcactgtgggcacatctactatcctagaggaggtcaactacagggtaagccgctgtggggaatgacatcagacatgctgtgttcatattcttcattcttacctttaagaccatgccccactcatttatttagtttttttttttttttgtaaataagcattttaattattctaaccataggattgtaatacaagcaggctggaagcatgtgtaacctctcctaatttttgttgaataatgacttactgacttgttgctttgcccctgttttctatgtggtttgatattgtataaaaggcatgagaactagagacagaagacctcatcttaatacctggctttacaattattcgattattaactgtgtgattatgaggtcattaacattacctctctgaaccacccttctgccatctgtaaaatgaggatagtaaaaatactgcctctgttacatagcttatggaaggaacacaatgatactgaatacaaaaggacttcaaataaataggaagggatgaataaacataagccattaaaccatctacatctctctgcatgagaattctataaaaagcagatcagtaatccactgaccctaattctattttactttagttttagtggttagagctcaactgttcctccatgaaaccacataggaaattagggaggggtaaagaagggagtacttcttcccatcaggataaaggcaacaagctattgcataatgagaatcaggaagaagcaaagttgcccaaacactaaatgaaaactggtctttgtttaaaatttctgtagaaaaagtagaaaattatgatggtgtctgcctctactgttattctgggtatgcaatttactatgtgcaaaatagcttcatccccagggttaatgatagtattaagaggtaaaaatccaccaagtcaccatttcacctggaaatacatcccctcttctctagccttcttcactcagtccatcaaaaatagactgccgctgatcaatacaaccaccccaaggcttttatagcagaatcaacagcttatcctcaataacctgtttgctgtaaggctcaaccagagtaatggtgataaaccataagaagcttaataacttaatcttatttaggaaactagtttagtaaattaaagcattcatctgggcagctcctgtggacccaacccatataaaatgatctcttatatgtgatacatcttgaatcaaaaaaatctaccatggtccaatcttaaatatagagtcagcatgttttttacttctctttttccaagggaaggtaataatattaatagataattccctatacacaggaaaaggtataagacacagaacctttaaaaagtctcctgtacgaagctgacatgaaatggggcagaggtcagacattgtagggaatgataggatgggttcttatcaactgtattttaatttttgtgaataattcatactgtttaattaataaattcaaaacacattttgaggcccagattagtgtcagttaaggtaaaaggcataacattatagagacaggtatgccagtttctgcctatgagaataaggacagtggtatttaatagcaatgctgttaaaaagattaatccatctagacattaatgctcacctataaggttctttaactgtgagtgggtcagttgtctgagcctcacttttctcccttgtgaaattaggaagttaaattttctacatagtttattacatcaagtttgttggtgccctgggattccttaaaggtgattcatgggctactatgacatatgtggaggtagtgaagtgaatatggtttggtcacatccctggctttcaacccaaacagctttgctttttggggtcccacatagtatataactccctctatcactgacactctaaattaggacataatgatctgtaaataattatcttaacactggtgatctgcctaaaaagacttttgtgtatacaaatggatcttgtcagaattgaaaggacccactcattttacagatgggaaaattgagactcaggggagaatgtcttggtaagataggttaatgttatcatcatgatatctaccagcagtcaagagtctgttgatgcttagaggctgattccttcattaccatcaaaagtggaacaattctaaacatgttaaacttatctaagactttatttggtcatttaccattagtattgaagagacgattatacaccctgttatatttcacatccactctgcaacatttattcagttttattaatcaactttaatggtactacttctagttatgttggtataaagaggtcagtgaatcctctctgcaaaacgcagtataaaatagaagaaaattttgaaaagcagcccttttaggactctgtaaattgaccaaatacagatgataaattgagaagcatttattcttgaaaattgctggaacttcatgtaagaacagcaggggtctgtaaccttcttgactggggctgctcctgacaccactctatgtggtcatcaagaaatgcagttttaccaacagaaggatagccacacacacacacatgcacgcacacacacacacacacacacacacacacacacagccagaaatttacaagggagaccttagaaatgagagagccacagaaaagctaagataggctctctataaatacatggtgtattaagccattcttgcattgctgagactggataaattataaagaaaagaggtttaattggctcatggttatgcaggctgttcgggaagcataatgttggcatctgcttctggggaggcctcagaaagcttccaatcgtggtagaaggtgaagggggagcaggcacttcacatggtgagaacagagccaggaaaagagtcagggggaggtgtcacacacttttaaactactagatctcatgagaattcactcattattgcaacgacagcaccaagaagatgatgcaaaaccattcatgggaaatccactcctgtaatccagtcacctcctaccaggccccacctctaacactgggagttacatttcatcatgagattttggtggggacatgtatctaaactatatcgtatggattatggaaaaatatatgtctctagaggagacccaagagggcccagtgagaaagaaagtccaaagagacttaagaactgccacaattttgaatgtcttcccaaatcacatacaaatcaatcaacagagagtggaagtcttatgcactcaagatatttgagcactacatttgcccaaattattgtataaccactaggccaagcagccacagatgtcaagctaaataatttaaataagaatgtagaaactgtgtagagacatcagtggcacacattgcagaagaaaaaagaaagaaatattctgcagattaatccaggaaagtagttaaaaatttaaaaacatttaaaaaatagaatccagagatgctaaaaaaaaagtataatctatgatgtccagtttgcaaccaaaaactacaattttgtgaagaatcaagaatgtgaaatccacgctcaggaaacaaagcagtcagtagaaacaagagtgggccaacatgttggattcataattatttccaagcaactgttaaaatatgttcaaataattaaagaaaattatgttcaaaagttaatggcaaaatatgatgaccattactcaatatatatggaaatttgatggataattagaacagaaagaaggaaggaaggaaggtaggaaagaggacaggagaggaggggaggggaagggtggggaggggagtggagggagggagggagggaggaaggaaggaaggaaggaaggagatagtgttgatgagtatcataaccaacatgaaaaattcactaggtgggattgtcagcagatttgagatggcaagatagtagagaatgaatcagtaatttgatgattaaccccaaattattcaattcaaagaacagagaaaacaagattaaagaaaagtaaacagctgtagagacctataggatagcataaagcatatcaaccaacatgtaatgggaggcccaaaaagagaggaaaataaatgtctgaaaaaatatttgaagatataatgagagaagaagatagtataggaggaacaaaacatatatgagacatatagaatcaaacaacaaaatggcaaatgtaaatccaaaaatatcaatgatgtcattaaatatgaacgaacaaaccctcattccaaaggcagaggttgtaagaccagatttaaaaaataggttcaagtatatattgtctataaatgacatgcttttgattcaataatgcaaacagcttaaaagttaaaagatgggaaaagatacaccatgcaaatggtaaccataataaagatggttatattgacataagacaaaatatacattaaaaggagaaatattactagagctaagggtgcaattcataatactgaaacaaattgttaatcagcaaggtgtaacaattataaatgtatgtgaatatatatactctgacatacaagaagaaaaagttgaaagaaggcatttaaaatttaataataatagctgaatattttagtagtcttctctcagtatgtgatagaataaccaaaaagaaaattagtatggagaacacctgacttaacttacatatagcagttcttttcaaaacaaaagaatgtatattctttttgagtgcacatcaaaatttctccagcatagatcttataataggctattaaataaatatcaatatatcttaagggactgaaaccatgcacagaatattcacctactcaagagaattaaattataaattaactttcataagaaatctgggatatctctgattatttggaaattaaacaatttgtatcaaattaacttatggatcaaagaggaaatccaatgggtaattagaaaatatctttaagtgaataaaaattaaaactcaatatgtgaaaatttatagtatgcagcaaaaatagtacacagaaggaactttgtaatttataatatttagaaatgcagaaagatctaaaatcaagaatctaagcatccacattcagaaacaagaaaaataagtgcaaataaatcccaaagtataagaaagaacaaaataaaagccaaagttagatcaatgaaataaaaatcatatgaacaatagagaatccataaagaacatgcttttcattcaataattcataatttgatttcttaaaacggtcaacaaaatgatcattatttagctagacaaagaaaagaaagaagatacaagttaccaaaattgggattgaaagaaggggcatcactacagatcttacaaagtaaaaatgaatatcattaacaactttatgccaacaagtgaatacattcttaggagaacacagactaccaaaactgactcaaggacacatggacaatctgatgaggtttattttaagtggaaagaagaattagtaattaaaactcttcccacaaatggaagtctaggcccaaatggctttgttgatacattctatcaaactcttaagaacaaaatagtgctaattataaaaacatcctttcagaaaatagaggagaaacacttgccaactcattttatgaggtctgtgttatcctgataccaaagccaaaatgagggcatcacaagaaaagacagctacagcccaatatttgttataaacagacaatagtattattcagtgctgaaaaggaatgagctatcaagccatgaagagacacggaagaaccttaaatggatattactaagttaaagaaaacaacctgaaaaggctacatactgtatttccagctgtatgacattctggagaaagcaaaaccatggagactaaaaagatcggggttgccaggagtttggaaggaaggaaggaaaaataggtggaacacaggggattcttagggcagtaaaactactttggataatactgtaatattgagtacacatcattatacattttttcaaacccataagatgtacaacaccaaaagtgaagagaatcctcatgtaaactatagactttgagtgatgatgtttctatgtaggttcagcagttacaacaaacctaccactctggtgagggatgtcaatgttgagggagtccatgcatgtacaggagtggggggcatatgggaaatccctgcatcttccttctcagtttcgctgtggacctaaaactgctttaaataaagcctttttattttttttaaaaaagagagagatagaacctatggaagaaaaaaatggtttcacttaagtaaaaaaggaaaagtcacttaaacaatgtaagagtaaacttttgcgacatggtatgccaatgttaagttaaagctatttgccagtattattgatcactttagttgcaggatatggaaacaatatatttatgtctatttgaccagccccccaggggtctggactagcagattctatttattttagcaaataattatgtagtaacctctatgagcaacatactgctcgatgtgtagggattttcctgtgaataagacacagacctgccctcatggaacttctaggcttctggggagatagaaaacaaacaactaatacatacacaataattcagttgtaattgtaatgagcactttgaaggaacaaatagatggagggattataggaagggagggacaagagtggataagatgaaatcagttaggaggcaattgtagacactcaagtgaagataacattagcattctatttcccttttttagatgattgtaagtctggaggctatgtaggaatttagagatcatagtgaattatattaattatgctaatatatttatataatatgtaatttataagatgattaataattataattaacagttacatttaacatgaggacagtaagtaccagagagagtaagagatttgctcaatgttctagaaattaacaaaactgcatctctttaaaaacaattctttcatttgtattctcattaacttgttatgcttctctactttctccctgtaatttgtctaaaagcctaaggcttcactattgtctaatgtatgtaattttatactatgtgttatttatgcatattctgccaacactaaaatgagagaatccttcttgttaatgtcataaaagttctgggactaatcgcagtatttctgctgactcagaactgtgtatactatcaactctgagtcattgtcctctggggaggaggtctagtggctggaagatccctttctgtcaatcagggtgtcaagtgtctagagatgccttctaaatggagattaagtagtcataaataaaatatttttaccccaagaaaaggtggaacatatgaacccagagaggatggattttcaggagtttcatattgatcaagcctcagatttttggcttagaagatgagacgaaaaagatcattctggcaattatatactcttaggaaagaagtgaactatatgtgcttcttctctagaatcatcactggcccctttggccttgtgaaataagtgaacagtccctagtctgaccctgctaagtaacagtgaggctggatgtagtctgtaaatttcaagtccctttgaaatctgaggatttccgtagtctcaactctttcatgtatgaggccaaatgtatgtgtgcagccttggtccatagcaatacaggaattgaaagattatggagttggccaggttggcatttggattcctttctagcaactttatggttttctggacttcagctatttatttctaacttttttttttttgatatgctgtctcactctgtctcccaggctggagtgcagtggcgcaatctcagcacactgcaacctccatcatctgggttcaagagattctcctacctcagcctcctgagtagctgggattacaggtgcctgccaccacatccagctaatttttgtatttttagtaagacggggtttcaccatgacggctaggctggttttgaactcccgccctcaggtgatccacctgcctcaacctcccaaagtgctgagattacaggcatgagccaccgctcctggcctatttctaccttttctaagcctgtttcctcatctgcaaaatgatttttaaaaagtgatagccatttcttagggttaataaatgatttaaagtaacgagtattttatatatagatgcttaacaatgttgagaagctatttttatgatgactatccctagtcacccacaactaatcatcgtttgatttttgtttttactgtagactcttcccaaaatccttgataagctagcaccagcattcacaatgagcagctgcagctttctcgtggagaaatctcgagcttccacggcccgggtggtggtgtggagagagatgggggtgtccagaagctacaccatggaaagcagctactgtggctgcaaccagggcccttatcaggtatgtgaggctgcaggacacccatactttctgtccagcaacaatacatagaaattatagacagctcgtacctgctttctcacctaaaaggggaagaaggctccaagtagagtttggtcctcccttgccttgaaaaacgggttcaacaattgctttcacctgcaggatcatctatcttgatcctggaagcaatgcgtgcatgctttccaatttggttcctcaatcagctgccctcactagcaagcagctgggagcctctctttgacatgcatccccaacttttacagaacctctgcttgcctggctctgttgttatatgcataaaattcttgccttctgcaacaagtggactagttctatgtacatcataaagggcataggtcagtgtgtagatattgttggtacatatatctattgtgtttccatcttctgcgtcaatctaaatctgtagttctctttgttatcctgctgtctccagagcacacaaaagtgtgtgcatggcgtgggtctcccagaatgagtgggttttggactcatatgctagtgttgagagaaagtgctcttgtataaatcacattctttctacagctatattaactgcatgagcagctggatagctgctacagcaggctgttctggctgcttttcccactcccccatagagaagcataaataaaggacattttgacagtgccagggtaatagactcttgtaaatttcttaggcaagctgacagactgctcctcggtgacttccattcaaccctaagaatacctggacctccccagcattaagctcattgtgttggctttgatagtctcctggaacagctaggaagcacttggcatctatgcaatcctgagcttgtagaaatctgttagttaccaaagagagtacagggtgtgacaggcaatgcacattatctaacttctcatgtagtcgaagattttttttaactcagagctaccgaaccacccttttgactattaattctgtcaaatagccacttagtctaaagacttgtttcaaataattgttttgttactgaattaataaattcttagactgaattaatcctattcacccacattaatgtaaaagaagaataagaagagctgaaatcattggatgagtctgagattgggcatcaagagatctcactctttcacttaccagcagtgttgaaagctacttacttctaggaacctattttttttcatatgtcaaatgcagattttaataaggactccttttatcctaccgtacaaggttttgtagggactaaaagaaaacatatatgtgaatatacttggaggttatataatcagaaatctgttcactcccttgtcattcaaaacgtataagattggaaaaaaaaagctttaaatattgtgactttaaggccttatggacataggtttgtgtctctctctgtacatgtgtcttgatgggaaggggcttgtcatttgtttaaaagacaactccatgtaactcttcaaagatttattagcttgtgactgtcattgagtttgtttctccaagcaccaattcaaacaaacagcttctagtcacgtaagtatcagtgccattcacaataaatcagctggaaactcaaagttctctggagctgtttgaaaatgaaatgactcataggttcaggccctcaccaactctctactgtgcagtgtacacagaggctgttggagaggacaaagaatgaaagggctcacccagtggatggccttcaggtattggagcagcatttatcttgtgaaattttccaaatggcttttgcattgggtcactagaaggaataatggagggagaactggctagagaaagccctaacagtgccagacctggttttggtttaagaatcccattctctatatgaaaaacacttctccgaatgtattagtttcctccttctctttgttttcctgtccttacaaacattgttgagtaactgagcagaatcacaggcagtgatactcacagaggatggtgagtaattttacatatgggggggcccaccccatgggaaggaagccagcctggagttgggtgttttggtgatttttgcgtaaggtacataatgcagtctatgagctacaaagcagtatagaaatttccatcctgaacatattgcaaatgctttttgtacattgggaagctgagtcccagttgagtcttgagattattattctaaggtcatctttccattttttgtttagcattaccatttatccaaaagatggaggatacttaaatacacccgtgagaggcattctttccttccttcataagaatgtaaatatttttgcagtttctctggttaatgcagctttaaagtagttccaatcatttctcccccagcacactaagtacctgatttgtaagtattgaaatgaaatatcattctttacagtgacatttatattggaactgcattaaagaacataagctattaccttaaaataatgattattaatacgatatttcctcttctattttccagtctatagttggctaattagaaaaagaattatcctgctcttgtttctttgggatacagtctctgttgctaggtcatacacttagatctataacttgtatttaatgtggaaatcccacccactgagagatttactttacctattagggatgggcccaaagctattgaggctgttgaggaaaaagccaaaatgaaatgatgcatcctttgggggctcatttttttagaggcatcccgtccatgtggacagctgtgggcttcacactgagtgtttgtgacctgaggtcacacacgtggtgtgtttgcatacacaaaggcatgtggctgggccccaggggttgctggtagcttaggaggaggatgtgagtccctttacccaagcaggctgtcagcttgctccttgcaacactgctaacttggacagcaaagtggatcttaaagaaggacagaagatggtaactcagctgaggtttgaagagtgactcaacttgtgtttaaattctctacctgcgagctgcatccttgtattgtgggaccttcctgcagtgcatcctttctaccacccacaagggctcctttaataacacaaatctattcaagtcacagtaatgcccataagtgtcttcattgtgtctcgataaaatccacctcatcatcgtggtgagtaaggccttttacaatctcttctttcttttttttatactcaatgcttagtatagtataaagtaggtattaaaaatgtatgatggctgacaagtgagtaagtaagtgaacaagtaaataaatggcaatttccaagccctcaaatgatgatcctcactgtccttgggtaagtagaaaaagagaagaaattattgtggtccaaatgtgatcagatgccattctgaaatggagatattaagagtcgttgcaatgggtagagctggaaaatgtgtgggtgaaagaaggaaagacacaagaatgcagggctgagatctcttagacctgccactagatatggtttgagagacaataatccacccaatggattatttcccagagtaaggcaattctagttcaggtatggaatctcttatggacacattctaataacagatgataattaggcagaaagacttccatccatatacgtagtagatgctgcggtccaccctcgagatccctccttaggacccaggcactcaatttcccctggttgttcacagctgtgtctataaccaggaattgcttgtaactaaaggaccccatcttgccccaaagctatggctcctccctacctgcagcctacatccaatagctgatctgtgggaaaacaaaagccttatctctgcttcagttgggatgactccaaagggccattccagctctagatatccctataggattagctggcacctctgttgtaattcccttgtggttcaacctccccctctgcccaactttgtttccctagtaactcacaggtattgttacagcaagcactccccagaagtccttctgtatgcaaatctcagcatctcagaggctgtttcctgctgtaaacaacttataacagtatttcaaaaaggcttagattataaaacatgcatgctggaactaagcacttaaattgttggagatggtttagtggggatgagtttcatataggaaattcaatcatcggaactccgtgttcagggctcccagtggccctttattcactccacttgccttagctgtttagggaacaaagccctctactacaaaactagagaccgcagatcagagcagggtttcttgcagtagcccagactgtaggctgactgtatttattttctgtggctgctgtaacagaataccacaacttggatggcttaaaacaacataaatctgttctctcacagatctggaagataaaagcctgaaatcaaggtgttggcagtgttatgttctctctaaaggcaactgtttcgtgcctttctttgagcttcttgtattgccagaaatccttggtgttttttggtttgtcaacgcatcactacaatttcttcctttcttgtcacatggccttctctacctgtgaacctctatctctgtgtctcccctcttcttcttataaggacaccagacatactggaataagagcccaccttactccaggatgacctcatcttaacttaattaattatatctgtagtgaacctatttccaaataagctcatattctgacattctgataaggagataaatttgggcattgggcaagatactattcaagctaataaactgggtcacacaagaaaacacaaaattatctccaagaattagggaaggtttttatttctgtctccatattgccatgtggtaaagccctaaatatgttataacagttcttattttctctccacctcatgatgaggaaaatgaaaagtttcagattttcttggaacatcttggaagacaaatttgagactcatggcatgtatgagtgctgattaaggctgctccagtattataatacacaatgttaaggtagcaataatgataacaaacacatctatcatacttattgtgtgctaagccctttacatatcttaaattacttcatgtctgctattgtacaacaaagcactacaaaatcagtttcattattattctcattattcctattttacaaatgagaccactgagacagagaagttaagtaacttgctcaaggtcccacagctagaagttttctgagccaggatttgaagccagacagatatgttgctgggatctttgcttttacctcgtgctttctgtctagtagaatgtggttggtaaaaggggacctgggctttggaagcaggagacccaccttctgcacttggctgtaattaagcagatctgcagcaacaggtgagccacttaacctctctgggtcacaattttcttatttataataggaagacagaattggaactaaaagataggtgtggtttctgctacattatgttgaccaagttttttgctgggtatccaagggacttatggatcacccagaccagggtgacccagtgtaatgtgaagcccttaaaaattttatgcaatttttcttttttttcttgtacttttttttttatatactttaagttctagggtacatgtgcacaacaggcaggtttgttacatatgtatacatgtgccatgttggtgtgctacacccattaactcgtcatttacaatagggatatctcctaatgctatccctcccccctccccacccccgcaacagtccccggtgtgtgatgttccccttcctgtgtccaagtgttctcattgttcaattcccatctatgagtgagaacttgtggtgtttggttttttgtccctgcaacagttggctgagaatgatggtttccagcttcatccatgtccctacaaaggacatgaactcatccttttttatagctgcatagtattccttggtgtatatgtgccacattttcttaatccagtctatcattgatggacatttgggttggttctaactctttgctattgtgaatagtgccacaataaacacacatgtgcatctgtctttatagcagcaggatttataatcctttggttatatacccagtaatgggatggctgagtcaaatggcatttctagttctagatccttgaggaatcgccacactgtcttccacaatggttgaaccagtttacagtcccaccaacagtgtaaaacagttcctatttctccacatcctctccagcacctgttgtttcctgactttttaatgatcgccattctaactggtgtgagatggtatgtcattgtggttttgatttgcatttctctgatggccagtgatgatgagcattttttcatgtgtctgttggcggcataaatgtcttcttttgagaagtgtctgttcatatcatttgcccactttttgatgtggttgtttttttcttgtaaatttgtttgagttctttgtagattctgaatattagccctttgtcagatgagtagattgcaaacattttttcccattctgtaggttgcctgttcactctgatggtagtttcttttgctgtgcagaagctctttagtttaattagatcccatttgtcaattttggcttttgttgccattgcttttggtgttttagacaggaagtccttgcccacgcctatgtcctgaatggtattgcctaggtcctgaatggtatcacctaggttttcttctagggtttttatggctttaggtctaacatttaagtctttaatccatcttgaatgaatttttatataaggtgtaaggaagggatccagtttcagctttctacgtctggctagccagttttcccagcaccatttattaaatagggaatcttttccccattgcttttgttgggtttgtcaaagatcagatggttgtagatgagtggtgttatttcggaggcctctgtgctgttccattggtctatatatcttttttggtaccagtaccatgctgtttttgttactgtagccttgtagtatagtttgaagtcaggtagtgtgatgcctccagcttcgttcttttggcttaggattgtcttggcaatgcgggctcttttttggtgctatatgaactttaaagtagtgttttccaattctgtgaagaaagtcattggtagcttgatggggatgacattgaatctataagttaccttgggcaatatggccattttcatgacattgattcttcctatccatgagcatggaatgttcttccatttgtttgtatcctcttttatttcattgagcagtggtttgtagttctccttgaagaggtccttcacatcccttgtaaattggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcaggttaaggagattttgggctgaaacgatggggttttctaaatatacaattatgtcatctgcaaacagggacaatttgacttccttttttcctaatggaataccctttatttctttctcctgcctgattgccctggtcagaacttccaacactatgttgaataggaggcatccctgtcttgtgccagttttcaaagggaatgcttccagttttcacccattcagtatgatattggctgtgggtttgtcataaatagctcttattattttgagatatgtcccatcaatacctaatttcttgagagtttttagcatgaagggctgttgaattttgccaaaggccttttctgcatctattgagataatcctgtggtttttgtctttgcttctgtttatatgctggattatgtttattgatttgcatatgttggaccagccatgcatcccagggatgaagcccacttgatcatggtggataagctttttgatgtgctgctggatttgctttgccagtattttattgaggatttttgcatcaatgttcatcagggatattggtctaaaattctctttttttgttgtgtctgtgccaggctttggtagcaggatgatgctggcctcataaaatgagttagggaggattccctctttttctattgattggaatagtttcagaaggaatggtaccagctcctccttgtacctctggtagaatttggctgtgaatccgtctggtcctggactttttttggtggataggctattaattattgcctcaatttcagagcctgttattggtctattcagggaatcaacttcttcctggtttagtcttgggagggtgcatgtgtccaggagtttatccatgtcttctagattttctagtttatttgtgtagagttgtttgtagtattctctgatggtagtttgtatttctgtgggatcggtggtgatatcccctttatcattttttattgcgtttatttgattcttctctctttttttctttattagtcttgctagcagtctatcaattttgttgatcttttccaaaaaccagctcctggattcactgattttttgaagggttttttgtgtctctatctccttcagttctactctgatcttagttatttcttgccttctgctagcttttgaatgtgtttgctcttgcttctctagttctttcaattgtgatgttagggtgtcagttttagatctttcctgctttctcttgtgggcattgagtgctataaatttccctctacacactgctttaaatgtgtcccagagattctggtatgttgtgtgtttgttctcattggtttcaaagaacatctttatttctgccttcatttcgttatgtacccagtagtcattcaggagcagcttgttcagtttccatgtagttgagcggttttgagtgagtttttaatcctgagttcttgtttgattgcactgtggtctgagagacagtttgttataatttctgttcttttacatttgctgagaagtgctttacttccaactatggactaagtacgatgtggtgctgagaagaatgtatattctgttgatttggggtggatggttatgtggatgtctgttaggtccatttggtgcagaactgagttcaattcctggatatcctttttaactttctgtcttgttggtctgtctaatgttgacagtggggtgttaaagtctcccataattattatgtgggagtctaagtctctttgtaggtctctaaggacttgctttatgaatctgggtgctcctgtattgggtgcatatatatttaggatagttagctcttcttgttgaattgatccctttaccattatgtaatagccttctttgtctcttttgatctttgttggtttaaagtctgttttatcagagactagggttgcaacccctgccttttttgttttccatttgcttggtagatcttcctccatccctttattttgagcctatttgtgtttctgaacgtgagatgggtctcctgaatacagcacacggatgggtcttgactctttatccaatttgccagtctgtgtcttttaattggagaatttagcccatttatatttaaggttaatattgttaggtgtgaatttgatcctgtcattataatgttaactggttattttgctcattagatgatgcagtttcttcctagcatcgatggtctttacaatttggcacgtttttgcagtggctggtactggttgttcctttccatgtttagtgcttccttcaggagctcttgtagggcaggcctggaggtgacacaatctctcagcatttgcttgtctgtaaaggattttatttctccttcatttatgaagcttagtttggctggatatgaaattctgggttgaaaattcttttctttaagaatgttgaatgttggcccccactctcttctggcttgtagagtttctgccgagagatctgctgttagtctgatgggcttccctttgtgggtaacccgacctttctctctggctgcccttaacattttttccttcatttcaactttggtgaatctgacaattatgtgtcttcgagttgctcttctcaaggaatatctttgtggcgttctctgtatttcatgaatttgaatgttggcctgccttgctaggttggggaagttctcctggataatatcttgcagagtgttttccaacttggttccattcaccccatcactttcaggtacaccaatcagatgtagatttggtcttttcacatagtcccatatttcttggaggctttgtttgtttgttttcactcttttttctctaaacttctcttctcccttcatttcattcatttgatcttcagtcactgataccttttcttccagttgatcgaattgcctactggagcttgtgcatctgtcacatagatctcgtgccatggttttcagctccatcaggtcctttaaggacttctctacactagttattctagttagccatttgtttaatctgttttcgaggtttttagcttctttgcgatgggtttgaatttcctcctttagctcggagaagtttgatcgtctgaagccttcttctctcaaatcgtcaaagtcattctctgtccagctttgttccattgctggcgaggagctgcgttcctttggagggggagaggcactctgatttttagaattttcagctttcctgctctgttttttccccatctttgtggttttaactacctttggtctttgatgatggtgacgtacagatggggttttggtgtggatatcctttctgtttgttagttttccttctaacagtcaggaccctcagctgcaggtctgttgcggtttgctggacgtccactccagaccctgtttgcctgggtatcagcagcaggggctgcagagcagcgaatattgctgaacagcaaatgttgctgcctgatcgttcctctggaagctttgtctcagaggggtacccagccatgtgacgtgtcagtctgcccctactggggggtgcctcccagttaggctactcaggggtcaaggacccacttgaggaggaagtctgtccgttctctgatctcaaactccatgctaggagaaccactactgtcttcaatgctgtcagacagggacatttaattctgcagagatttctgctgccttttgtttggctatgccctgcctccagaggtggagtctacagaggcaggcaggcctccttgagctgccttgggctccacccagtttgagcttcctggcagctttgtttacctactcaagcctcagcaatggtgggtgcccctcccccagcctcgctgctgccttgcagttcgatctcagactgctgtgctagcaatgagcgaggctccatgggcgtgggaccctctgagccaggcgcgggatataatctcctagcgtgccatttgctaagacattggaaaagcgcagtattagtgtgggagtgacccaattttccaggtgccatctgtcacagcttcccttgcctaggaaaggaaattccctgagcccttgcacttcccaggtgaggtgatgcctcgccctgctttggctcacctcgttgggctgcactcactgtcctgcacccactgtcctacaagccccagtgagatgaacccggtacctcagttggaaatgcatacatcacccgtcttctgcatcagtcacactgggagctgtagactggagctgttcctgtttggccatcttggaaccctaatttttcttgagtatgcacatttttctagggagaaagtgctctgcttttagaaccaattaggtagttttcaagtgactttggctgttctatccactatttccccctctccttttcattttattcttgctggtctttatttcacctttctagagtatacaaagagggctgagaggaatgtaatacattaagtggcagctctccatcagcagggtgaataaggagcagagtagatcttcagtgaaacagccaattttttttatagcagggaacctcctaggttgcttccttttctcatttcacttcctcttgacttctctccttgtctcatcagagaaccatggctctcacacagttctttggacttgcgcagcccagatgggacacttctcctccctaaaagtgtcctgagctgcagaattgcctctgtatcaggatacagacacacacacacacagattctttctctccaacacacaagtatatgtatatatcacacatatatacacaaacatgtatccatatcaatggtttttaataatagatgtatacaggaaagcagagtttattgtttaatatgggctcctgtgtcagatgtagagttccagggagagctctacatttcacagttgtgaccttgagacagttcctgacttttatgagctttagtggtagacatggtgctcctcatagttcctacttcatggagatgctataaagactgaatgagctactgcctacaaaacatttatcaccattttcatagtaaaaactcaatacatgtttactgtttgtatttttattgattaacaggatcattaatggtggttttctttttctattttagataaagacacttaggctccaactcttaaccataatcattttattccaaccttcctaattagaaactttggggtctaagattaagactctaagcttttatgaagtgtaatatacagccagggttgagaaccacagattttggctttcatagacactaatatccatatacctgtatttataggcttagctacatcaaagtaatgtctatatgtatcatttagacatttcttttattatccactcatttattctatctgtcaaaattcctgtgctgcctaatctatgttttagttaatttgtatgtgaagtcccagagaagggaaggggaagaagacaatttgtgagccttcttctaggagaagagaaagaaaggcatgaagagttgaggcagggaaggaaacagatttaaatttctccaagattgctgaatttaaaaggctattctaattatgagcacaactcaaaaatattttagatcactattctcagaatcatttttacagataacctttagaggaatataattttgatcttttttttgatctttgaatgggggaggaggtgtctttctttcattaatgtaatctgaggagagattgaggaccacctcaaaccttagtgtgcatgagaatcacttgtggagtttagaaattgcaaatgtttaaattgcaagaaagtctgaactctgtgtccagaggtatcttgatctggggcatggtccaggaatctacctttttttcaagtgtccccggacattcagagcccagctgcccagagaccagttactgagagactgaggcaggatagtcagaccagatgtaaaaggtgagatggttttgagacaagtttttgtttttcttctcttgcttctgatcttctttgggatagaaaattccccatggcttttgtcatgaagtctcaaattctccttatgctcccacttttactttttttttcttcatccatgcttttaggtaattagcttaattctactacaagaaactgtctaatatcccattgagagtttaaagatgtctttgtttctttgttttctctagctcctgggacactcccaggtcagggtattttaaatcagtatctttgaacagtcttcgtatgtggactttcaagagtttaagaacagatatatataaaattatttgttggctctgtgtaagttttctggggagaatacctgtatttctaaaggtattcttaaaaggatgagcaatgcccccaagaagattaagagatcatgccttaacttattgattccaggatctctagagggcccttcacagtctcctagtttttgctcttaaatcagctcagaagtgcttggcttgactttgtgaaaatcaaatggaggctgtaaatccctgactatttctgcctacttatcaattagcacaagaagaatgaagcatctcattaaatgtgtattggattaagcagtctaaatcttctgtgactgcatgggatgctaatcttcttaggatgctctgtctcacaagtggtggtatagaccctggagcagagcatcagcagcatctgggatttgttagaaatgcagactcccaggccccacctactgaatctgcattttaaccagatctccaggtgatccatttttcccataaatttgagaaacatggattttgaacacccttggtcaaagaggtgaggtagattggaaagagtgaagggtcaagcataggaagttggggagctccaacttttctgttaaggcaaggacattgttcccagaaatttttttaatgacaatgagatgctgtatgtatgataaatatgatttaaaagttgaaaataaataattcctagtatgagatactttgttgatctatgccaacattttaatgttacataaactgtttttttttttcactcccatattctctaatacctttcccttctcaaagtcttggaaaagaggacaattttccaaatgcctgttttgccattggaatgccattttatttctttgaaaatacaaatatgaaatccagatgctgctgggcgcaatggctcatgcctgttatcccaacaatttgggaggctgaggtgggagaatagcctgagtccagaagtttgagaccagcctgggcaatataggcagacccatctctacaaaaaaaattaaaatcagccgaccatggtggcacgtgcttgtggttccagctacttggtaggctgaggttacggtgaactgagatcatgtcactgcactcccaggcaacagagcaagacctgtctcaaagaaaaagaaaacaaggaaaaaaaaaaaaagagagaaatccggatgctaatctatcattttagtagaaatactatttgggccatttatgttgacactctgtcattccttattaactgcaattcaagtgatgccttgctgttgtctcttttgttttgtttttagaaaaacttcttcggatatgatctcaaagcacactatgagcagtttattaactcactgcagtcttaattatgtagtaaaatattgtcctcattctgttaccctcagttctataatgtctgtcagcatcatgatagaatattaaaaggaattaaataaaaatcaagaggcagagatgctaataaggttgccagcagggatctttcctgggattagaaaagccctgggaaccatgaaatttaaacgcccatcgtagaaaattgttccttctatgaaaaataaggaggagatctggcacttgggataatcctatgagcctcaaaagacctatgatcttttaaaaataatttgacttcaaatgacaaagaagaagaaaagatggtttatctctgtaaatcttactctcccatgtgactgttgtaaatgcataagccagatactcttaaggaacagacaaacaaaatcaaagaaagcattgacttaatccagagttttatttatcttgtcgtgtagggaaaaaggattgactcaacctgggatgcttggagtagcatttccatacaaatgttctgagaagggcagagtccaggatatgaagagttgtcatggggtattctctctgcataaaatggggtgcaccccaaaccataatatcccctttgactattgataccagtgggctgggggaggtccccaaacactggtaggaccttgaacccagctattgtccaggctcttgacaccatcgtgagaaggaattcaaggatgagtcagaaaataggggaagtacagagatttattgcaaagtgaaaggtacaccctcaagaaaggggaggacaggcacactcaagagagagtcatgtgcaaagacatttacagctgctacctttatgggtttttctttaatcaaggggtagaatattcataaagattcctggaaaaagtgggaatttctcagaattatgatgccacccatttttacaccaaatatgggtgttccccgaactgtcatggtgtccatgagtgttaatatgttaatgagcatataatgacattctaggagaaacctaggtcaaatccagcaccatgttggatctagtcggtcttagcgagcttggtccacaaactatttttcagggtctttttcagccccagcttgtgcagctatttcaggtttccttttgctattcatgtttttatgggatctttggggtgtcgcttttctggctggaaacctctgtggctggaggcatctttgcccaagttttgcttgggccctctgggcttgttccgctcactcgacctggcaggctggacttggctcatgctactggcctggatcccatgcctgccaagggagagtcaagcatggagcagtgaggggtgtgtgagcagcatgcgggctggcctgtgagcagtttgtggtctggccgttgcacagtcagacacgctggctgatgctatagggtgggcagctccaggtgctggcatggacacgggctcttggccgagctgtggctggaccggctacaccacaagcagcttccctggctggcactggggaatatggtggcaccctgaagtttggagatgccaggaactgctgggggccccaaagatggagtcacatccctggcccagggagctcccaggtctgagatccctgaagggccacagctcttctcttctgctcttcactcccaacatggcaagcaaggggcatgtttcaaccctgtttgtgttacagatctttcagcctcaccattcagcaggtcccgagttcttgttttgcatccaggaagaatgaggttcacagacaagtggaggatgagcaagatgaagaggagcgttattgagcaatggaatagctcagagggcccacagtaggcagctcctctccatagtcagggtgtcccaacaagtgtgcagctcttagtagagagggtacttgctctctgcagctggttgtcccattgtttcttcagctcacagcaaagagggtggttcctctctgctaggcaggtcatcctgatgagtgtccagctctcagcagagaaggtaattcttctctgcagctggtcatcccttcatctcccccttgtttcctatcctctctgtcctctgctcaagtcaagggatggggtgtttattggcctcagaggggaggaagcgggtgctgattgatccatgagcagccatgggtgggcccaggcaaaagcaccacaagctccccctctggtctgggggtctcgtggcccagcccccaggcttcaggccctccctggcttaaaggtggggcttcactagggacctgcctccttcgcccaggaaactgcctcctgccgctgttctccacacccaggctgttcatgctaagggaagcctgaaggccagcatcagctgtcctcagcacccccttagcctccctcccatgcttgttggtgcacaaagtcctgagggggccaagccggcaggcgtctggcatgtcagctctaccccgactgtgtgcatatctggccaggctgtgacattgcccaggctcagccctgactttactctgagattggagtgggcgttgacagcggggagaaggcaggcagtgggagcaggcacttccgggcccgcagggggaagtgccggctcccttcctgggcccccaagaacagagatgcccgggtcctgagccatggcagggaggctgcagctgcacctgtggagctcccgctctgccaaatcagaaggggcgaggctctcacttgtccctggttcccgctggctccatggagtgtgcagcccagaccacacctccttgcagtctggggtgggggctccaggtcctcgctgggtccccctctgagagttcctctgtaccataccgtgctgctctcctgacggctggcagctcagcccggccccatcgtggcagttgccggggtggcaggctccaggaggctcccagaggcaggctctggagactgtccgcctcctgcctgcaccgttcccgcagtggtggttggtgagagcagcaacatggggacaggggccagagctgcggaggctctgggcctaggagtgggtcctgcccagtcacgcaatgttgggggcggtgcagtcggctgcctcagggtacagggcacaggagtccgaccatcgccacagctgctcccgcagcttctccagctgccaccgcctgcgcttcgctgcttcagccagcatgatggcagtggctgctctggacggcccgcccctgccatcagtgtggcactgctgcctggaattttctattctcctgtgactgccctgtattatttctgtctcactgtaagaggccaatgacggttcaagtcttcaacattcttcaccatttctgcaatctaatagagcagccttaagaatcatctctatttctaacagtaagcaataattctgtttatatgcttgtgttccctaaatgtaaatgagaactttttagaataccttgaatcctgttgttggaagccaataattagaggtttttatataaatgtttgtttcatcaattagtcaacatatatttactagttatctactttgttttaagctgaagtttgtgactgggtttatgtatatacaactaaaagcacataaccaagggcagataatagccatttcatctacattcttcattcattctttcttgcattatccattcaagaaacgtttttctttttaaatcctgcaatatgttaagtgccaagaatatgacagggagtagaactgacaacttccatgtcttctacagtttatagtccagccacaaaggcagataattaagtaagcaataacagcagagtatggaaagaagtgggtgccataagagaacacagaagaaggagatgatgatttaggcttccggaaatgttggttgtgtatgtgtgtgtgtatgaaactggaaaaggtaacatctggtaaaatagaagataattctttgaaagtagggcagggtcaggaagtccttgatttttcttttatcctagttgtctttcatcctacttcctcctcctttcgtattctaatctccccatagaactgcatgctagggtatgcatcctgctggatctgagtccactggagtatgtaagaacatgatcctcctccttattccaacatgccctctttaggagcatgctgaaatgtactgctggtatttctatgaagcttataattaactacacctccccgaaggcagacagaatcggaaagatacaaaatgtttcaaactcctcagactgataaagagtagtaaaatttaaatagggcccatcttaattattttgttccaaatgaaattctggctatctacccccaagtattcctgaaaacaacaaaaatcacaataataaaaatactttcccttttcaaaatgatgtatagtttacaaaacattttcataaactttattttctcagataagccagaaaactaccagcgaccaaacaaataaacaaacaaacaaaaaaaaaccataaaagtgagagacagggcaatggaaaggaatgcagagtgttgcattgctgcaatggtcaaagcagtcaaggaggtccactcagctatgtgggctattgctggataggctgtacatagttgaaaaggaaggcgagagcatttatctgcatgctgtgcaccaccctaccttcctgtttcctgttagtccaagtgtgtacccagaaggttaaactgacatgttcaggttgcaccatctggtcccttctgcagccactcatccaagtccagaaatggtgggagaagccagaaacttgaggtggaaggatggttggctttgctctctagtagcagcaaagaagaaggtccttttaggaatttgactggtcagtcccaaggggtgcaacaagggcccaacaagaactggtggcacctaaggcaaagttcacaactggggatccaggagctgacatatctgaaggaatctaaggagatacataacatatgttctatacaattcttaaaagttttaattttttttttttttttttttttttgtgatgaggtttagctcttgtcacccaggctggagtgcgatggtgtgatctcggcttactgcaatctccacctcccaggttcaagcgattcttctgcctcagtctcctgagtacctgggactacaggcaagcaccaccactcctagctaatttttgtatttttagtagagacggggtttcaccatgttggccaggctggtctcgaactcctgacctcaagtgacctaccgtccttggcctcccaaagtgctgggattatagatgtgagccactgcacctggccctaatgtttttaattataaaagtgattgcatggctgggcgtggtgactcacacctgtaatcccagcactttgggaggctgaggcaggtgaatcagagggtcaggagtttgagaccagcctaaccaatatggtgaaaccccatctctactaaaaatacaaaaattagctgggcatggtggcaggtgcctgcagtcccagctacttgggaggctgaggcaggagaatcgcttgaacctgggaggtggaggtgaccgtgagccaagatcacaccactgcactcctgcctgggtgacagagggagactctgtctcaaaagaaagaaaaaagttattgcacatgggctgggtgtggtggtgcatgtctgtaatttcaacactttgggaggctgaggcaggaggttcgcttgagcctaggaagtcaggaccagcctgggcaacatagtgagaccttgtctctatcaaaaaatcaaaaaattagctaggtgtggttggacccacctgaggttttggctacaagggaggctgaggcaggaggatcacttgagcctgggaagttgaggctgcagtgagccatgtttgtgccattgtagtccagtttgggtaacagagaaagaccctgtctcaaaaaaataagtaaataaataaataaaaatttgaaaataaaagctaaagcacaaactagccatattcaaattttaaaattcatgaacttaaaaaaaaattatttttagagacaagatctctctctgtcacccaggctggagtgtagtagtacaaatcatggctcactgcagtcttgacttcctgggctcaagtgatcctcctgcctcagccttctaagcgactgggcctacaggtacacaccaccacatctggcttatttattgaaaaaaaaatttctatagagacagggtcttggtatgttgcctaggctgatctcaaactcttcagctcaagcagtcctcccaccttggcctctcaaattgcttggattacgtcttgagccaccatgatgggccttcatgacctttgactctgaaatcttccagaaatttaattccagaactacacaaacatacatatacaagaaagtcattgcttgttagtgataacaatgtgcaaacaagcttaactcccataagtagaaaattagtgaaataaacaattgtctgaacattggatgactcagaaggaagaagataattaatatttacatggactttagcatttctgcatgctaactccatcatttattgactgcactttgggtaaattatttatgcttttaaaatttttagtgtagtcatcagaaagaaaagggggctaatgattgtacctcctgcagagtacatgtatataaagcacttagagtgttgttaaaagaaaaacatcagacaaattaaatttagtaaaatttaattgagagaaaaacgatttgggaattgggcagcctccaaaccagaatggattcggagagacttcagcacaggcactgtcactgaaaaaaaaattatggacagaaaaaggagatgtacagaaaatggaagtgaggtacagaaacagctggattggttatagcttggtgtttgccttatttgaacatggtttgaacagttggctgcctttgattggccgaaaccagccaaagtgactgacacaagagtaagttacagtctctttacacatccagttaggttacagttcactatatacaaagaggtctttaggctgcacttgaaatacctaaggaggcagtgatatagtttggctgtgtcctcacccaaatctcaccttgaattcccatgtgttgtgggagggacttgatagaaggtaattgaatcatagggacaggtttgtcccatgctgttcttgtgatagtgagtaagtcttatgagatctgatggttatcgtaaggaggagtttccttgcacaagccctctctctttttgcctgctgccatccatgtatgacatgacttgctgctccttgctttccaccatggttgtaaagcctcctcagccatgtggtaaccgtaagtccaataaacctctttcttttgtaaattgcccagtcttggatatgtcttaatcagcagcatgaaattgtacagtagattggtaccaggaataggattctgctgaaaagatacccaaaaatgtggaagtgactttggaactgggtaacaggcaggggttggaacattttggagggttcagaagaagacaggaaaatgtgggaaactatggaacttcctatggacttgttgaataggtttgcccaaatgcttatagtgatatggacaatgaagtccaggttaaggtggtctcacatggagatgaggaccttgttgtgaactggagcaaaagtgactcttgttatgttttagcgaagagactggtggcatttttcccctgccctagtgatttgtggaactttcaacttgagagaggtaatttagggtatgtggtggaagaaatttccaagcagcaaagcattcaagaggtgacttgggtgctgttaaagacattcagttttaaaagggaaacagagcataaaaatttggaaaattttcagcctgacaatgtgatagaaaagaaaatcttattttctgaggtgaaattcaagacagctgaagaaatttgcataagtaacaaggaaccaaatgttaatccccaagacaatggggaaaatgtctccagggcatgtcagaggttgtcatggtagcctctcctgtcattggcctggagatctgaggggaaaaagtggtttaatggaccaggtgggcccagggtccccgtgctgtgtgtagctatggacgtggtgccctgtgtcccagtcactccagctgtggctgaaaggggccaacatagagctcgggccatggcttcagagggtgcaagccccaagccttggcagcttccacgtggtgttgagcctgtgagtgcacagaagtcaagaactgggggtttgggaacctccgcctagatttcagaagatgtatggaaatgcctggatgcccaggtagaagtttgctgcaggggcagggctctcatggaaaacttctgctagggtagtgtggaagggaaatgttgggttggaacccccacacagagtccctactggggcactgcctagtaaagctgtgagaagagggccaccgtcctccagaccccagaatggtagatccactgacagcttgcaccgtgtgcctggaaaagccacagacactcaacaccagcctgtgaaagcagccagaagggaggctgtaccctgcagagccgtaagtgcagagctgcccaagaccatggaaacgcacctcttgcatcagcatgatgtggatgtgagacatggagtcaaaggagatcattttggaactttaagatttgactgctctgctggatttcagacttgcatgggggatgtagccccttcattttggccaatttctcccatttagaatggctatatttacccaatgcctgtatccccattatatctaggaggtaactaacttgcttttgattttactggctcatagccagaagggacttgccttgtctcagatgagacttcggactgtggacttttgagttaatgcagaaatgagttaagactttgggggactgttaggaaggcatgattggttttgaaatgtgaggacatgagatttgggaggggccaagtgtggaatgatatggtttggctgtatccccatgcatatctcatgttgaattcccacatgttttggaagggacccagtgggaggtaattgaattgtgggggcaggttttcctgtgctgttcttgtgatagtgagtaagtctcatgagatctgatggttattataagggggtgtccctacacgagctctctctttttgcctcttgccatccatgtaagacgtgacttgcggctccttgcctttcaccatgactgtgaagcctcccagccatgtggaactgtaagtccaacaaacctctttcttttgaaattgctcagtctcgggtatgtctttatcagcagcatgaaaacggactaatacaggcagctttaggctaaacttaatttagcagtgtctgacacaaaatactagctaatcctcattttcaccatcatcataatcctttcatcttgcttgcatattgttatacccagcctagggtataacaaaagacttttgtaaaagcctagatgtgaaaacctagatgaaaaatatttcagtggcgtcctaaatgcttgacaagtagtcagtagtgttcttcaattatactgctttgtcttatattgatgaaattttcagatgtcaaaaagctgggacaagcagttattgcattacgttgcaaattttgtgtctaaaaagatcttagcaaaatggaatcctgggcaaaatctcaaaagaggaacttaaaatggctaattgggaagtcttgaatttggttaaaacaaaaaggcatcactgaactgcaagatttataacaaatatttagagattttacttttaatgtaatatgaattaaatgtgaattatgactgttaaaaacgtgaatgtgatattagattatgttaaaattatcatagtgactaaaatgaggaagctgatatttctactttctccacgtaagtctcaatgcactgagaaaaatgtgttccatgcaaaaatgtaacttgatttttgggcacttattggggaattgtagcagaagtaagcaatggtcagaaaaaaagagccttatgagccatcctaaggggatggagtttatttcagacacagtaagaatccattgataagatttaaaaagaggagtaatgggatcacagctgtcttttaacatgtgaatgttgaatgggacttggggcagggagaccagtcagaaggcttttgtgaagcccatggttggagggagggcagaaaacaagatagacacatgaagagatattcaggaggtgcaattgaccggactggataattggttggttgaggtggtgagggaggaagaagtgggaaaagcctatgatgactcccaggtttctggactgtatttgatactgggaatgtaagaaggaaaactgtcttgtgggatgtttggatgattatatgcatcagaaagtgaagcataggcaggggaactaccaatttcttttgatgttaaggaagaaaagaagctgtgtttggcttgatagataaagtccatggccaatttcttctgtgaaattcttgagtatataatcagaccattaatggaagagaatgtgaaattgctgagttaaccgtaggagggactttctaacatatactcattactgcttcaacacagctgaccttatccatgttgcagcctaatttaaattataatgcttattcttctgtgcactccaaaattctgactatagttttccttgttactactaacttgctataaatgcagatttgtacttttagtattgaaagtatacttttggctgaaaaaagggagtctgagtcaacttaactatgtatacatatatatatatttctaactatgttatagacaagcccagggtaaaacaagcaatatggaccataaatgtatgaatttatttttatcattgtttttgttattttggtatttttttctagactttgttacatgcatatttttctagactagtactcagtctgtacatacatttatggatcattaatttttttccttttgtttttagttgacataataattgtacatatttaactgagtacagagtgatatttggatacatgtatacaatgtataatgatcaagttagggtaattagggcattcatcaccccaaacatttatcatttttttgttgagaacattcataatcctctcttactgcttttaaacatatacaagaaatttttgttaactatattcaccctatagtgctatggaacactagaacttagtcctcctatctagctataattttggaaccacttatttttaattaatatgataagaattttccacattgctttgaagccttcatgcttctaatatttgtattttgttccaacattacattaactacagtaaaatttacttacaactgttagacattttggttgcatccaaatttttgctgtattgtgcagccctagaaataagatcttcatatggaaactttccttcactcactccaatactttgaattagtagatgagagttccaaaaggggagttactaagtcaaagtgttggagaaaaattatggaacttgatattataaaatattattcaacaaattaaagcctgggtggtcttgactccttgctcatggtcaacgtgagaagttgtatttctacttgggctttttagttcaacaatatatacgacatttaagcttaatggagaggcaaaagaaaggaaggcaaattaggaataaaatgaccacttttatcttaaacgtttttctcaagatttgtcatctcttgattttgataggtcccttcttactttcccctcctcccccattggctaatgacaagatctggtggcaacatttcttataagttttctcattcagataaattatcatagaaaggaattcaaaggatgggttgtttattttgtttagtgcttatgaaatgatatcctaaaagaggccattgcaaaaaccattatgttgacttccaaattggatcatcattttatcattcatttgaaatctcatttaccagtggcacccactgccagtttccataacaaatcaatttgtgtgtcataacactcctcgggcactcttcagtcacccatgaatgggttgagtacagctgtcatgagcaacccccaaatgttacctagaaatcaaatcttcctctcccccaaatctctctgatatagctacttcctcactggctcaacataggtacaaaaatgagaccatttgtagtctcggtcaggaaatataaaataaattaccaaggaaggtggtgaaatgaaaccagccaaacccctctcttcatcaaggacatgggagatgagtttacttttgattatgaggatcttatgtaataattatggatatatgacaggcatgagatcctaaaagtattactgaagcaagggtgatctctctggcttggaaagtttctcaacctcagcacttttgacattttgggctggataatttttggtagtagaggctgacattgtaggatatttagctgcatccctggcctttacccactagatgcaggtaacacccctgtagttatgacaaccaaaaaatatatctagacattgccagttgtccccttgtagatcaaaatcacccattattgagaaccattgcttagttacaaaggtttagtttctcaggttcactctttgagtcttggtttccttagctgaaaaatcaaaagaaagacttggttatctaagttaccctacaacattaatggtatttgaacatgccagggtcagggaaatagatttactggtctatataatctttaaagccctagcctttgtaattcctgaagtttaaaagttatttacactgttggtggggctataaacacaatgggagttcaaccattgtggaagtcggtgtggtgattcctcagggatctagaactagaaatagcatttgacccagccatcccattactgcgtatatacccaaaggttataaatcatgctgctataaagacacatgcacacgtatgtttattgaggcactattcacaatagcaaagacttggaaccaagccaaatgtccaacaatgatagactggattaagaaaatgtggcacatatacaccatggaatactatgcagccatgaaaaaggatgagttcatgtcctttgtagggacatggatgaagctggaaactatcattctcagcaaactatcgcaaggacaaaaaaccaaacaccacatgttctcactcataggtgggaattgaacaatgagaacacatggacacaggaaggggaacatcacacaccggagactgttgtggggttgggggaggggggagggatagcattagtagatatacctaatgctaaatgacgagttaatgggtgcagcacaccaacatggcacatgtatacataagtaacaaacctgcacattgtgcacacataccctaaaacttaaagtataataacaataaaaaaaagttataatattttttgaaattttttttttaaaaaacaccatggtattattagttggggaatgtaaatatgattagctattattttatctaagaggaaaagtatttttagagatgagaattggaatttaaaaaaaaaaattcaacttttatgttagagtcagggagtacatgtgcaggattgttacttgagtatattgagtgatgctgaagtttggggtacaattcctcctgccaccaaggtactggtacctaaaattagcaggtatatacctacttagcatactacctcatattaagtttctcaacccttgccccctccctacccctctctccagtgtctattattgccatatttttatctatatgtacccaatgtttagttcccacttataagtgagaacatgcaatatttgattttctgttcctgtgttaatttgcttaagattgtggcctccagttgcatccatgttgctacagaggacatgatttcatcttttatggctgtgtggtattcaatggtgtatatatgtacatttcctttatccagtccactgctgatgggcgcttaagttgattccatatcttttctattgtgaatcgtgctacagtgaatgtgcaactgcatgtgtcttttagactgatcattttagaaggatttattttcttttgagtatgtacccagtaatggaattgctgggtcacacagtagttctgttctaagttctttgagaaatctccaaactgctttccctagtggctgaactaatttacattcccaccaacagtgtataagcattcccatttctccacagcctcatcagcatctgttgtttttgacatttaaaattatagttattctgactggtgtgagaaggtatttcattatggttttgatttgcatttctctgattattagtgatgtggaacgttttttcatgtttcttggccacttgtatgtcttcttttgagaagtgtctgttaatgtcttttacccatttttaatggggttatttttttgttgcttgttagattaagttccttgtaaattctggatattagacctttgttggatgcatagtttgcaaatactttttgccattccctaggttgtctgttgactcttttgatagtttcttttgctgtgcagaagctcttcagtttaattaggtcccatttgtcagtttttgtttttgttgcaattgcttttgaggacttggtcataaattctttcccaaggtcaatgtccagaatgatgtttcctagattatattctagtattcttttagtttaaggtgttacatttaaatcttttaatccgtcttgagttaatttttgcatatgaggaaaggtatgggtctagtttcatttttctgtatgtggcgatccaggtagcccagcaccatttattgaaaagggagtactttccccattgcttgtttttgttgactttgttgaagatcagatggatgtatgtgtgtgactttattctcagttttctattctgttccattggtatttatctgtttgtaccagtaccatgctgttttggttactataaatttacagtacagtatgaagtctgataatgtgattcctctggctttgttcttcttgcttaggattgcttggctatttgagctctttcttggttccatatgaattttagaataggtttttttctagctctgtgaaaaatgatattggtagtttgatagaaatagcatagaatatgttgatttctttgggcagcagggtcattttaacaatattgattcttccaatccatgagtatggaatgttttcccatttgtttgtgtcatctgtgatttctttcagcagtgttttgtagttctccttatagagacctttgacttccttgattagatctattcctagttattttattttatttgtgtgactattgtaaatgggattgtgttcttgatttggctctcagcttgaatgttactgttgtatagaaatgctactgatttttatacattgactttgtatcctaaaactttactgaagttgcttatcaattccagaagttttggtggagtatttagggttttctagacatagaatcatgctgtctatgaagagagataatttgacttcttcttttcctttttggatgccttttatttctttctcttgcctgattgctctggctagtacttcctcagaactggaagttttatttgtgcaaatgccccagaattttgagattggaagcaggctggagtgtgatggagtcagaagatagaatgctggccaaagataagagtaaaaaaggagcgaaggtaaaatcagtagttttcaagtgtgcaaatacatacagaactccttttattgttttctttttatgtatttatttatttagagacagggtctcactgtctctgcccaggctggagtgcagtggtgtgataatagcttattataagcttgaactcccgagtggctggaaatacaggtgtgtgccacgatgcccagctattttttacttctatttttttatagagatatgtttcactatgtttcccaggctggtcttgaactcctgttctcaggcaatcctcctgcctcagcctcccaaagcactgggattaaaggtatgagccatcttacctgagtgagctatttggacaccactccttttaaacataaaataaacaaagggttagagaaaaaatggttcaaggagtccaggaactgttttctgttggaaggctctctctgtcatcacttggttatttaagttgcacagactggagactaggtgtgaaatccaggaattgcattcaaagtagattgaaaggaataattagcaaattcataacaatggtgagacaaggagctcagagttctagacagactgtgaggatgaagcaggaagaaaatgattaagaatacctagccatgctccacattccactgctttcactatgacaagggctttggtgatgttcagtgtctatttagacacacaggcatgctgcctgtcggcatgcctctgcaccgaatagaaccatgaattcagattcagcttcacaggcaagaacattctcatctgagagataatgctttctaaaactgagtcagaaaggagaagaggaaggaataataaatccccctctctcttgcttactctctcattctgtctctatctctttctctcctagcctgtaattctaagttatctagacaaggtactagggacacctgaaaacattcataactgaatgataacaagtaatgttatttaagtgtttgccattagtttacctgcttggagtggcttttataataaatcgtaatatttattagaacttactatgtgttcttatgtttgcatgtgttgtatttactatcaatgtaaacctatgaggtagttgctatttttatcatataccttttaggatgagaaaattagggcagagaatagtcgagtaacatgtccaaggtcacacagagcgtaatgatggcagaaaaccgaaattctgttaaaatatataaagtgttttattcggagccaatgtaagtgacagcagcccaggaaaacagtctcaagaggtcctgagaaagtgcacctaaagcagtcgggttacagtttggtttaatacatttcaggaagataagaattgcaggtaaaatcataaataaattcctgggaggtatacaatagtttggtctgaaaaggcaggccatctcgaagtgggagcttataagtcataggaaggtttaggagttatttatttggcacttggttgaaagagttaagctttgtttaaaaacttggggtcaatagaaaggaatgcttaagttaagggggggtctgttatttgtcatgtgatgccatgttagagtctggttgaaaagtaggccacaatatactgggtcaaaaaagacctgtttaatgagctttaagggtttgtgaggcatgactccccaggccccttagaaaggcatatgaggaagtaaaaaggtcagagtccattcctcagtacctttaaagagttcggactagaacccatcagatttgcaactgaggcttctctccttactgctaaattattctgcttccctgagcacactgcagtcatggtcttagcttactcccaccatgagcttatgagcaggcattgtttttatcttccttctacagatgaggaaactgaggcacggacaggatgaatactttatctaaaatcagaaatgaagtgaggaatcagggattcaaactaagttgggttgctgtctctttttcctctgacctctatgctccttggcctcctctcagagtgctgcaaggatatgcagtactaagcaattgtgcagcaaggcagatggaatccgagctcacctgtggcagcaccgtttcagtgtttggagaaagatgagattatatttggttgcttgggggttgttaaaaaggcttcatggaggggcttgtgttggctacggtttgggaaagtgggtctaattctataggaagcaagtgggaggagggcgttcgtggaagaaggagcagtataagcaaaggcataaaggccaagtggcactgggtttgctgcaggaaatgttcagttgtcattcagtttagagcagtgagggtgtgtaccttttagtatatattttctttaaaagtacagcaatttagagaaactcagaagacagaaaaaataagttttgattaaagtcagagtacccacatgcaaccgcagaaagtgaccaagacagggaagatgctgccatgagaacccacgtagtaatcacacaacagctgctgggctgtgttacatccaggggtgagaaccattaggatcaaaatcacaaagcaagtatcatatcacagtaggaagcttctagttcttccccaggctccaacgactcactatgaacccagacttgtcttttagaccccaacctgtctctgaaaaagtaactgctttgtatatgtatgcatgtacatggaaaggattactaataactaacatatctgctggcactattcttcattattctaaatataaacttatgtaaaggtataagtaatgcttatgtttaattgcacagttagaaaattacctgtgggtttaagaataaagttcatgaagagaattttaaaattctgcattataccttcgttaatacaatattatgatatttgaaatcaggatgagcctgggttggctactctacacagtgtgaataaatgtgaatgtgaataaagaagttatatttagagagccttgatcacctacaggtcttatcaaagaccctcttacacagttgatctcctccagttatcactgactgagaggattcagccagtagtaattctactgtcctaaacaacgagatatgcctccccactcctgcccctaccagaagaaaacttgcagcagtaaccattgaggactggcctgcctgctgtgtcctgcaagggagaagtagctgcagggagtgctgggatctgtgggatgtggcttttcaacatttttcataaggctgaagctcatatgcagatagaactcatttgcctgaagtcagacaccacggcaaccacaacctgatcaaatccaacccctggagtgtgtgtcagggcctctgtgatggagcacagcaggctcacctctgaagcagagtttgactccggaatcttctgtttgcagcatgactaagctttgtttttagtctccctcttggggaagaattaaacctgaccctatgaggaggcagcaagaactgaacagaaacccatatttattgatagtgactcttcctcagaggaaactgaagcaagtgtcttttgaattgtgttaagcctttattatttctttgatggcaaatacgtgttatcaatgtttattgagaagactgagaatatgctgatcataaaagatctaaagaatattaaacatttcccgttcatgtatctttcacaatttttattttttatgtgtatcttttcagaatcttcatatatatatatatgtatatatacactgtgtgcatggacacagaaggacaacaattttttttaaatatgaataacttacgatggttgatttgaagtctgtttttgggtatcattttagaacagaatgaagtactcattacttagtgccggatgagatgtcagagccccggcatcagaaagtgatcaactcacaggttggtaagaatttactgataactctataggtttgaaaaggaaatttttattattatagatagaaagtatactgcagaagagtgcagtggggcatctcagcaagagagggctgaccaccccatgaggaatttttgcttaggggtatttatggaacttaaagtgggaccttaagggtaatttggatcatgttagtcacatagcccatgataaatggttaaatttgtagacattttgtgccttaatggcagcaagggttgcacaataagattcgatatgcatgcattctggagatgtatagaaattctaattacttataaactttgggtagagaagcctggaaccagatgcctattttagatagaagggaagtccaattacttcaaattcctcagataaaaagttttgcctccggatggcttgcttgatgatcaccagttgatctttgctttcttcacttggatttgccaaatggtttgcattttgccccatttgttttataattttcctccttcccttccttcctcctcctttcctccctccctcccatcctatctattagtctacttctttatctaatctatcatttctctatctgtccacacatattttttgtaatcatctgagagtagtttggagacatcatgtccttttagtgtatatttctgtatgcatttcctaaaaacaaggttttagctatcttgtatagctacagtaaaatatattctctacatattctcttacatatgtaggggcaaagggaaaacttccttttgccctcagagggtttgttgaacaattaactcacaaaaggcagactcataagataaaaggaatccagtttattactgtgtgcacagggagaaccacagagtgattggcctccccagtgggctgcaaaagcttatttaccatcttgaggctacacacagaatgggagctcggacaatggccaaaaataggttgtattggtaaaacacattatgggagggagagaagaggagacttggtttgtgatatggtttatctgtgtccccacccaatctcaccttgaattatagttcccataatctccatgtgtcatggaagacaccctgtgggaggtaattgagtcatgggggtggttaccctcatgctgttttcatgagagtgagttctcacaagatctgatggttttatatgggggcttttccccacttcactcttgttcttctctgtcctgccactatgtgaagaaggacctgtttgcttctgcttcagccatgattgtaagtttcctgaggcctcctcagccatgctaaactgtgagtcaatgaaacttcttttctttataaattacccggtctctggtatgtctttattagcagtgtgagaacagactaatacagtttgcaaagggggtcttgttatgtagatgaaacctcacaggtagcaaccctcagagacaatagatagtaaatgtttccttgagacctttaaaggtgtcagactctcagttagtctttcttggatccagacaagggagaaggcctggcagtataaatgcaggttccctacagatgatgtaaatttctcccaggaaagacagctttgcagagctacttttatttgctggctctctgacagccatctcaaaatatgtcaaagaaatatattctggtgtaaaacacttttattttcctcacacactacaatgaaatgaccaaatgagaaaatatacattgatacagtatgattgtctaatccagagtttgtgttcaacttttctcagttgtcccaataatgtacgttatagctgtgttttccttgtcctgaatccagtctgagattccactttaagtttagttcgctctctagtttacttaatctagaatacttactcatgatttatctctcttaaccttgacgcttaaaggtgtccctcaatttgtgtgattgttttctcattgttagattcattttatgcatctttggtaagtgtacctctgaggagaaaaaatacaaactcagagctttttcctattctctttcccaacacaacaatcaatgcaatacttctgtgattacatgagtaagggtttttccacacacaccaaccactggacacctgctggatgtcctctaattcaattcagttctgatgctatctacctacagatagtgccagatgccacagatcaagggctcagtccccaggaatgcccttggcacttccagacaccagtcacaagttcaggcttccggaacttctgacccactggcttgaagttggggttcccatgattacctctttaaattcagttaacttgctaaattggctcacagaactcacagaaacacttacttgtgtttaccagtttattataaaagatattacaaagaatatagatgaagagatgcatagggtgaagtatggaggaagtggcacagagcttccatcccctctctaggtgggccaccttccaggaacctccagatgttcagctatctagaagctccccaaatcctatcctcttgggtttttatggaggcttcattacattggcacaattgattaaaccattagtcactgttgattagtttaacctttagcccctctcctctccctaaaagttaggagtggagttgaagatcccaaccccctaattgtatcttggtctttcgggtgaccagctgccatcctgaagctacctaggggctgccagtcaccagtcaataattaacatacaaaacatcactgtggagattctaaggattttagaagttatataccaggaaatgaggtcaaggaccaaatatatattttacaatatcacaataccacagaagtaatatagacccacctcaatgcatcatatcaggaggtacatagtgttggtcatcccaatattggtgatgttaaatttgatcacttggttaaagtgttgtctgccaggtttctcaactgtaaagttactgttttctcccattgtaatgagtcattttcctttggggaaatactctggggccacgtaaatgtcctatttcttatcaaactgttagcagcagcgaatccaacgggtctgcagcaaactcgattcttgcctcctcagaaaaaaacgaattcagccaaggggcataaggcagagggagagaccaaggcaagttttagagcaggagtgaaagtttatttaaaaagttttagagcaggaatgaaatgaagaaggccaagcaagagacttgagagatccaagtgtgctgtttggcccttaacttgttttgtacattggcatggttccagagtttccatttctcttcccttgatttttcccttggggtgcactgtgcgcatgcacagtggcctgccagcacttgggaggggccgtgtgtgcagtgtgtttactgaagttgtgccatgctcattagaagcgtttttcccttaccagttgagtgttcttagaggaaggtcgcataacagttaaactttgccattttgtctcttagtagacatgcttgagcccactcacccagcttctgagatcttatcagaatgctgctgatcaccagcttcacgtgttttctatcttgggaaactgcctttccctggtgtcagctgtaactaattattattttagagagacagtataacacatgccagaccaacacccaatggttgcttgacattcctggggtgcgggaccatctcctgccctgcttatatctgcctagctacctgctctaacaaaaccactggtttaacatccccttgggattttctaacttcatcgttacttcatatttactagttatcattctatgacaagggaaaacctctccctttatctctatcctctctcttgctctctctctgcagtacggattcatggattcatcaatgggttatagtctaccagtgtcattatttattttattgttcaagttgccccagtgtggtcacagggaggcccttcatgctgctgctttttccttttgacatgtccttattctgtgagcacttttttagttcttggcaccacaaaatgtttcttactaaccttgtactttctctgtccaacttgtggaatcagctcttgtcccaaggaaccttagatttttttttttttttgagaaaagaacttagaaaccaagatctgtggatctggtgtgctccttgctactgatgtgtctcatcagacagacctaggagataggagatacagacagcagttatttaaccatgagagcatatggatatctccagcttaacactaaagagtatgttctaagttttctgtttttcatatttttaaatgtcttcttcaacagctgggaattgagaaacctggcatgagactcattatttttctgcatgattcagttaatagataaattgcatggactaattgttatatcaacttcgctggcatataatttatatacagtaaaattcacccactttacatgtactgtttgataagttttgtcaaagtatataccactgaaatcactaaccataatcaaaatacaaaatatttccaatattccaagaagttccctcctactactttgtagttaatccttcatctgtagctctagggaacgactaatcttttgttactgcagattatatttttcatttctagaatttcatataaatggaatcatacaatatgtgttcctgtttctgcttcttcttgatgtttttgagattctttatcttgtgtgacactgattgatttttttttttttaattttgaaacagagttttgctctgtcactcaggttggagtgcaacagtgcaatcatagctcactgcagcctagaactcctgggcttaagtaattttcttgccttggcctcctgagtagatgggatataggtgcactccatcacacatgtctggctattttttttattttaatagagatgaagtcttactatgttacccaggctggcctcaagtgatcctcccacctaggcctcccaaagttctaggattacaggagtgagccactgcgtctagccctgattgatttttaaaccaagcttgcatcccggggataaaacatatttgttcatgatttattatcttttcatatgttgctagagtcattttgcaaatattttgttaaagattagtgcatctttgattttgaggtctatttgtaattttctttttttggtaacatctttgtcaggttgtgctcacaaagtaatgttagtttcagaaaatgtaataaaaaatgttcttttcttctattttttattaagtaaactgaagaatattgctataattcatctctgaaatatttactagaattcaccagtgaagctgtctaacctggagttttctttgtgggaatgctttttataatgatataaggctattggtcactcttcagtgcctttaaatatctttgttttgttctgttttccaaatttatttcaatgttaaaatttgtaatttgagagcatgttagtatgctacatgatattccttcactaccagaatagtacaaagtaaaatctattttttaaaatctcaatcatacattggaacatagttttacatcagcaaatacacctgaatactgcagagtatttcattttatacacacatgactatttatctgatttcactacttgtatactcactctcgttttctttaaacccactctattgaggcctttatgcctacttgaataacattactgttgccaacctcactaattgtctccactttgctaaatgagttggtatgtctttcgtccttgtttcacttgatccatcagcagcatttgactaagttggtcactttcttctttcctcacttggctttcaggacaccaccttttcttgagtttccctgacctctctggctgctattgtttgatgtcatttgctggttccatttcttgtccctgaacttttaatgttgaaatgccgtgaagctctgttcttggtcatcttctcctctctctataaccttaatcccttggtaatctcaaccagtctcataacttaaagtgtcacctctatcttgttaattccaaatttatatctccagcttggatctttttttctaaccccagacctaaaagtctaacagacatctttaactcatcatgttccacaccaaatgcttcaaaacttgctcctctcacctgcttataaattctccaaaacctactccttaaccttttaaaagttcagttgctgtcagttctgtctttctggttattcagttcagaatccttggcttcaactatgaatttcttgctctcttatattgatcaaaattcaaattctcttgtctttacatttctagtaaatcaaaaatcttaccacttttcaccatgtcattatattatcaactattatctcctctcaccctctcctgtctctctcattcctttctgagtctgagggaccatcacctctttcttggactataatcacctgacatgttcttctttcccactgcacagataaaaccaatttactgagatagtagtattgcagtagaaaaagtttaattaatgcagggctagcggagtgatagatatgagttttttactcaaatcagcctccccaagaactcagaggctaaggtttttatggataatttgatgggcagggggcaagggaatgggcactgctgattggttggagatgaattcatagagtctggaaaatgatcctagtgcactgagtcggtctctgggtgggagccacagaatgagttagctatgaatcatgcatccctgtggagttagttagtccccagaaagccaaagtctgaaaagcatctcaaaagaccaatcttagggggttgggtgtggtggctcacacttgtaaatccagcactctgggaagctgatgcaggagaattgcttgagcctaggagtttgagaccagcctggacaacacaggaagactccatctctacacacatacacacaaaagaaaaaattagctggacatgttggcgtgtgcctgtagtcccagctactcaggaggtcgaggtgggaggattgcatgagccctccctaatgatcatttattgcccttcaacaaaagtcctcttcgccaccccctcccatatcctcttttgctaggatccaagtccccattctttctgtaaccttaagatgatatatgaacttctgttcctcactgggggttggatctccattcagaaggctcttatgtatatataggttaaataactttgtgtgccttttctcctattaatcttctttctgagaactgatttttcagcagtccttcagagggcccttgggccccacacctaagcgatcttcttccagtacatctcctcattcactgctccagacactgtggttttctgcaattcctggaaaacacctggtggacttctctctctttttttttccccagagatatacttggctaacaactatattcaagtcatcattcaactttcatccatcctcctaatgtagcctaccgtgactgtcttgtcaaaaaccataaatatcttaccttcaccttcagagtttctaaatcctaccttgactgttctgtcaaaaactataaatatctcatcttcaccttcagagtttctgaatctatttaccttgctttccttcttctttttcccctattactcatcaacttctaatatcataaaatttatgtactatatttattatttattgcctgtactcctattaacatttagtcttcaagagcagggatatttatctgtttggctcactagtattgtgtacctaaaatatggaccaacatgtgacagatatttaataaattcacatggaataaattagacaggttgttctcattttccacagcaagatggatttatccatcagtccatttgtttctttgtccatatatccatgatagattgatctattgatctgtctatctaatctacctatatccatccatccatccatccatccatccatccatccatccatctctcttatctagctagctagccagctatccatctatttacctactattttctgtctatctgtttttgagcatttactctttatttactctgtcagaaatagtgttaaaagctttggaaaaagtaaatatacagtgatgtgctagagcttcttacgccagcttataggaactgatggttcaatattcagaaattttacgagctggcttttaaaatagtggtagcttgaaattggccatggtatgggtatttataccagagaaattggaaaattctgcaaatcagggcttttcctgccctttcccttcatcacccctaaccccagtttaccagtgtaccactagaagtataagacatctcttgccataaagcagttaaactcctaagcatatagctcctaaatacagtacgtaatagaactcaagaggatagttaagatggacttgcagtattcatgtcttgtggaaataaatgaagaatattcaaatgagaatagacagagcctacttactcagagcttgctttatcaagggagtcagctactatcacttgtgtttggcagagatgcagaagcagttaggtatttggaaagctttataagtgaaaaaaaggggaaaacttcaggtgatctaattggagattgttggcaaggggaaactggatagatagaagtggggcaacttatgtgattggtttggggaggattttggctttctctagtctgttctgaaacagataaaagagagggaacaaagataagaaagtttgccattgttgatagtcctgatcatcctgagctgactgatttggaggttgtggtatagctttctggacttcctatgtgggtcagagttctatcatcatattttgtctggctgttgtctgtaaatttggtctctttggtccttggttttgtcattttcttgcttatgaggggtgtttaacccattcagagaaggccatggtttcagatattcactgctagaggattgtcaccatagtcaactgtattatgaaatactgactttttagttatatcatcatggtaatcatataataagggagcagctgtgaagaagcatttaaaactctgagtagagtgcaatggaccatagtcttgacactatgactaaaatgacaattaatagttcacgtaagatgctttggacccaagaacgccaattgccaagacaacaaattccagaggctatggagattgaccttagtgatctaagtagctttttccttaatgcaaaatatagccagttctactttgcctgtttgatccaagtgcaaaatcaatattaaaaatgacatagaagccaccacgactagcccaaaagggatgtagagcaatgcaattgtccatcactattcttgtcaacaagtgacaccattttgtattccatctagggcagaagtagtgtccttaatgacttctgccagagttagggatcactcttttagagcttttacttctgtatgtatgcttcccactgttgggaacactgctgtgactgtctgcacaagcaatgggtcaatttaaaacatggctgcacctatactaaggatattacattgagatgacttactgtagatatgttaatgatatttaaatatagaaatgcaacttagattttgttgttctgtagacagtgaaattagggtcaactgttgaattgtcaatgtaaggatgaatttgatattaacaagaaatctgaaaatggagcagactgacctgagaaagcagtgggctactgaatgttttccagagtgattagccatttctcaagtgtaatgggagagtgtataatattccagctttgagggtgaggttgaaatagattattaactttaatgtctctttcaatgctaagagtctatgtctcagaatgattcttgtgagacgttgataatcctgtcgggagaatagtgattagtttcacaccgagctgactttattttacctagttttacttagttttttaaaagtttactaagtttttaagccagagttacaaaagttacaaagggacacttactagtattatgttgttttacctgccatgagaatattctatagtcatatgtttttcccctaaaaatttgttgtattttctctttaaagactgtgtgaatcatgtaactgaagatgtttccattttttttttagctgccataaagcccagggacaaatttgccattgaacatgttaaccatgcagggtcaaattgtctctatatttatgctttttcttcctggtctcaatctcttattttaaatgacattgtctctggctttatttttatgttttaaatttacttatgttatgcattctttcaagtacctcaaatcctttgggaagtgcaatgggaagtggatgaatggatcgataagtgaatgcatatataatggcatggcaaattggtgtttctttgggtaagtgcctataagcggtgataatatcatgttccacaatggcccagtaagctatcaattcctatccttgccagtaattttcattcttacccaatatccaaattcttattccccgattcctcagatggattcccatttggataatcatcagccccaattctatgctcattctgaacagttgtggtaaacactatttttttgcttgagatccaattggttaataacaaattgggtgacaatatcctacaccttttttacatatcataattagggctcagtaggtgcttgatgtatagaagaatgtgcttctaataataaaaacccccatattgaaaacaaaacttattaaataccccttgaattatatacagcctacttaaattggcagtacatttagtcccaaaattatggtacacttgatttgccatcttagatttaattttgaattaatttttgaatagtaaaaagtaattgcttctttccagttattactgatctgagcatgtatagaatgtgcccagttctgggcaacatccttggagaaggatgtcagctaactgaaataggttcggaggaagttaacacatttctgaggacttttgaaagtatgttgcctgtcactgctggagctatgaatgcttagtctggaaagtgattacattgacatggttatttctttcaaatattagacttgagtttctccactgtgcactaaaccttgtgcacacatggaatcttccagaaacacaaatattatcagacaggtggtacatgttcatggtaccaaaataccactacatcaagtgcccaaaatatcttaaaggtcttgcaaaaggactatacgggatgtggttttctgataactgccatgtggcaacctacctgtcaagccacctctgtgtatacctcctagactgtgttctaggaatagtcatcccctggcagtatgggatgggtttactctgtcacccaaacaatctgctttttgttttcctacagaaggcaccttaggtggattgattaggagagatccctgtagcctggaaactggttcctaggaaaggaagctgaatcagaaagaatctgggtggggagccctgcttttcctacccttaccctcacctccaaaacaattcccgaatctgcttttatggctaagcagtatcaaaatcagagaatataaaagagagaaaaatgggctgacttgttctttcagtggcacagttccaaagcattttaaatcttaaacattctaaacactactgcagtatacctgggagagctgatactaatttaatcaaggcagaggaggaagtctgtaacagtattccctgtaagctctgacattttccaagggtccagagcctgctgggctccatttgtaatttcttcaaacttctctttttgcaaaaccctcctggatattaaaataccctaggattggtggtaactgcaaccattccatttcatcttatttgcattaacttccagccagacccttatggagggaacagttgacagagttgtttgttgtcaaggaaatggtgggaataatagggaaaaagtatgctctctggtagtcattttgtcaaaagaaagttacatagatttaattaataatgagaagattcttctgtagacttagctagcactcagttaagggttatcaaatcctcagcctggaattttgaaagtgactgggcaatacattatttgactttgtttttaatatatttacctttccaagtatgtgttgcttatactaataatacaattattttgcatttgttggaaatattctgaattagaattgaggtcttgaaaataggtagtgaatttcacaaaaatgtggctttaaagctaagctttgatcaagcttctgttgggtgcaagtgggttaattaattcaatgaattaataaatgaataaacagataaacaaatgcttttttaaaaagatacgagtaaggttctttctgtttctgaaaagacagataagcttctgcccagccaattaagacttaagaagaaggcacaagtggtgagctatggaggacaaagggaaagaaaaggagacgtttttaactggtgttttaggcagaatcctcagtaatgacacattccatttaatagcagttttaatttctccaatcccttctatattcaccatgttattttattttgaggtggtttaggcaaattatcatcattactccatccaatagataaagaaatggagacagacaggataaatatgtgcctaaagtcacatagctgcttaataaattgtttgaggccagatcccagggctcttggcttaaccatatactctttccactagattacctggacaagcaaaatttatgaattatctccattaaatataagccatcagtagttactgtatcttaattgttctctccctcccttccttcttctttcccttctctttctttcttttctttttcctcttccctttcttcttccctctcttctttactctccatttttctttctttaaaatatcacgacattggcaagcattagtaatccctttgccagagaaaatctaatcctcactaacaatgagtctgagttttagattcttaattcatcacatgttgtatggtgggagtggggttggtataaaaatttcctccttcatagaattattctgaggattagatttgattattacgtgaagtgctcagcacaacttctagtacattgagagattaactactcaataaatggtagctgttgatgctgtgatgttgtatgctcaccaagtaacaatgaaattgaaattgataaaaagaaattcatcctcatttcaaagagagggaaatagagtcacaaaatatacagccttgatttgagatgaaacccaggtatgctgtcagttagttagggctatttctgggcaaattccagtcaagtttaatatagtccttgcatacgaaaagatttgtagtgggttgaaaaatacccagctagtgaggaatacatgaatgatctagttaacaataggattgtgaaatcataattatgatttagtggaatgggttgtttctattttataaacaagatgggaaattatttaaagatcaggacttaactagggaaacgtctttggaatatgaaaatgagaattctgaagttaaaagcattagcagaaaaaaataaggcttggagggaagagagacttcagctatggctttgatctcttgaagtcgatatcaaaagccttccttctaagtggaatgctaggatctgtgttcctccagcagtggaccagtggaggtctcattcataatagtgacacctcttaaatcaggcctctcaccctggctgctgacatgttgttgggtgtagacttgacttgcaattgtagatgaagccccatgccaaatggttcaattacagttcagaagaaagcaatgataggataaaggcagtattggtccacatgcattctgaatgtgggcaatttctggcatctctcagccagaggaggtggtttccttttattctcagaactcaagatttcttacccctcaacatttagccatcccccaccatcatccatttctccacattactttgtagaccttctggactgtatctttccaaattcagatttccttggttacaacacaaaccttcccctccaaaggacccagtatctgatgcatgttttaacatctcacttttatgtgttaattatgtggttgtttaggaaatagttggaaactgacttaagaataaggatataaaatccatttaagattcctcttaatattgttgttccccacacccccgccccctaccatctcaagcatctgggcacttggctaaaggttagtgcaatgacacaggcttcctgtcccccttagccccctattttctaatatccatcccttttactttctagatgggcattctgcctgaaatgggataaagctggcacactacctaccagaaaagaaatctttgttttcagacagaagtattgaatcgaatctctcagaggggagcctgaccccttccctctcttcccgccccctccatctggaagagaagagaaacagtgaaattcaaaagttgccaaagtttaattacttctactgaaagtgccaaaaaaaatgtgaaagcttatcctttagtggaaggaacccagagggccctgtggacatttgcagcagtctgtttgccatttgtttttgttgttgttgttgttgtttttgtttttctactatagcccctgagtagcaaatttccactttcttttccaagacgaaggaggacagattgtccctcagagatttcaaaagggtgtttcagattctgccactagagacagaactattgagccatccccaaatatttctgctttaagattcacacaatgtgaaatttcaggcaagcattttcttacaccattagctcatcatatcgaccatccacctatacaaattgtgttaaaattacatccatttctaacaaactcatcggggccacctcagcagatattaaaatagatgtttttcttaggggagcaacaaaaactcaacaaacaagcaaagaaataaaaattacaaagttgtaatatgaaattgtaggcaattagatgataattaacattctcattaaacaacagttatcaattacctaccatatgtcagatctacacacttttatttgttttattataattatttatcatgacaaccctgtgaaagaaggtaatattttcatttaataggttcaaagaaagctaaattttcatcgaggttatgggacttggccaaagttacccatctaatcatgaacagagctaaaatttcaatccatgttttctgatcccgaggccaggcaatatttactcctcagttaactctcaattacacagtggctgaactagcttgtggatcaccacacatttatctgcctcttcttttcctgtgctatattttctatgtgccttaccttttaataatacctgtacagttgggttgacatataccaacctcaattaacaggtaacaaaattttcttttctacttcttagtagttggataggcaggtgaatgagcccaataattaaaattatatataaattattatgaattgcaatgattgctattttcacatttctttttctttctttttttttcttttctttctttttttttttttttgagatggagttttgctcttgttgcccaggttagagtacaattatgtgatctcggctcactgcaacctccgcctcctgggttcaaacaattctcctgcctcagcctcctgagtagctgggattacaggcatgcgccaccacgcccggctaattttgtatttttagtagagacggggtttctccatgttggtcaggctggtctcgaactcccaacctcaggtgatctgcctgcctcagcctcccaaagtgctgggattacaggcgtgagccaccgcgctcagctcacctttctttcatatgtggtagtcaaaactggtgacatgaagaatattttttttaaaaagaacaaattttcaagttgaagatagtaaacaacattgtttgaaagaaatacagctaacattccttcagcttttatcaacaagcctgttcttaaaggaatatccttttcattacaaatgagacatggtaggttttctgtcctgttggtgactttttaaataaaaaaaaaaagaatcttacatctttaagttttctgtgaaatcagcatgctttgctttttgatttctgatgtctctttcttctcaatctagttctttgtggatttattgcacaaatctgtgcagcagctaaaaactgtcctttgatacaatgcaggcagtaagcattaacttctacattgagggaaattggtatggaggatgatggtgcaactggggattggaagccagttgggctgtgtatttcaagctctttttactttctaaatctctgatgtacctggttcattcttaacaacacatggaagacagaaattgccctcagaggttaagacattgacgttgattttgctagtccaatctccagttgaagccaggttttgatttttcagaatatcgcaaaaagttcatattttactgacgtggactcaggctgtatgtgagtgtgtgtgtgtgtatgtgtgtgtgcatgtgtgtatgttgtgtggtttgggctgggctagaggaggcagcattggttgaaagagtaaagaagccaggcatggtggctcacatctgtaatcccagcactttgggaggccaaggaaggtggatcgcctgaggtcaggagttcaagaccagcctggtcaacatggtaaaaccctgtctctactaaaaatacaaaaattagcctggcgtggtggcaggcacctgtaatcccagctactagagaggctgaggcaggagaatcgcttaaacccagaaggcagaggttgcagtgagccaagatggtgccactgcactccagcatgggtgacagagcaagactccatctcaaaaaaaaaaaaaaaaagagtaaagaagaaaggagtctgagtgacaaagtgttctagttattgaattaatcggcttctattctacagactaaggtctgagatttggctactgtggttctgtttaagcaaaatggcatatttgggggagtgaaaacattccttccacaatctccttagaaacagagctccctggtaaatttggcaaggacactcaacagtatagagttttctgcgtgagattagttttagtaaaataatcagtaaagacagagagatggccaaaattatcttcgtctaagttacactccagggaagggatataaagacgctgtttattggtatctgacattattggacacctgataattgttgaacaactcaccattaaatagaatttaatctgcttttgttctgaaatcttgttaagaataaagtgagagtaaaatggtgtttagagacaagacacagaaccagaccctactcctcctctcttgaactctgtgaaattagcatgctttgattaaagataattaacaggcttttttgggagcaggtttagatttatagaaaaattgaacagaaagtagagggttctcatatatcccctttctctcctcccagcttcccctattattaacattttgcataagtgtcgtacatttgtaacaatggataagccaatatctgtattactaaccaaagtccatagtttacattaggatcattctttgtgttgttcattccaatggttttgacaaatgtataattacatgtatcctatgttgtagtgtcatatagagtcgttttactgccttaaagatcccctgtgcttcccctactcatccttccttctttcccttggtggaaattactgaattttaaaaactctctccatagttttgccatttccagaatgtcatatagttggaatgatacagtatgaagccttttcagattggcttctttcacttagcaatatatatttaaagttcctccatttctttttatggcttgatagctgacttgtttttcacactacacattccattatctggaggtaccacagtgtatgtatccattcacttagtgaaggacactttgattgcttccaagctttagctatcatgaatcaggtgcatctggggattggaagccaattggggtttctatttcaagccctttttactttccaaatctttgatgtgcttggttcattctcttgaatgaacctcctcttgaatgaatgctttaaacatttgtgagcaggtttttgtgtggacatacaatttcaactcatttgggtaaatggcaaggaatgggattactgtatcctatggtaagagtatgtttgattttgtaggaaaccaccaaactgtctttcaaagtggctgtggcattttgcattcccagcagcaatgagtgagagttccctctacgccatatccttaccagcatttggtgttttatattttggccattttactgggtgtgtagtggtatctcactgttgcttgagttgtaattccctaatgacttactatgttgaacatctttttgtaagcctttttgacatgtatatatcttttttagtgaggtgcctgttcaggtcatttgcccttttaaaaattgggttattttcttattgttgagttttaagatgtgctttgcttttttgatttctgatgtctcaaggggaatgtgctatagaggaacaactgttatgcaaattttgtgtttctcaagctggggtaaggaaagtctaggcaggcagtgcatggacatattgtcaaaggtttatgaattattattttatttgagatgatatctataaaccataagagaaacatgtattgctaagctggaggaccactttgaaaccaagtcttatcttctttctgcgcctgcattttcattagtatttacaagtgctttaacaccaagtaatgacacaacagtgacatcatttgtttttaatgcagtatttttaaaaccagtattttataatcctgctagtatgtggatatattatctgagatccagaacagctttatccctttctcatcctgcagttcaggtgtttctggagagaaacaccagaaatatcactacaaggttttggtcacaaactacaataatctctactatgttagggcaagactttctttgccttggttagacacaggctcgagctagaaccaaagcagagaagagggactgctctttgtccttttccccaaattcactttccaatcttagatttttaaagtaggggaatgcaagagcaagcaagaatatttgcctaaacacaacgttcttttttctctgttgataagacactatgcagagaaatgtggctcaaactgaatagccttgcaaccttctcactgaaaagtaaaatgcttgggtcctgagaggcataaagtggtagaggcaaagcaaaggaggccttgaactgccttccctgagagaccactatatacgacatgatgctgagctgcaggattcaccagcagagacctggcaggtatccaggcaggatgacggcagcataccggagaactctgcccattgaaaagaacagctgctattcagtgtcagtcagttgctgcataccaaaatgtgggctcaagtcagatcttctgatttttcaagggaagctggaaatctgaatttaatgtaaaatctcctaattttcaaatgttggcaatgagtttggaccctgtgagcatcatgaaacatatctataaatgagatctggcctatcacagggcttccaagttggtgatttttgctccagttgggtttgcatcgctagtgacttgctgacaagaaactgcatcttggcaaacacaaggtggctatgtggaatatgacacgggaagcacactttgcataattttaaagtacgtgacttttttgcttccaaacatatttagctaaactgtgcgggttggctcttgtgaatgcatattacactccctttctacctgctgtctgatccaacccacacaaacccagacagagagatacatccttgaaggtgttactgcctgtatatggataaagattgaggaaaccagccttcctcttgaggagtactagatctcaggctctgcaaagtaggaagagatggaaagagaacacacacaagaaaatcagaaaggaggaggaattcagaccagaaatcctaggaagcagaagttgctaggttgctgagactcaaaggtcaccagccatcaaatgatgtttcagataccaaagctgagaatcacagctgagggcagagaagtctggtgcctgggctgatgcacacttcatttactgctttctatatcagtagctgtggtagggagtattggcacctgtggggtagggtatgtgtagttctaggagttaatttgtgttgacctattcttgggtttaataccgttttagtcgatccaggttatagaactcaatcataggacacattgcattgtctcccccaaacacctcattctcgtgaaaacttcttgttaaaaaatccatttattctaacaaataacttggcataacaaacagaggtcatgtgagaattgttacaatagccaggtgaacaatgcatgctttctcaaaaagttaggggggaaaaagatttgtaaacgacatactcttgtaggaaaaacaaagcaaagcaaaacaacccaggtactcataacaattcatccagatttccctcgactacttattaaatgccaaccatatgctggggttttgtgttctgtttaacagaccctatctcaaatttttatcttaactttaattgtgcccattttatggatgaggccatgcttctgtgaacacaccacttgtgcaagttcacagatcaaataagtagcagagctatgcatccaaaaagactacatgtcccccccatctccaccaatggaacatcaaacttttaatgtctcttaggggcaaaaacattgttttctattagggatttaatttgactaccggtttaaaaaggtgatctcctctttctgtagcataatacattcaatggaagatagtcatttcgtctcttttgacatgacagcactgtggttgtgatatatgtggatagttgaatgtcactaccaccatactgttgggttaatgccaaacctccaacacagcagactgagaaagagaaaaacttagtcaacccagtggttctttggtccacataatagtaaacaaaagtttaagattaagcaacatcaaatacttcaagaaaaattaaaatttttagcatgtgatgatggatttgaaatgcttacctggggcccttagttgtgaagagacactttcttggatgtgaatgtggaatgtactttgggcgacagctaaaaaagtcagcctggggctgctcactgttctgccccagggagaaacagataaacaaaggagttccctagactaactagataatacagtttagagtttaaaatgggaaacaaccaaatccaaattatttcccgcaaatctatggggaagaataaaaggaatgtttctgatttagactttgaatgcaaaaactctgcttcatactttgttgagacgttccaaggtaggtccaaaatcagtacttaacttcgcttccctaatcacatgttttgcttccctaatcacgtatttttttttccttctgtgtttcccaccactttcttgccttttgtctttcataaagtatttgtagaggtcgtgatattcacactgtcctgtgctctggatcagtggttctcaaagtctgctccctgaacttgcagcttcattgtcacctgggaaatgttaaaagtgaaaattctcagatccacttcagacctgctgaatcagaaactcaggagtgggatctgggaatctgtgtcttaacaagacctccagatgatcctgatgtgaggtcaagattgaaattgtgactaaactagactgcaaaattgaacaggacttgtatcttgtatctgctcttggtagcttgcaatttgataatgggcactgcattaaattattagtttatgataaactatatgatataggtatgctcagggtgtgtggatgaacaaagaaagagcaacaaaataaaaatcaatgttttagaggaacttctgtgacactttaaattcagcaactttttattgtctaaagagtgtcaccaatatatttgcatatttgcgatgtgcagccatcttaaattagcagacaccccaaccactggtgatccataacaccaaaccaggaggaaatcaaatttaattttgagaatttttcaatatagatgatgtgaaacatccctttaatgtttttgtctgcagagtcattcagtttttctggggcctagaatttgaactcaaccccaaatcaggagaaagacttagagggaggaatattcaccaatcccaggaagaaagagttaatgtcagatcctacaaggtgaattgcatcctgttgcaatttacaacaggatgtggaaatctttgctgatttattgcagccttttctgtcaaggtattttttcccccttggtaatctaatcagaaagacaacgtacatttctgtgggattttttaaagcatgatactcacaggcaacagaggccagagaagaggttcatattagaagaacaagcctatttgtaagatactgtgaaagcagcagctacatgaaaaaacctcagaggcggaagtttactgtaaactcagggtgagtcaacagaaccacaagactgccaagaaagttaatttgatcttaccctgcatgcacaagtggctggtatttaaaatgggggcaggctgtgagtgttctgctcagtagaggtcagaacacacctggagtattgccttttgttttgagcccagttcaaaggaatttaacaaataaaccccaaatttccaacccaaatcagactctagcttctctacttagtaattgtgagggaaagagagaaccatcaccctcagctggagataaaacctccatagtgctcttcactttttgggagattgtagggggaagaggaaggatgagaccctaagagatctgcctttgaccagcagcaggatgcatcacctccatgagtctttgaatatgcaaatagaagcccctgaagggtagcacaatatgccaccccaaaatatgctagccacttttgcctaaggataattttgagctaaaggcatattaacaaaaaataaaattctaagctcctgaataaacttaggctgaatgggccctgccttggccaaggggattccaaaaaaacctgaagaactagttcaggccatgatggggtcgggggaggggaaggatgggggtctgacatgcctcatcacaccctcctcccttcggagtttagacaacagtgaccggcattaaaacagagatcttaagactgacaaaacagactcattatagcaagaaaataccgaattccaacctgactctcgtacagcatcacaggacagcaggccctgaaggaaatgaaagtattttacacccaaatatatttctttgacgtattttgaaatggccctgcaaagctgtctcttgtggggaaaatttgcactcggtagagaaccttctttcttactaggtcttttccagagtgtctgacaccttttaagtttcaataagagaattttaccatccattctctctgaagccggctggcctgaaggctttatctacatgacaagaaccttggcttctgcaatatccctctccccttaactgaccttaactcaagctgatttcaattctttcgaccaattgacaatcaggaaatctttgactccacctatgatctggaagcttccctgcttcaagatgtcttgcctttccaggccaaaccaatgtataccttacatataatgattcatgtctttgtctgtaacttttgtctccctaaaatgtataaagccaagatgtaacacaatcactttgggcacatgttctcaggaccacctgaggctgtgttacaggccatggttcttaaccgtggcaaaataaatctctaaattgattaagacttgtctcagatactttttggtttacaggtaccttaaagaagaaaacaaattaaagcaggaatcggagcgagaggtttgttggttttggaacgtaagatcccaaaccattggagaactgcagcatggtgaaggcagtcgaggtcccatgaacttgtaggtgactttagctggatctaatggggcagtaggacaccggttggtgcgtggacagttagtgggtgagaagacagtgtctggcatgttcaaagctgcttagccagatgagtggcaggaggagctgtgggcatttagctcagacagagaaggcttgctgtgaagtacttaaaggctgccatgtgaaagagagattaggattattcagtgtgtttataagagctagaactaggaattgtaaagtaggaaattacctgagccagatttcagatcacagaaagtaagtcacgagtacttaccagctacctaaagaaggcatgacgtttcccagaaagagggcattttctattgagggatgaaaacaaatgttggttaaagcccaagctctgctactccaagtaggatcttcagaacagcatcatctccatcaccagggagcttgttagaaatgcagaatttcagaccccatcccagacctactgaattagaatatgtagcatagtaagattcttgagtgatctatatgcatgttaatgtttgagaagtcctgagtgaaaagaccaatctctagggatgttattcaaagtagttcaaataattaatggataggtggattcctttccatctcctaagggaggtggggtaatgtgctgctgcaaactttgtacggtaagggaagaaacttatcccgctgagttgttggttttaataaaaataaatcctaagaacagaagaatgtgcaacccagaactagttagctggctctggataatagaagattctatctgttttaactgtaagcatctattacactctgccaggcactgggaataaaacaaaatgaataatatatgcatcgagctctatgtattaaactgttatactctgcccctaatggttgaaatcatttactgaccctggggctcttgccttaatttctggatgaatttagctcatccttattgtcactttcttccagccctgctcttttcttaattcttgataatattgctgttcacatgaatacccaatacctggaatactccaccttgttctattgttttcttagtatttagcaccttcaagcacttttataaattattttcttatttagcatttgtgtggtctgcttttctttcactagaattacatgtttcattagtaagaagatttaggtatggtggtaccctgatggaatactgataaaacaggtttgaaatgagctttgatttgtagtgtttgccaatccctctggtgtaaatattcctgtcatggccagtttgaagctactgttactacatcactgaatgtgatgttaggaaaaatgtgcacaattgactcttgtgagctggcctgagcagcttccatcacacagttggtccctagaacagtgttatttagaacagtgtcaactccaagtaagtgctcaaaagatattttttcatttacttaatgaaggaatgaagtggaaaaaaccagattgtcatataatctactgatcgtaagaagaaagtgttgtgtagacaaagagaagagacaattaacagtaactttatggcctattggaggcttctttctgaaggtgacaaccaaactgggtgtggagttgaccaggcagtgaaggtagtttatagagaatgagcaaagttgttctaagatgagcaaagaaaactagaatggtgagagttcatggcagggcaatttggataaagtaattaggataccaaaaggatgggcctttagaaaaggttaggactagaatgtcaaatgtcttgagtgacacattaagcagcatgttgagggtgatggagagtcactgaagaaatctaaaaatgagagtaattctagcagatttgccttccagatgcctctgccagcaatgcgggagattaattctagcattggaagtagagtagagggccagggagactaaaaacagactattgactaaaaaccagcctaggaaaagatgtgatgagggactgtggtaaagactagagtggaggaatgggatatgggaacacatctgagagctcttcaggagtaggtttgatgcaggtggtgtccagtgggatctggggtaaggaggaagaaggtaagatgattatgagattatttgatggttactgtggctttaactaaaataggcaacacaaattgcaggaacagatgtagaggaaatgaaaaatattccttgtgctatgctgaacctgagaaggccacacgccatcccggtggagatggcacagtggagaaggcaataaaccttccatggactttgaggcaatctaatctgagtgtaacagagcactgaggctccggttcacctctggacagctggcatgggtgcaaagacattgattgacatgttaagaagattcaaaactactcaaagccacagagttagaaatgtgagttttatattgtggacagaggttaaaaaatagatttaaaagtcaacaacatatataaaagttctggaagcagatggaaactcagggaaagactgttgtaaaatgaaaaattaattaatagggatgacagtgttggggttatacatacattgatagggggcatcaatataagaaaagatgtcaacaggaaataaaaaaaaaatactcccacggaagtggaaggtaaaccacagaagaaaagagtttcaggaggttggggcagggagattaagctgattaggatagcaattgtcacaatacaataaaatgaagatgggccaggagtattggctcacccctgtaatcccagcgctttgggaggctgaggcaagtggatcacctgaagtcaggagtttgagaccagcctggccaacatggtgaaattccgtctctactaaaagtacagaaattagctgggcattgaggcaggcacctgtaatctcagctactcaggaggctgaggcaggagaatcgcttgaacccgggaggcagaggtagcaatgagccgagatagcaccactgcactccagcctgggtgacagagcaagactcctccacttcaaaaaaaaaaaaaaaaaaaaaaaaaaaaaaaaatgaagatggaaaacttgtcgttggattagattggtggtcattgtatgatgttactatagaggttggactgtacaaattgcagtgggcagggtgataaaatgggaaaggagaaaagaatgagcaagtagaggacactgtcttcaaaatgcctgatcaatgggtaaatatagaactagacacctcttgtctgattttgttattgatttaacttgctgttgaccctggcacagctttatcctatgcctacataatgttgagtcacttgatgtttctatagagtcatagatttggaaatattgttatacttggcttcactcagacaaaatatttggttgattaatgaattgttaccagtcacctgtcactttgtcacatttcagacatatacttcgcttgtccatctctacccctcaatttcctcctccttttgtaaattatacttcaataaagttgactcaaaaagaagaaaaggaaagaaactgaaagggctagtcctatgtctttagctcacagtaagtattgtgaaaagggacttttgctacttcatctatctcttctgcttcttctgtcaccaggagcgattgcttgctggtagggcaggatttgtgttgtaatcctttaccatcacaaacattatgatcccatttccagtttaaatgttatcttgcctcctttaaccttcactctctgctcacatgtaaaaatctattcctcaagtcccttcttagccttagcaaagtacctttggcctgacttcccctttgatctgtgatttctaattgcattctataaagggtcctgcttttacacaatttattgaccctttgacaggaatttggactagtgtcattcgacagaattgatgttttctgcaatctgacggctgtttggatttcagagtcgatagccaacaataatattcctgtgacctttcagagtcactgttttcttctgctgtaaggactagacacatgagattggaaagaactgcccaaactggctttcttccattcagtaggagaaatgatgcctctgactaaagtcagaatgatttacattaaaaatataaaactctctagtacagaattgagcatgaaattcctcctgtctactaatcaattgtatgtatgtaaatattctgtaatttatgatgagttctgacaattggagctacaagtggtattgtcaaattttcgttcaattggtaagaatatggtattgtcaaaactgtgatcataggtatattttttatttttaaattaaaaagctttttcatttcttgggctgtgacataagtatataatatactaggtagacagtataagattgctgtttcatagatcagaaatggttaataatggcaattctgtgtgattcaactttatgcgcacacacacacacacacacacacacacacacacagccagccagagcgagagagaaagagattttttcttaaaatgcaagtacttcataacagaagtttgatacgaaagtgttgatttgccatttcaaaaacaaaacatattattcctattgggtcaatgattatgcaatattagtggaataatattaattgaggacttcctatgggtaaaatatttaatcataacatttctataaggtagaaactgagcagggcttcccactatattatacttctgcctgagatttaacatttctcatgcatatcttggaaactgaagtcttgatggaatattcattagagggggctaattataaccaacaaacagaaatactctttaattccaaactatgcaggatgctactaagtttgatatcagagaagataatttaaataaagaaacaggaggcaaaaaccatgtctgcctagtcttgcctttaaacaactgcaattttgtttaagaattactaacttcttggtgctatggcaacttatttgcaagccattaggatgaggctaagatgatttaaagacctctccccactttagatggggctcattacattcctgatgacaccagcaggtctattaaggtgataaagcaaacggagctaaaatatctttctccaggtttcctcccagggccaccctcatcagactcatttggggcttttattaaaaatatagatctctgggctctagctccagacctactgaatgagaatccttagggatgaggcctagggaatctgcatttaattagcttttccaaatgcctggaattttgttagtgctatgtaaatgaatatttatgtcacatgtatagtgctaataattcttaggcatctcaaatttgagaactgctaaaccagagagtgtggtaagacatgcagatttatttgatcctagactcccatccttactgcaccagaaaatgggaaagtggatcatagactgatctactgaaatctctggtaaagacatggagtttttctaagatgcccgttttgccctcctcattacagaccctccgtggatcctgctgtctcaggcacatccctattttgctggaccctctggcgctaactccttctcttgggatacaggttctgctcctactttgtagttgcttgtcctctcagaatgcagaaaaaatgtaggcagtaactatcattagagatcatttaggttctaaaagatttttaaaaatgactttcagttcagaaaatttcgtaggcccttctgtaatgaggaccctcaggggtctgtggccagagtgctgaggttcaaacctctttattcactcattcatttaaaagctaatatatatatatcaagtgcctgctatgaatgaggcaccatactaggcccgagagatacttattatcaattataacgtcaagcatataataagtactcaatatatcttttttaatagacgtgacactgaacctcctacaatgcctttaatttaccagtgacccatctacacttggtgtgtggcctaaggtcaaagatcacttactaatgtggaagagccttttaagatctacccctgacttccacttcttccctttctccatgcttctttctctcttttaatgtcctaaaacaaaatgaaaagttcagtgggaaatgataaagttcagatttcattagcttttgatgtcacttttccttggggagaaaaatcacatttttgggtgacctttttagttaattcacagctgggagaaaatcacacttagtgtctttcctgttaagaggtaattagacgctgctggtcagtgcagtcctatgagatgggctgtgcggtgggggtgaacagaagcaaaatattgcactcatccttttggcctctgattcccagcgcctgggccacagtggccattaaaggaacgagatcagtaagtgacaactcagactgtgacaagcagtgaaatagaggtacaatacccggggcagagagggctcactgcagacctgggatttagggaaggcctcagaagaaggaacatttgaattgaaccttaaataatatatgctaagcttcaaaggaactgaaatgtacatgcacacgcagagagagtgggcaaacttgatttctacaagagtctactcctggatattcctataacagagctaagtcacactgctgctatcaggacccagtctttcctgctgatgggctttccagactcactagtgttagccacataactgttcttccagaaatgctgggtgaagacggatctcagagtgtttttattaaaacactgtggtctccagtaatatcacttatttgtgagtttccccaggtggaaagggtccacaaaattggtggtgtcaggtacgattcccataagtagaagatgaaaagaaagatccatgaggtcacatccagtctgtctctggaggatcagggcaggaggattccgggatgtgtttattttctagcactctgtccacctcagacttacatgtttacatttatatagcacctttcctcaaaggaaatgacttcactcgtggaaaagcgaaaggtcatttgaaatttgagttacatagagaagcaataaacttcacgctgtcaggaggttgcgctgagactttgtgaatgatcctttgtggattgcaccccatcactcccacttacctgcttgcctgtgtgagatttttgtatgctattccacacttgtctgcatgctgacctctcatctcccagacagctcctttggcttccccagtgaccttaattatcacctcatcaagaatacatatttagtgcttttaatctgtccccagaaatcaatctatcctctgcatgcattacttttgtttaacccttttatcaatttcctaccttgccctgctgcatttctactttctggtttgaagtgactcagaaataatctatcttctcattagagcctcgtaaaaagggactttgcaacctgccagctatgtgatttttccacctctgaaagtgaactttgaaatgatattagctcctttttttttttctatagcattgcatgactggtctaaatccgacttgccgcctgcatgtctctcttcacggctctttttcaagtcgcctgcgtgctttgaatatttctcttcaaagggaggggctgctctttccctccagttaaatctctctattattttctactctcatagctattgctgctaagttcctctgcatctctcttctcctcgctttcctggaatttgcaaccctttctatttggagtcagctaagagtttcttttgtgtgaggtcttctttgcactttggccatgaatataagtgatactatgaccaaaggtaacaactgtgcttgcagatttcatttggttatagggctgtgcttttacatcttccttaattgttataatatgttgatcaaggatgactcctctgctatagaattcagggaagtgaactgggatagtgaaatgagtacaggctttggattcaacagatcctggttcaagtccttgctctgccgttaccagcccaagattttgtgttagtaaaataaagatactgtaacaaattattataaacaggatggcttgaaagaaatttattgtctcgcagatctggagggcaggagtcccattccacatttcttgcctagcttctggtagttgccagcaatctgtggcattcctcgccttgtagctgcaacacttcaatctctgcctccatcttcacagggccatcttctcagtgtgtctctgtgtctctcctcttcttgaaaggataatagtcattggatcttagactcactaaaatccagtatatcttgagatccttaattacatctgaaaagaccttatgtccaaatcagctcacatttacaggaactgggatttaggacttggagatatcgtttggaaggatactattcaatgcgatatagccttagtcaagttatttattctctctcacactcagtttccagaatggttgttgagagaaataaatcataaaatgtttagaaagcctctagcatcatggcaggcatatagtaagtgatcaatgaatattaattcccttttccaaaatttctattactcctttggtaggactttttagaaaacaaatacaatcttgttttacagagtaggacatttttagagatctagcgttacatcactatatgcaattagaaaccagcttccctctaaataattcatctgcaagacaaagatgaaaactttgataagaaaggggtcagccaggtgtagtggctcatgcctgtaatactcgcaatttgggaggctgaggcgggctgatcacctgaggtcaggagctcgagaccagcctggccaacatggtgaaacgttgtctctactaaaaatacaaaaaaattagctaagcgtggtgctgggcacctgtaatcccagctactcaggaggctgagtcaggagaatctcttgaaccaggaaggcggaggttgcagtgagctgagatggcaccattgcactccaacctgggtgacaagactgagactccatctcaaaaaaaaaaaaaaagggggtagggggtccacacaaaaaccagacaggcctatttttttcagtctataaatatttactgagcaactactaagtactaaacactgaccaaaagagaccagtgaccagtcatcatggaaagatataaaatcgacaataacacaaaactatgaaatataatttcaagtaatagtaaataaaatagagacaaatgaaacaggatgaaaagatggagcactttgaatggcaggagaaatgatgacctttgggaaggtaacatttaaggcaagttctggataaagtgaggggtcatcccatgcaagggactgggggacacacgttctagaccagcaatcctcaaccattttggcaccagggactggtttcacagaggacaatttttccacagactacgggtggggcatactttcaggatgattcaagggcactgtttaccgtgtactttatttttattaatattacattgtaatatattatgaaacaattatacaactcaccataatgtagaatcagtgggagccctgaactcattttcctgtaactagacagtcccgtctggaggtgatgagagacagtgacagatcatcaagcattagattctcaaaaggagcatgcagtgcagcctagatccctcaagtgcacagttcacaatagggttcgcacgcctatgagaatctaatgccaccactgatctgacgggagatagtgctccagcagtaatgcaagcgatgggaggtgcctgtaaatacagatgaagcttcactctctcaccctccacttacctcctgcctaacaggccatgcagcggtatcaggtggggacccctgttctagagagaaggaatcgcaagtgcaaagcaggacagtcagggtgtgtaaggcagtggggtatggggacgggtttggaggaaggcaggagctcaatcatgtagagcctggttggccagggttgggatggggccatcataaatgctggatgggatccagtgtggctggcagagcacagggtttgagggcaacagctactgctagctgtgattcagaagggcagtctgcagtgtgaattgagaccactgtggctggttctccagacactggtacagctgtctaggatatgcagaacttttgcctcgttttccaactctaggttctctctactgccattctctttgttcactacccaaactgtcctccaaccacaggaatgtcaccagctctggatgcttgttcttgctctctttattttatttttgttatctgatagaagcagacagtaatactctgagatacttctaggaaccagtatatgacaagagatgcatttcaccctgtcagttcctccagcacaaatgacatgatagtgcttttctaaataattttgcaataattcgaaatcctgttcctccaacacaaatgacatgacagtgattttctaaataattttacaataattccaaatcctgttaaatcagtgcatacacttctgtggattttactgtctattcacctgaaattaaattctggtgggctttgctgcacagttcacctagaagaggcacaattagatgcaatctcattctagtctgacactgctgtgctaaatactttcattaaaaactattttctcaaagaataaaagcaagcataaaaaataaaactaggggcctttccataagagaaagaatagagattgagaggaatgggaggaagggatactgagtgaagaaaagctaaacaaaagcatggaaagtcaaagaagcacacacatgtgtgaatagcatcatctaattgtcctataatgaattgtcctatgtcagagcatgcctgtcaaattcttctaaacttctctaggcaggcttagaaaggtaataatattctagttctcattattgggaagtcacaatcaagagcaagtgaattgaatgttaaaagtatgagtctagctgatattgatagatcaaatgtaatacaacagcatgtgacacttattagccttttggtcaagctattgggcatggaacacattcaacatgcagtaacatttattgagcacctacagtatacagtgccatggtttgagtaagggctctgtggaatggaagacatatcctctgtcctccagaagtgttcaatatcgattctgagtcatttcctgtggccttcactttttcagttcttcatatctactttcttggaaggtattctcaattaaggcccaaaaggctgcacataaatttaattaaggctggaagtggtgctagacagtggaggagcagtgagcctgagctgcagccaaaaggaggaataatccactaactcaggagagcaccctttcttccccagcaaatgcccagtgcactctttattaagggacactgtgctgtgatgagctgacctggccacagggtgtcacaactgccccagggactcctctacaaactcaggagggagacaaggtctgaaaggtcagacaccagcagcttgtcgttccctctcctgcccacattgccaagtgagtcagccctgagtcagcccagctgctcaaaaatcatctagaatgtcacggctgccagggcctgacagaatgccttcagagctgcttaccaggctctgtgtggctcttggtctaacggaggggatcgacattttggcagtgcccgtgagtgagatgaaggactggtgacagccccacacccacgcagcaccggctccctcatagacctccagtcattcgaccaggtttgttcctggaaggatctgcatcatttatttggagaaggaccaggcagggggtcaagagacaatgattttagtgtcggctctgcctccttcaagttggggaccttcagccactgaatccacagagatgggcctcagtttcccaatctgtaaaatgaaggtggatcctttcaacttctgaacattaatgaaggattggccatgtcttatttggttagacatttcaattactttctctttttttggctctgacagcctccaaggtagaagaaattagcgtttttttttttttgtttttgtttttttttttttttacaaacacagaaactgagggcctgtgagactaaaagaaggtaatcaaaagagaatacagaggagacattttaatccagatctgtccagattaatcccactgtaattggggtgttcatttacaaactacacacaaatgttttgtgactcctgggaactgagtttcagacatgatgagatgaaagacacagagaatatatttgaataagtctcataaaaagtaaattctggatctttgggatagaagctaagggatatttgtgaatcaaatggtagtagcaaaatgggtcaagaatggcaggtaaaggataaacagaagagaaacacattttaataatactcaaccaatatttattaagtttctcccctgaaaaagttattgttcagggcagcaaaagacatgcaaccctagaggcagctgagaatccagccatgccaatatccgaatgcaaataaaagcaagaaaaagccaggaaaaagacaagcaaagtactgcaggattcaatcaagaatcgaatgaagaagctgtatcccattggtggaacttggaaggcaccaaggagaaagtttcaattgagtcataaagaatagtagagtatcaacaggtaataacacaaaggatgagctagctggaagaaagagatgcatgaacagaagtcaggaaaaaaagggttgcatttgattgtggaagacagtgtagcaattcctcaaagtcctaaagacagaaataccgttcgacccagcaatcccattactgagtatatacccaaaggaatataaatcattctatcatatagacacatgcatacgtgtgttcattgcagcactattcacaatagcaaagacatggaatccacctaaatgcccatcaacgataaactggataaagaaaatgtggtatatatacaccatggaataccatgcagctgtgaaaaagaacgagaccatgtcctttgcaggaacatggatggagctggaggtcattatccctagcaaactaatgcggtaacagagaaccaaacacagcacgttctcactttaagtaagtgggagctaaatagtgagagcacatgagaggaacagcacacactggggctttttggaggctgcaaggtgggaggagggagaggagcaagaaaaataactaatgggtactaggcttaatagctgggtgacaaataatctgtacaacaaaccttcatgacacaagtttacctatgtaacaaacctgcatgcatacccctgaacttaaaacttgtttttttttaagaaaagaaagggttacatttggagaacagtgaagactattctgttgaagtgtgtaggggacataggattggaaaagttcctctgaaatcatattgtggagagccttcctaaaagacaattttgagattggtggacaatggagaaccaatacaagagtaatatacttttctttttttttttttttttttgagacaaagtcttactctgtcccccaggttggagtgcagtggcacaatcttggctcactgcaacctctgcctcccaggttcaagcaattctcctgcctcagcctccagtgtagctgggactacaggtgcctgccacaacgaccagctaattttttttttttttagatggagttttgctcttgttgcccaggctggaatgcaatggcgcaatcttggctcaccgcaacctccgcctcctgggttcaagtgattctcctgcctcagcctcctgagtagctgggattacaggcatgcgccaccacccccagctaattttgtatttttagtagagacagggtttctccatgttggtcaggctagtctcgaactcccgacctcaggtgattcgcccacctcagcctcccaaagtgctgggattgcaggtgtgagccactgtgccctgcctgatataatttttataaagaagtttttgcctattgtctgggcatggatgctggaacaggagatgggatgccagaggagaggttagtaaaacagtccttaaaataatctggtggcagaggtgagaatgaggaggtgttagagataccaaggtacaaatgtgaagacttggcctctgattaaacacaggttctggagtattagagacagggcaaacagatggtggagtttttaagcctcagtgggaaaacgaaggtgctgttaggataagcagaaatatcataatgagtggcaaattccaaaaagcttacaagaggaaatacataaagagaaaagaagtatacaaatggaacattgggaagaatttatgtaatgcagtgaaagaaagaaagtaaagctaatgaaaaagagaaaccagcaaccagggtatacagttaggaaggaagagagagttccttgaagaaagcagcagggtcagtagtggcagggacctcaggggttgagaaggattgagacaaagcctttggaaatgctgtgatgagtgctgttttcacatctttgccattttctctgaacatagagaaattctgtctgtgcctgtgtatttgtagcctccaacacagcgtcctgcccatcaaaggcgctcaatgaatatttcctgaatggagaaaggaaaacacagacacggggctgtttaggagagctgtaggcatggaaacaaaggtgttaagagggagtgccttctgagtcttgcaggtgtcctctgtctttccaaatagttctggggagaaggcagttctgggctagtgcagtccttccagaccttgagcatgcatcaaaatcacctgtgggtttgttacatagcttgctgggccccacccctagagttttcgatttgtaataataggtctgaagtgaagcccccgcatttccattcaaacaggttcttggatggtgcggaggccacaggttcagtgatcatgctttgagaacccctaggcatgtgaaaatatccctgtatattcagttaggagacatagtttgagtcccaactccttattggctctttgccttgaggtatttctctctgcctattttctcatatgcaagatgagggtcttacctagaacatagcactgataggcgcgttgaatgaaatctcagtacttgtctaaaacatgtttattgaactaattttttttctttaaaaaaatttttggctgggcgcagtggctcatgcctgtaatcccagccctttgggaggccgaggtgggtggatcaggaggcaaggagatcgagaccaccctggctaacatggtgaaaccccacctctactaaaaatacaaaaaattagccaggcgtggtggtgggcgcctgtagtcccagctacttgggaggctgaggcaggagaatggcatgaacccgggaggcggagcttgcagtgagcagagattgcaccactgaactccagcctgggagacagtgagactccatctcaaaaaaaaaagttttttgtttgaaatttgatttatttttaaatgtcttcagctttaccgaggtacaattgacaaataaaatgtatacagtatattaaaggtgtacaacaagatgtttgatatacattgggaaagagtcatcacaatcaagctaattaatatgtcagtcaccttacatcgttaacttttttgtgtatctgatgagaacacttaagatctggtctcagcaaatttcgagtataccatagcttcttattagctatggtcaccatgctgtacattaggtctccagaatttactcattttatagctgtaacatttacagctgactaacatcttcccattttctccaccctccagctcctggtaaccaccattctacttggtttctatgagttcaacttttttacattccaataaacatttttaagaagataaagattggttggagcttgagaaagtaacaggaaggaaaaaaatgtgtttattttgcttatttaagaaatgccaagatgcatggcaaattcatgtttgctgggcaaaagatttactctgaattaatggatctctgtggaatagcagttaattttagagctggcatgagtcttatgattatctgcatatcggtcagtcagtttgtctgtgtgaacaggacatacgaagcctaaaggcaagctttatcatcttgcttatacaaagttaactatagcactcaaaccccacacattcagaataagaataaaataacgcaccctttgaatcatacataggtatgtaatttgcttccaataaaaatggagatgaggttgcagctagataaccatcagcttcgtccaaggtacaaaggtttaattttttatgtttgcatttagtcatttttatagtactggcttcttggctcatttctgaataaatctaggcagcattgaaacaaatgccaaagaaacaggaaaaaaaaccctctcagaatttcccgttcatatttatagtgagttgacagatattgcatttcctttatttcaggccctaatcaattcattgctaaaaggaaaaaaagagaaagaagaaaacagatgaagaggaacaatttgtatggggcttctggtcattacccttctgttataactctccttagtagaactaattagcattacattaataaatataagaatagaggatatggcagccaaagcagatgcttattgcaattgcagatacattgctgccatttgcttgttaaattcagcatctttaattctgcaatgtggtgctttgaagaggatgaaaatttctccttatatgaatcttccttctatgtggtcaggatgcaagtcatagggtgaggcaaagtggccatgtctgtccaacttcctttgtgtacaaggttaatgactgtgttttgtgtctatccctcaggcattatgaatccagatccttcacattctaatcttgctcgcctcttggctgttggtgagatggtggccccaacactgacaaaaagaaccagcctgttccatgatagtttctgtggaactcagcgttggtcacttgtgtcactgtaccaacagggacacctgaatggctctgtcattaataatggaatggagagccagagtgcaaaacagactccataggctgactcccacacttacgggagggcaattaagggcaataagtgctaagatgcaagagtgctgtgcttctcaaaacattaatcttatgcaaagaatcacctgggcattgtgttaaaaagcagattgtggctccacaagctctcacggatgcaggtgctgctggtccatgagccactctttgagttgtcttaattcctttcccttctctcacctgagccagaggtgcatttcagcttcttcaatttaaccttctgtcttctgtgacaagaacaaagtgagctctgctcagatagctcgagaggacaacatagctatttttttccaaagtcacaaataagtaaataaataataggtaaattagcaggattgctaaaagccccttaatttttcctttcaaaatgtagaggtaagtaaaagcaaatgaaccagattcttggatctgttcaaacccggagagcgcaccaacagataacatgaggaggtgtggagcaacgtgctattttaacgagcgcctgagtgcaggtgggctgaggcctaaaatggcgtcagcctaggtgaggacaggacagaggttttatagcctcctggaaacaggaagtgtcctagtctgacataactgctacttggtacctggaaggcctctttctccatcttcaggggtgtctgccagccagggtaggtgtcttccgtccggctctcttcctgcttctgctatcttgctgacacacgctggtgacacaagtggccttgggccttgggaccaggcctgagaagggaggagttattcatctccttaagctttcaagtccctgggagaatcttacagtttcctcttgtcacagcttccttaggaggaagtagggggagacgtaggtttggggagaaaaaaaagtcatattcattgagcactctttgtgctatgcttaacaaacatttcaatttttaatcttagcaacagtcttaaggggtcagtaacagcataagtcaaagataaaggaactcagaggggctgagagagattcagagagattgtgtgacttgccaagagtcaagtttactgggaagacctaaagcccatattcctttatttctaaaatacatgtttctgacttactaattctttgagacctgtagtttgagttgaggcctgctggcatcttttatttatctcttgcatcctttctcatgagatgtatggggcagcctgctaatggaacctcctggaaggatgaacacactccctgatgggaggtgtggttcatgggagttcccagggagatgcagaagaaggctgtttagggtagctagagggcccagtgggttctcatagccaaccccaggtcctgaatctgttcctatctgaatggagcctagagcctctttctactgcctctgcctccatccccttttgttgatggtttcttccctctgttctcattgggttccctgcttcgtactagttttaaaagttaattaggtcggccaggtgctgtggctcacacctgtaatcccagcactttgagaggcccgaggcagaaggatctcttgaaaccaagagtttgagagcagtctgcgcaagcctagggagaccctatttccacaattttttttttttttaaagttaaccaggagtttgagggcagtctgcgcaagcctagggagaccctgtctccacaatttttttttttaaagttaaccaggtgtggtggctcacatttgtagtcccagctacttggaaggctgagggaggaggatcacttgagcccaggagttccaggctgcagtgagttatgatcatgccactgcactccagccagggtggcagcgcaagaccctgtctttctctttaaaaaaaaaaaaaaaaaaggctggccaggtgcagtggcttatgcctgtaatccagcactgtgggagactgaggcagggaaatcgcttgaacccaggaggcggaggttgcggtgagccgagatttcaccattgcactccagcctgggcaacaagagcgaaactctgtctcaacaacaaaaaaatgttaatcatgtccatttgaattacgtagttgcaactcatgagaaaggaggggagttttgtagaccactctactattcaggttgttcagaccttgcttctggatgtctcatcaagattctcagattctctcacttccaaccttactaccatgacaataactaaatctcatcatgtttttttttttttttctttttcacaaaggcttccttctctgtgagctcaaactaacccatgtaatttttaggtggtgttgcctataagtaagggcttctgagcaggtgtattcattgccactgctcttaagatgcatgtgtagtgttagggatttcttctgccagcgtagttttgtttttgcagttaatttgtaaaaaaggttttgctaatactactgccttttttgtttcttacctttcttgtcattatggataatttttgcttcaaactaaccatacttgattcacttgcatagttcaattattaaccaaaaagcctacaaaaacacaaaagcaatatttgaagacaaaatggatgagaactttgtagacttgatgaacattgtgaaatgtaacattaggtagacataagccattctttatatgataaataaaaataaatctacacttagacaagtagtaagaattcagaacaataaagacaaagaaagtatcttgaaagcaactacagagaaaacatagattatctgactaccatttaatacttacaaaaaagtggtgcagctctgaaaaaaaatgctgtgttgtgtgataatgaatggatagaacttaggtgaatgttagcttttatggtttcttgcacacacgttaattattacctatatcattaagacatatcagattagttttgctgtgtttggttgcaccatgaattttttttatgtaatatggtcacctgctgctaagttaaaaaaatctctatcaacaggacctgtttatgaaatgatatatatactgtaacatttgacatcatggatcatcttttatgtactttgtttactgggaagtacttagaatgctacatatatagtgaactctcagtaaataaatactgctgaaagaatattagaatctttgctccttagcagaatttttattttaaattttgatggttctttatataggtgttttctaagtggaatgaattaatcccaagggagtaaaaaagatcattctctgaaatatttggaaaaaaatgttagaacttctgtcttatatttcaaacatattttaggggatgtttcatactatatgctatctttgtactgtattatacacagtaatatgtataaatacaatattttatgtgtgtgtatatatatataatgtatatatatataatgtatgtatatatatataatgtatatatatataatgtatatatatatataatgtatatatataatgtatatatatatatataatgtatatatatataactttataaataatccaccacacataaagtgaggtgaatgctcaaatgctaataggcatgcacaatcaaaagtgtttggaatgcaaatcaatatcagtaggagataccacttcacacccattaaaatggctgaaataaaaagacagaaaatagctagtattggcaaggacgtggggaaattggagccctcatactctgatggcgagaatgtaacgtggtgaaatcactttggaaaacagtgtggcaattctttaaattgttgaaaatagagttactatatgacccaactcttccatggctgggtgtatatgcaagagaagtgaaaacatatgtccacacaagaatttgtatgtaggtatttatagcagcgctatttataacagccaacaagtagaaacaaccccaaagccggataactgatgaaagaataaacacaatgtggtatttccatagggtggatttgatggaaaggaatgaagtactggtacatgccacgacatggatgaagcttaaaaacattgcgctaagtgaaagaagcccatcatgaaataccacataaagcacaattctatttataggaaatgctcagaacaggaaaatctatatagagagaaagtggattactggttgcctggagctagggaaatggaaaatgggaagtgtctgctaatggatgtggagtttctttttgaggtgatgaaaattttctaaaattagatagtggtgaggcctgtacaactctgtgaatatcctaaacaaacttgtatactctaagagggtgaattttataatatgtaaattatttttcaataaaaccatcataaaaaagaaaaatgtgccaggaaaccactactttagataaattcacacaaacttgatgaagctaatataactgaaaagactctggcaataaaaatgttccgtttcatttgcattatgttgccgcatttgttttatctctctttaaatagcataatctctaaaagacattttttttctttaaattatctctataagcattgacttaacaagagatggcatgtttcattttgtgtaccctcatggtgtctaaagggaacgccactagatgtatattgaaaaatgaggacattctgcataaacaaaactgataaaattgttttatgaattaggagaaaagtaatttttatcagatttgtaatgatatattctcatttaagaggctgtggagaagagaaaagaatgagtgcttccttcatattttcttcttttaagactaaaagaactagagtttacccataatttcttgtcttgccctattttgggtggcaggggatataatcatttcttctttctcctcctcctccccctccccctcctcctcctcctccttcccctccccctccccctcccctcctcctcctcctcctcctcctcctcctcctcctcctactcctcttactcctcctcctccttctcttgcccctcctcttattcctcttcctcctcattgctgtgtaattatcaagggcaaagtactgttgccctgaactgcgattcaggttgctgtggaggtaacttagaggaacaactcactgttttggctctctgttttgaaggctaatgtaacagactcagctcaacaagtgatattcctgccaggctggacgtttaaggatcctgatgtatttgagagttgtcttgtgttcttactcaaggaaaagtaggtgtgctgggtctagcagtaaatacagcttttgtggggccttcatctaataacattcgggagttcctctataagaaaaagattacatattacaaatataaaaatagttacaaaagtgaatatttagagtgacaaaagatatcacccatcacataggtcaacatgctgccacattccaacatgagattaaaaaacataatttatttcaagcattgtgtctcattcctctctcctctcagtgccaactgccaaaggagttatcaatagaactcctggccctaacttttgtgtcccaacattgggtgagtcagcacagttggagataggagagttattagaagctctaatggtgggatggtagccatgatttaatgacacattggattcactatgaaccatataagtgggtaccactcaccatgaactaaatagatccctaaatcatctcctcctcagtgtgatgatcaaaatgtccaggaacactgctttaccataccacatgaggggaaatatgatggaggggactggaaaagtggcagtatcggagaggggagacagcacagtgttaattcattgctgctaaaatacccacttctacaaattttataacagtagggccctggaaggagcctgttagcaagggcccatgaaacctcaccttctttagtttcttaataaatatatctccactgatgctctgtttcagagacattttatagatgtctagtcaaagaagtccattttcaccgtttcatctggacaattttacaggagtaatgatttcaggacattttgaaacattccgatttaaaacatacagagaagacaggagaggagaagaggggacatgagaaaagtattatttaattcatcaagatagttttttttttttctggaacatctcctacatttaaaaaaaattcctattaggaagacacagagtaaaactttttcccttatgaaatacattttaaaacaaattcatcacatcctcactgtaaggagattattagattactgaatcactgtgagtcagaaatttttaatcttatcatattggcttacagctttgcatggaaccaccagtcatatatatatatatatatatatatatatatatatatatatatatatatatatatatacacatacatacagaaaggcaagagaagattaccttctttaatacatttaactgaaacactgtgacatcacctatgatgactcataggcacaattcaattgtttcatccattcattacatatttatcagtgccaattatatatagggctcttgctggacttaaggtggatttagagatttataagaacagatctcatcttcaaggagttcagatttctttttaggcacaaccaggtatgtatacaagtaactatcatagaaatgctgggtgacaagcagacataaagaactgtgaaaattctgaagtatgggagcaccatccaatcatttattcgatgacagaggatggacaaaatatatttggtacctgccctcatagagtttgtaatctagtgaggaagatgcacattacacaacacaggacatacacaaatatgtaacctataaattgtgatgtgttaagaaaaaatagatgtaagaggcaatgaaacagagtcctgatgaagagtggagggtcatgaaaagtgtgagaatgtggcatgtcagggagagctaagtgctgaggaggaatgacctgggtgaaggaggataacgtggattgtttcaggcatagagaaacacaaatgagaaaggcactaaggaagaagatagcttgatgagcttgaagaacagatgaaggtgaatgaggccgggttatagtgagtgagggtggcagaagatagttcagagaggaggaaaagaagctaaagtgtcaaggaacttaaaggcgtgttaatgattctgtgctatgggaattctttggagctacaaaaatattatgtacaatataaagtatggattggaagcagaaagcagtactagcaaaggctattggggtcatcccagggaaagatggtggcttggagtaggacaaaagcaatgagggtggcaggggtggtggtggtaagaagcactcagattttgcaggtagaatcaacaagacttgattatggattaaacagggagaatgaaagagaaggaacacaccagactgtttgcttttatattgtcatctgaactttgtcatgagactgtaagttctttgaggcagtggacatgctttctgcctgatctgtgctctttatagcatcaaagagggagatggtgtttggaaaatattaatttgcaatttgttttcccaggtagaaaatctagtttctctatccttctgcccctcagggctctcatgttttttccatccctgtgtatttgcttcctgataggacctcagaggaagaacaggaaaaaaaatcctttatacttcatacttcgggactacttctcatcttctttcaacttggcacaggctagagacccagaactgctcctgcccttttgaaaaaaatcctacaatggtggccatcttaaaggtgctattcaagatagtagcagttggtagcccagtcaagttaaagaaatattgcaatacaacagttggtatcattgtgttttgtgtagtgaccagatggatgtgcctttaaaatgtcttcatatgccttttgaaattttctatgaatacttcaatgacaatggtgtgggatctggctctttgtaatgatcttccaaggaagcgatgtgctgcattttcacttgcatctgtatcacctggtccatttcaagaccatgggtgccgcgttcaggctgccatcatattatcactctatcttgtggggaagcaggtgtgggtagtgagtgttgaggaccaagcagttgctctggtggggtctttggacttggtggatggccacagctgaggcagcattctcctttatctccaagactcctgtcagccccacactttgttcttcacatgcagcttcagtgtctaagtaatccgaatagagagcttgccttaagaggaggccaggaggacttagtggggagatgaggaacttctgagagaaagaggaaaatgaaagaagaggtaaacataggactgtattagtctgcaattgctgagtaacaaatcactgcaaaactcagaggcataaaacaccatacatattatctcatagtttctgtgggtctgagtctgagtgtggctcagttgggcctctgctttcaggacctttcacaggctaccatccatgtgtcagctcatcgtagttatttcaggtttcaacttggtagcaatccacttccgagttctctccgtgctggtagacgggattcagtttcttactatctgtcggctggaggccactctgttccttgccaggtgggccttttgcttcattgatgctgcagctcacttcatccatctaggcaagcgagaaggcaatagagtatgagcaaggtggaagtcagtcttctgctacttaaccatagaattgacatctcgccacctttactgtattctattggttagaagccagtcactagttccagtccacactcaagaagaggctgttacacagaggcacaaatacaggagatagagatcactgagggtcatcttggaagtctgcctaccacaatgaccttgcactagatctacttgcaaatattaaaactgttgtggtacagtgaaggaagagcaggagtttctttggtaagtaccttcacttctacatggaagcaactccaaagtgttactctggtataactctgatccaggattagattaatgtggtggccaaagaaagagtctggtggctaaatgtgatttcagtggactcaaattatttactactgtttcttaaaaatactatgggggccatgcatcttctgtgccacacctcctctgaattccagtttttccctcccatctacttaactcataaactacacttgggttgctccgaaattgctctcttcctacctcccccatacagcttcccgggtctcttgtcctttcttccatctctagatgacaaatgtccactgacaaagtctggctgcagcacagaaatggtctggcaactgctgatccctctttggggagtggaggagagcaatgacctgagcaggaaaagcaagttctccttagcaggcaaggaaggaggaaagccgggaaacccatgtatattaatattttcagcctcatcacattacgttttctgggtgcaggtttttatctctataaccaggctgcaaactccttgaaagcttgtccttatcttctgctttcttgtatttcccaacagcatatgtgggaccgaggtttgctgaatggatggtgtgtgtactgggctgtgacattttttccagtggactggtgtgattgaaagagataatgtgtctgaaagtgcaatgtaaattgtaatactctatatacatgtcatagttattattgttactatcagcaccatcatcatcatcctctagcacatcttttatgcaccatctgcaaaaataggctttttcctagatgaatgctccacctagaccaccaggatttaagctcaacaaaatagacaaattccttccaaagatatatttatgtgtcattcctatgtttataaagtccagaattataatagagtgggaatatcacatattatggcatgagtgtttctaaatgttacttacactttctgattggaagagcaatcagatatcttttataaaatttagaaatagaaatgagataatagaagaaaccattgttaatattttaccacatttctgtccatccttgtgtgtattaatatataatacatgcatacatagatttgtgtataggtagttatgggtataaagatttatgtgttgctgtgtttatagtctcatgagcaatttcctatgtcattaaatacatttaaaactattattttgttggtaaaataatattccactcaaatatatgtaataacaagtttaaccatttctctactttttggagatctaagattctgtctctttcctaatatgaataagatttcaattaagatttggtaataagtcattgtctacagccctagttacttccttaggaattaagagtttaattagtaggtcaatggtatgaccttttaaaatatatttataaatctggcaaggcatttttctgaaaataattagccagtttacatccttccaagagtctagaagattgcctctcttatcccaccctcagtgacaatgaataatattaatttaaaatttctgattatttgatacaaaaatattcacacttagttttgtttttattttttaattactgaggttgatttttttttttatgtgccttttggccatttgcatttattcttctgtgaatggcttagttacctcttttgaactcttgactttgaatgagtcctaatgttttccttcttaattgataaaagatctttaatagcttattttcacctttaggctatcgtactacaattatttctttgcagttgtttgccttcaagattttgtatatgatgtttttgacatgtaaatatattaatttcttaagtaatatttattcaggctagtgtactatattgaactattttccaaaaattattgtgatcacttatttttattgtaaaatattttgtgcacaaatgaatgtataaaatacacaaaacaatatacaaataacgtatagaatatatgtgcgctgtttaaagaatattggataaaatgaaagctctagtttctaccactcaattttttttaaaaaaaaaagcagtgccggtagttacctggcagcccccatgagaactccctagtcacacaattctcctttatttccccaagttaaccactctcctgacttttgtgagaatcatttttctcctgaatttgtgaattgtatatatttaatatttaatcaatatattgtttggttttagtttttcttgtctttggactttatataaatgcaaccacagtgtgtatatttttgtatcatttcatgcctgtaatcctagcattttgggaggctgaggcaggaggagtgcttgaagccaagagtttgaaactagcttgggcaacatagtgagactccgtttctgaatttcaaaaaaagacctaaaaaaaccccacagcttttatcagtcaactatttttgcagcaatgctgtgtagcaaactactctgtaactcagtaacctaaacaacaagcattcattttcaggctcatggatgtgcttggtcagttgtgctttaggctagggcttgggtgggcaggtctacttcagactgtgaaaggacttcaagcctgctccatatgtcttttcttattatgtgattgctaccttgaacttgttctcatggtaatgagaaaagtgtaagagtagactagtcatacttataagcacatttgatcactgcttgcatcatgtccacaaataatcttttggccaaagcaaatcacacaagctcaacctcaatgaaacagggaaatatatttggatttctagtggtgactgtaaagtcatatggaaacaggaatgcatgtaagctatataaaactataatcagaagggttgaagaatttggaacaataaagagatctgccatgcattttagccttcctaaagtgaaatatatcttttactcaatagctaaatttattgtcatgcatctcattccctgtctttttctttttatggttaatagtttagagttaatagtttatggctttacaattaagtgtttaagaattgacgagacatggtaattaacagatattacattatcattttttttcttccagcgtttcactatagcaagatattggctgttagtttacagtgaattcttttaaaaaaaattgtgttaaagagtattcatatttctaatttaataagaattttaaacaacatgcaacttttgtcttctgaaattatagggataatattttctaaaatttttacttattaaataatatttaatgttactgaaattaaaccacttttacaatctgagtataaacactatttattgatggtgaattattccttacatccttttgattctatttgcttggtttttatttaagatttcacatctatgttcgcaatttcattttattttcttaagttttataattagtgttgtgctacctttaccaagagcactgggtagctaccatctttttctgtgctttaggaggactattttattttattttaatattacacatactagaaaaactaactcatactgttaaaataaataaatgtgtttatgcactaatataccaggatggtaaataggtagagcgagtttggggttttgagattgctttaaatcaatgattatatgacatcaatgacttggtttctttttacatctcaattctgacttctggggtggcaaactttttaggctggctcactgcatggaagcaaaatggctgcagcaatttcagtcatcacattttgtagtacgttgttcataaagagaaagatgggctggctccttataagctcatataaaaaagaagtatcttattttgagaagtacacacatatatattcaacatatatagtcctagaatatatatctagtcacatactttttcatgtttattgatcaatttaggtttcatatgttttatgaaatctgttttgtaatttatatctattccaaagataacctttattttatcctgattttaaaatgtttgccaacattctacttgcaattctcctatttttaatctcctatatgcccctatatttgctgccatagccttgattttctttgtgaatatgcataatattgaggacttaatttgacttaagtactttgaaagaaattttacgtatattagcttgtcgctaacttctctttttttcttaattagatttataggacttgtttaattttggggttttgtctattttttaaaaagaactgattattggatttacttactctatctgctggtttacatatttttcagtaattagtttgacattttttaaatacattaaatcatttttactgcattttattattttctccttttttcttgaagttgactttatatttctaaatttttaagaataaaagttatttaatgacaaagtatttaaggattttatttatgcaggtttacatttgtcatgtggacatatctaaatagtttactattttgttatgcatttactctttaactcaacaggcccttagagaagagcagctttcaacttttaggaccttgtaaagttgtttttcctatttttactcttacttaatcttgaataaataatgcagtctatacaatgtctaatttgggtgacttattgcagttttgtgtctcagtaaacaaaaaattttaaactattctttggagacttaaaaaaatttaacgtttaagtggtataaacattaaatatactgtatgtctattcactttatatgctgattatattaatctaatcatcactatttctatacattttgactactttattatattgtgaaagtagggaattaaagcaattccaattatatttatctcaatttttaatttcattttattttgacaaataattgcttgattaaacagttggtttcagattgggcattgtggagtacttggggaggctgaggcaagaggattgcttgaggccaggagttgagattagcctggcaaacatggcaagagcccgtctctacaaaataagaaaaaaattgatttcatgtgtaatatgtgagcacacactcacaaaatcagcacctaagtcaggacttacaaacttaataggtcagcttcctgcttctattgagtcactaacactcacaggtaattgctatccttaattctaacagcatagataagttttgtttgtttttgtaatgtctcatgtctggcatctttcattcaacattagatttggtcatgtgttttgtgtgatacattctataaaacaattggcctgaactcaaaaaaaaaaaaaaaatcaatatcatgaaagaccagaaaagcaaacaaacaaaaagctgaagggcttgtctacattaaaggagacgtggctgggcgtggtggctcacgcctgtaatcccagcactttgagaggtcaaggcaggtggatcatctgaggtcaggagtttgagaccagcctgactgacatggtgaaacctcatctctactaaaaatacaaaaaaaaaaaaaaaaaaaaatagctgggcgtggtggcacgcacctgtagtcccaggtactcgggaggctgaggcaggagaattgcttaaaccgaggaggcggaggttgcagcgagcggagatcaagccactggactccagcctgggtgacaagagcgagactgtctccaaaacaaacaaacaaacaaaaaacaaaaacaaaaaaaaggagaagctttgatgaacaaacatatgatttaattagaaaaaaattgaatatcaacatgttaatattatcttcttaatgttaaaacttttattgtgaaatggtgtggttatatagaagaatattcttgatcttagatgacaggatacatttaggagtcaaatgttttaggatctgtaagctattttaaaatagtttggtaaaagtaatatacatacatatatacttgtgtgtgtaaaaagagcagggaagtgtggcaaaatgtgaaaaattggggaaggacaggttggtgtccattgtattgttctttcagcttttctgtgggggctgaaatattttaaaattaaaaaatgggaagataagcacacattgctatttaatcctaatttttaataactgagcagtagattttctgttgtgattttatttagcatatgtagaaactgaggctcagtggagtttggcacattgcctagagtgtggccctgatgactctgtgatctaggtcttctgaccatctcctgtgcaccttttatgaaggccacaaggacactgttgactgacagttgagaaaggtaaaagctattaagacatcctagaattttagagtagatagaaactacagtgatcagctaatcagattctctaatcttagaaatgtcaaggaggtcaagtactcagtccaagttcacagaatgagttagaaatgtcagagcctgcattacaatcttggttttctaattttaaaatccatattatttttactgcaccaccaatgagctgaacgttccaagcagatagaattctgggccatggaacattaggacaacaaagttcaaaatcaaaaaccaaaacaaaagcctcaaattcctcagcttgcttttcaggtttaagcttgacttctgaccacatgtcaatcaggcattgttttcggcttgagtcgggaatattttgtataactcctctgaatgtgtaatatccctgctctctttcccagccaggttgggagtgtatcttggcgtgtagcagaatatctgagtgtttatttccccgtcttacatcaacagtttgctgaatcatttactttttctctttgacagagtttcaatgctgtcagtagaatatgcatcagggcagaagggaattatcatggtgtcaggcattatgggtaattccatgtaaatggttctgcagagagccatgctgatttgcacggcggcagtaacaactctaagtggaaggcttcctcatgtctggttttgttaatttcagtttagtggctattagcaggtttcctgaaaataggaatgttagaccctagacagtccttctcgaacttgagagtgctttccagtctcatttatcctcttctcatagaaaaggttttgttttcaatttctttgtttctattatcctcatctttctgtttacttttcctggctccctgcctaacctgagaggaaagggatgtgtctcatgttcccttcccacactcaagactctgtgccctgagtttgggttacacttttcttttttttaagttattgagtatacttgaacaatagtatactctgccccactataaataacttttttcccacagaatactgtatgcttttataggaagagctctggactgaaagtcagggggtcacaatttcaattttgccattagtcagtcctatgaccttgatcacattattttcatcactaaataacgttgagaaaatggaacgattctgccttcacatgtgtttgataggtggtgagtaattaggttatacatgttcattcttaaattatatatgaaaatacattctaaaagatatattttaaaaatcaacacttaattatccaggaaaagttgaattaatttttttcttagttttttaaagtgtcatgacatttccttattctgtatgacttaatgtatttgaacacattgttttgttgtcttctcttatgtgatcttctctagctcacataaaagactaacattttaaaacccatttttaaaatacacaaatgaaagtgtagcaaattaattgatttatataacattaattgatttatataacaatcaaccatatttgagctagaattaatagtttaaaaatcttaattttaatatcttttttttactgcataggtagtaaaataatgcatccaagataatttgtaaagtagaaatggacaataaaacatggacaataaaatcacctgtgtcctatatttgttaatgatctaaataaatgttgattatttactatatgctagctattgttttaaaggccaagaatacaccaatgaacaaaacagaaatccttgttttcatgcaacttagaaaatatgtaaaatatctggctgggcgcagcgccttacgcctgtaatcccagcactttgggaggccaaagcgggtagatcacctgaggtcaggagtttgaaaccagcctgcccaacatggtgaaaccccgtctctactaaaaatacaaaaattagccaaatgtggtggtgcatacctgtaaccccagctactcggaaggctgagacaggagaattgcttgaacctaggaggcggaggttgcagtgagccgaaatcacactactgcactccagcctgggtgacagagcaagactctgtctcaaaatacaaaaagaaaatatgttaaatttccaatatacaatgcacaataaatgcatgaatcatatagattactagaaggtgataagtgttgtcaaaagaatgaaaggaaaagagtttggaaattctggaagtagggtaagggtgttattgagaagatgaaatttgggtgataatttgaatatgtgaggacgtgagccatgcaggtatctggtggaagaaccttccagagggaggaagagtcagagccagggtagaagcatgtctggcatttctaaggaacagcaatgtggccagtgtgactgatcataataaggaatgagtagagtgttaggaaataaatagtcagagacttgctcaaggaccataacctgtagccttttaggtcatgataaggggtttggaattttctctgagagaaatgagaagttagtggcataatctgacttacattttgaaggtctcactcttgctaaactttgcgaaaactgtttgggatgttgtgggggaggacaggaaggggagggcaagagtggaaagagaaagatgaggtaggaggctattgcagttctcagtgagggctagtgatgacttcctatgtggggtgctagacttgagagtggtgaggatcagattctgaatatatgttgaaggcagagccaataggactttatgatggattagaggtggtgggtgggagaaaaatcaagaataatggagtgctctcaggtttttggcctgagccactggaagaatggagttccccatcaacagagatggggaaaactgtgagtttaataggtttggagcaggtggggacaatataaacaattggttctgcaaaatgttttgtgtaagatttctgttagatagccaagtagtaatgtcaagtccttagtcagataatgagccaagagttcaccggaaaggtctgggctgtagaagtaaatttgacttattcctgggacctttgttactaagaattgaagtgtagagactaacagaagacaataagaaacgaggtagaaggaaaaccaggagatgaactagtagtatagtgtcctagaagcccagtgaagagaatattgtaatgaagaataactgattctctgtataaattaaaatgaagtagatgaggagtaagaactggctatcagatttaatgaaatgaaggcaattgatgactttggcatgagaagtttcagtagagtaatgggtgtgagattataaaagaagaatttgaagtttaatgcaaaggggaatggagaaatggggccattgttggaaggaagagtgatatgaagagaccctttttaagagatggagaaatgataccatgtttgaatgctgatgggaatgatctagcagagaggtaaagcttatggtgtggaagagaggcaagaattgctggatggctgtccatctatgaggatgaggaaataggatctgatgcatacctgaaagaattgaccttaaagagtgtcatgggtagtttacttatagtaacaggagaaaggcagagtatatggaaatagattctggaaggggtagaagaggttgtgggagtctttggaagatctcctttgatagcttcaattttgccagtgaaattggaagtaagatcattgagaatgaagatggggaagaattgttgaaggttttagggggaagaaagaggtaagtaattgttcaacaagagagtaggagaatgaatgggcaaaagaaacatactgtgatgacttggtagtactgagtccactggaaattttcagtcatgaatttgaagtgagcccaatcagcagagtgatgtgtttttccctacctatattcagttacttggaagaatgtaggtggtaagacagcagaagctgagaatatatgcaaatatgtgattagattggctgatcatatcagtccaaattctgcataagaaaaaatggttactttcataattgataccttgtttcatttccttctatctttttaatgcacaggattaatttgggttttttttctttttacataaaaacaattattctggagtatgcccttttattcaacattctttttttttttggtggggggcttataatataatgcctatgtgtggtgttatatacaattaatgattgcattaatttttatttttacttttgtaaatctacctaattgtattgtcctttaaaactacatgtcagttcatggttataacacccattgttatcaataactcactcaccaatcaatttaaccatgaaaatggcccatgccatatgtctgacaagcattaagtcataggaccaaaaaaaattgggataagctttaaaagtatcattcagcattcttttatggacatgtaaaaatagtctagtttcttaataagctacagcatatatatctagttctttttgtggcacagggggcatttagttttgtgaaagagaccagcagtttttctaaaatactctcttctcccattcttcattagtaacagaatccctttccctgtttttagcttggtacacggccacctgaaatgaggactaagtttgccagcttccttattactaagtatggccatgtgaccatctttggccaatcagatgaaagtgaaagtggtgtttcagccatcagtcatctggcaccataaccttgacaatggaagctatataaatttataaggtataaggaatctatgtctctgacactatgggggatatacttctggtcaaaatgactatgaaagaaaaataacttcttttataagctactgttattgtggttttttctgggcctcacagatgaatttcagccatctgataacacgaaagtccaacatacctgttttttcctaagccaagaattctattgcttgtttttcttcagtccacatgagactctctgaaaataagagcaaaataaaaaggcattactttaaaaaggacaaagaaaaaaaaccctgaatttaaaaactatagggcaagatgtctgtaaagtacatatttgtgatcctccagcaactgtccttgaatcacatactggcaggcatacagtatcagcacactgtctagaggcttctttcccgagctccctcatctcccagacctatggattctgaatataggtgtaacttttttgtatcctgcagctagtcttgcccacgctactctctgccaaggacaaattccaagtaggtttgatttggggatttcattgacttcacagttcattggcagagcagtgattcttaaaaattctgtagttagtaaatcccttagcacttcttggttcaaatcctcaaattggctttcatctgagaaggaaattctgatattactcactgaagtgtctttaagacaccctttcctatgtttcctatattcccccaacatacaacttaattaagtagttctcaagttttaatcagcataaaatcttgataaaaatgcatctcatctgaccacagcctcagagttcttaatttggtagctatcatggtgaggcccaggattattcatttttaaccagtgttattccatgactctgatgtgggccctgcaggggtcacgttttgagaaattgcatagaggcctccaagggtcttgactcagacaatctaactagttataattttctagtacttctaaggctcatgctgaaaggaaagaacacttctgtatcaaagagataattcaaagaggattagattctggttaaaacttctctcactgtagaaacacataagaaatggcatggctttccttgctgtgtgaatttggaattgtatagatcttattataattccagcactgctacttattggctaagtgatttagatgagttatttggcatatacaatcctcatccacaatgctgttgtcaggattggaatgcctagcctggctcctggagcattgacgttcgtcagtaaatgacggtgttcctgttttcccactcctctttcttctcattttcttagttacatgaaacttcttgacccctccatagattgctaataagttccaactactgatctctctgagtgttgatatcttactaaacctgccactgagtacgttaactcttaacactgagttcagttgacttcctgaatgtctgacaaagtattgtcttccttggtccactgcttggtgtcagtcctggttgccccatctgagacactgtctcttgagctgtggtcccacatgtggttgccctacttccaccagcataaagtgtcattgagatgggggtacttcaaaagtctggggagtttttgcttgtttttctacagtccaactggactctactggatgctcagaagccttccattgtctgagattgtttaacaaatgagtgatcttcactaacttcatctattctttccccaatacaataaaaaggaaacctctgttaaaagagtaagtctgacacctgtgcttctactcccagtgcactctcaatttaaatgtcattttagggtcaaaagattggcagacaatatatggaggtacaccagttctcctcatgttctctttcaactcaagcatcatagggagcttcgcagctgtgacatgacttccacttagtgacaaaggggataaaatcaatttccatttctgtggttcttccagagaggcacagggatctcagcctcctaatgttgttattgttgaagatccaaagataagagctaggctttaatgttcgaggccagaatagaaagactggctaccggaggtttttatacttcctgatttatccattctagaaagatgttgtcaaaggatcaatattaacacaccgagatgtggtttagctgctttatatttcatagttatgtagatacctacctcggattgtagatttaaacatttgtttgggtaagacctgcctaaaactagcatactatccatttattctccttctttaaaaatcttccaatatttgtttctggaaccctattctgagactcatttcaagggtattaagttaatgaaaagtattgtgtttgaagttttctctttgaaatttcatgaatgactacattaaatctcccaaaaatgtatgtatacacacacttcagtgtgtgtaaagcagtggttttaagcagggagaaattttgcccccttttcacttcccctgccagagacatttgacagtatctagagacattttgggttgtcctaactaggtacggatgcaatgggcatcaaatgaggagaagtcaaggatgttgcacaatttcttgcaatgcacagaacggtccccataacaaataattttatgacccaaatgtcaatagtgctgatgtagagaatccttgttatagaccctaacaaatgcgttttatccatgagaatgtatattcattttattttcacgaaagattagttcacccatcaaccagttgggatattgccgagtagccttcttgcaccgtccttccataacctcctcaaatgcaaaccaaaatgagttatgtcagcacaaacatcccaggggatcctgatacacaaataagaaatagttagccctggcttgccaagctccctccacaccaagtcaatagtctcatcttaaattagagtccatacactgtgtccttcagtgcctgctcctttcccttctccctgccacccggagtacaagatgcagacttttccctaaatcctataataccacaaagcccctgctctttgtattattctcaagccctagcaggactttttgcactcaggcaaataaacacgccaccaataatccaataaaaccttcacagacatcggatataaaccacagtgatgagcagcgcacaatctatagctgcttggttcttttttataaaccgtgcacttgagccctgaaggcaacacaaatcaaagctaataaaagcaccaaggccttccccttattgttcctaatgggttgattcaccctacctatgccatccccctagtgaccacaggctgtctccactcccaaatggaagacatacaagccagcatatcaagtatgaggaaggaaagagctcatttcaaatatgcctttcatcatgatggctttccacttggtgctcaatagctgcagagaaataaacacgatcaccttgggctggaactagccaatgtctcatactcccagagaccaaatacagcacaacactcaatcctagagctcatttttttttaagtgtgttttccaactctcaactttgtgaaggagctgcaattagtctatgcagtaaatgaaagcagattagagcagaagaatgtgagtagtttgataaaaagcttgccccaaagcagaggtaacaggaaaccacagttagaatgttctttcttcacaggaaaacctctgtctttggtagaatgactgcagagtttcactgataatcaaaatgcgaagattttattctgagccacaaactcagatgtctctatgggccaagcagatcatgtacctgagtgaaaaaggggtagaaaaagggaaaagcaagaaggggagtctttggtcatctggatcacattccttgtttataatctctactcctcccctagagctctgccaagttgttagcaagtaggagtgttttttcagatcttcccatttttttcaaagctatataataaagacttattttgagtgtagaagcttccaatttttacatatgggtaagtaattgcatttagacaaaaaatgcatgggccaaaacaaactaaaatatatctgtgggctggaactattaatagctgtgagctaccaggctggcaccactctttacccatggccctgtatgcaatgtctcatccttgaaaatgaagttaatagttagtgtccattagtaccaggaccctaatcaaggctttacagagtacattgttgtattttttaagtttcatgtttagaatccacatacattcatggaaagaggtggatggcaggtgtcagggtaacgtgttggcatccccttttgtttcaaaccttctcctataggtgtcaccgatgctctccttggggaggactgtggtcattgacctcccagtccccttcatggtaaaccttttctgatgatgggccctgcctagtcagccagccatggagaaacaaagattacatacagcctttcctgactaaagatgccagtgagcatcaaaatcaaatgggagcttctcatagccccaggcaccgagagattgccactctggaatctctctcagtagggttatgctcttttataatgtaatatcttctcaacagctcctacttttcagagcagccttgcagaaaagcagttggaggtctgtttctgttagccaagaattcatactcacagcttgccagaaaaggtgatgcatctgtttataagggaggtaagggaagagcctactctatccattggcacaatcattccagatgcatctggtgggacaattctggggctgattccaatctccggaaatgcattcttccctgggaaaattattagcaaggagggacaggtgtgcagggcattcaaacagaccttccttttatttctgtttaaatcctgaatatctattaacaacttgccttcccattgttccccaacaattgaagcgcagctgaatacacaataggaaaatagaaactgaactagccaattgactccggcttctatttaactaccaatacacgcaatgatgtcctaactagtaaatatttggtagaaaatatgtaaacatataaataacactattgagtatctccaaactaatttttggaagtaggtaatcaataatttcccgttactttcttttctcttgtctttccttttctctcctcttcttccctcaaatatttgtaaagcatcttatattatgcgtaattctgtgtacatcgtacctctaggaaaggacttcctccccatcaaattcatatatgttgacaaaaagaacatacgcaattcaaaaaactagaaattgccctggtgtgttattagatgtccaataaatgttgctgttgtcacttgctgggagaagggaagtcattgctaacttgcagtggtcaggaaacacttcaagaaagtgtacaatttggatacattaggaggagaaatacctgggagaggtggagtagggataaacattatgaggaaagtctagctatgggcttcgtagtagttttgctgctataccacattactatagatggttagtgtgagttagaagaaagactggcagataatttaaatattggacaagttaatttgcctccctgagcatcagtctcctcatgtgtaaaatgggagtagtaatgcttacctccattgagatgctatcaattaagtgaaataagtaatgaaataatgtacggagcatgaagcatgcttccaggcccttttctgcacctgcagtgtaatagataaaatcatggaggtctttgtgtgatgaatttggacatatttctactggcctttgttgaggaaagttgtgatttataggaagtctttattctatattaaatacacataaactactttcaaccatcttaacaagtggcagagggtgagaaactatgtacaatattaaatttcatttggattatttgaactttctcttaatttgagcagaactagcattattagaaagaaagagcacgctgacaaaattagtggtgcttcaaaagtgcttagatatcaccctggggctttaggggggttgcctgcattatgtaggaaaacaacttcattacaaacccagtgttgtagagttctaaaggaagtaacttgctgcttgttgaggttctaatgacacatcactcttgtttattctttgaagggaatgtctagcaggcctctgtgtagccagactttggtagtgcactcctaagttctttatgcatcaaaaagtaataaagtatctcttaaaatatgacatagtctaatttgaccactgatgttaataatctggcttctctcccttctttttcccttatttattgaagatctctcccttttcctggccagaacccttgtgaccttcttcctttacaccccctgagctcccttatcttccattgtttaccttccatggaagagggttaaatgtactcagtggctcttttgcctccttagctaacatgagaagggtctgttcttttacctgaactccaccaaaaggaattccacatctccactggaggtttgaaatgcaaataaactgagagtagttttcatgtcacagatttggtttctctgctcccttcccttaggaaattgtatttttctttgccctggcttttacctgctccccagccctccatcttgcctcagccatgttggttctctggcccttatttctttttaagatcattaggtttctctcatgttaactgttgctgcttccaagaccctcaccttcctcgtttctcagtgtgatttcttttgctaatatgctcactgtctaccatgccccttccactaagccttcagcagcctttgctctgttcctccagaaatatttcatgaagtgggagctgacctgggacaatgccaactgtacaagtgccgcgggctgactgtgtgcctcctggccaatcagtttgccagccccggtaagagctcgtttcctcctgctccttgacacaagctttcctcacttcatgagagtttctgattagtattcagaaagagttttctctgatggcattagtgggaaatcagactgtcaatttatttatacccagcctcagggcagaaccactgtgtgtgggtaaagctattagatgcagaaaatactctgtgtgtgtttgtatgtacacatattgactggaggtgacgtttagagtggaaatccattgccccatgggttggaaagtgactcacagtgggatataaaaatgccggagaaagatttggtgttattgctaatggaggtcacattttcaaacccctagttaatggttttccctagaaatgctgtgtcctctatggataatcacagtataatttatgtctggacttgcttgctccaaacttaaggtggtggcctaatctcacatcataaggaaggacacatctctcgtaagtctcctacttctgagattgacaaaatgggctactggcctggggtagaccagaacagggaatagggagcaagggcttctgatgggccagcagccatggtgtcttggtgggaagcaccctggatttaggtttaggggagctaagttagggatgcaagtctcctgcttattgagaatacagagataagatgctcaacttctctcaaactcatcattaggactgttgtaagagttaaaatatatacatacacataaatatatataatttatatgtgtatatactatattgtatatgcatatatatatgtatgtatgtgtgtatatattcatgtatttatgtatgtataatgaaagaacatgatcagcacaaaaatccaggttgggttggattcccttaatgtattctcgtagcatcctgtagtttttggtcacagcactttcaaaactatcatgaagcaattaataatgtaatgcctctagaccaagacaattattaaaatgactcctctggattaagttatatgagcgtatagggattttgtccttagcctgagaatgtaacaatgtctgacacttggaaagaacttactatatatttttgcaaaaatgaatgaatagtaaatgttaatgtttcttaagtctgaatagaaatgaactctattggggattttctgtgactaatggacactgacacctctactggtctgctttattttgattctggattaagtaagagtcaataatatcctaggtgcccatttaatttttaactatctagcaaaatgaaaatatgaacccctttttacaactatgactcttacagcctcctggaccttggttttggccagtgtttctcatttgtagactgactcttactttgacacataggtatcagcaacactcaggattgcaaatcttatatgggcatgtggatacagaaagccatagccagagttcctaggctggtgggtgtttctgatatttggcccataaccccattaataatttagcacttgttaggccatgtgtttggggtttgatttagggaaaaaacgtggtcacagaaacactaaggagagcaatcctccatgttggtatgtagagataaatcatagaatgttagaacattctggaggaaagctgtttgggatgcactaccaagcatcatgcagattcagtggaggttatagtaacggtcccttcatttacgcagaacatgtgttggctggctgtactacacagagagcaaaggcgggtattcacaaagacagaagtaagccatgatcttttaattaagaaaagttcctgtctcatttatttcctatttgtcccccctccacatccctttcctaaaaagggtcattgaaggcctgaagatttctagattcttgatcttttttccagaatttacctacctgttccatgtttcacttcatctggccttgaatctccactgaatggctatgtagcagttatgcactaataaacagtgcaagaattggtgttactttgcttattagtggacactatttaaagagccattaataaaaagaatatcagtaattgtcagattgatggatgagatgatttgaagccgggagacttttggcttccataagctaagaccctgccaaaggtgaggactctgaaggtaaaggtgatacaatctagacctgcaggtagatctaatacaacctcatctctgtgcccaatattggggttttctcttctgtctatagcaactgttgcccctttgcagaatttcagcagtatgctcctatcttctgctacccgccacggcgtctttaatttccaagtctctttcattgacaatacatcccagttcttttgtcaaccgtaagatctaacctgatcaggttatgaacctgatcataacctaatctttcttaggtaagtaagaacgagacagctaaacaaggttggaggcaggcaggaagcagacaggactaactggaaaaggtttcattaaaaaataaaacatttctcatcatttgaactgaacaaagtctgctaacaagtgttttgcctgctggggtttccagctgttccctcctgagcacttgggcatcaaagttatatgggcccatggtaggactgtttgctctgttgccagggcaattacagtctgacagtgctcaggtctgttcctgtatttattactattgttattacttccctgctcatggactttgggggcctcccaacacagatgcacaccctggggaatcacaaagccacaggcacatttgtagccacggcttggcaattcttggattgttatgaatttagcatattccctttatctagtaagcagaaccatagatgtttagacctactcccgcaagaaagacggtttcctgcagaaaatgtcagttttccactccaggcaaggagcagaaaggagggactgcagtatcttcattttcatctgaaaagatctacaggggccgattgaccggggcttcatgcctgacactgggcagagagacatattcattgtcaaactgctcaggtcctagacttccattattgctacagctatacataaatacatttataaacaaacatacaaataaataaatttaccctttagaacaatcagaatgctttgcattcttactgtgtgcatgtttcaaaaggcaacatatacacgtatcatcctctcttcaaatctacttacactttggtaggggacgtttgctcaaaaacagagcaaagttttagaaacaatcttttccccttaaagttaattgtattactaatccaatatagtcaacacattttttttttactgattttttaagttcaaagatttgaaaattaaccattattttttaatttacttatagactcagtatgagttttatacagcaatctcattgcttttaagacctgaattatgattttctctgcatttggtcaggcctcatttactgaactgaatataaaattgctatatggcttttggtcagatattatcttttagatcataacagcaaattctagccatgcgtaaatctgcagactctaatgtatattagcctctcttcctgtttgtgtttgttctaagtctctccttctccaaagtattcagtcaagcaaaacttgaaggaaaataataatagtattaatgaaggagagttttagtgactaaaaatgctcagaacttgaatgcctacaggagccaagcaggtaatgtaaattcagggactgagaaagtgtaaaacagtatggacttaactgcttatgttgctacacctgcttagctctttcacctttaaaacactgtgcagggacaagcaaccaaaagatgtctgtaagtatacacgtcccaaagtcctaatgcagagaagctattcttccttcagacattcaaggcaaatcctattttagtgtatgttttagcttccttaatacgcataagatcattggggattgacatttcttattcccttcaatgatcctttaaatgtccaccctggactctaaaatgacaccctgtaccaaacgctgtgctagagatgtagaaataaaggcaatttttagactggaggcaggtacatgagtcaccttcaagaattcagaccatgctttttttcccaactcctaaaacagagtcatgtacatagtaaaagctaattcaatggccattaaatgaatgaatgaacaatgggctctcacaattatttgctggagataatgatgctaacccagtccagttagcagaactagactgggttaacatcattatctgcagcaaataattatgagaaccctgtaattcttcaggaagccaaggacacctcttaaaaagacacccacgcacaaatttacatgcaataagaggagaattaccaattgccacggactctcattggtcagtgaaacccagttaaaagcctttttgctagagcaagcaaacagtccccagataaactggagatagggagctgggagatggtgctaagcacggtgaccatgctaaggtgtcatccaagtacagggctccataccaagtcactctcgtcgctctgagaatgtcgcattgcttcatctcatgttctgtgcagtttaactagtcaaatgaatcattttgtggacaatttctctattctctgctctaagatctaaagtttctttcttcgttcaacttccactttccacataaattatgtataatgggaatactaatcttttatcttacctcattcaacaacttcagttatgtagaggaataaaagctctggcttcccttgaatatcacttctgaatacttggcctttctgtgttttatccatatcaaatgaccatgtaaaattggagaaaaataaagatttcagctggaaaaagagaagcaaaactaagcaaagatgagtggcatttatatatccatgtaaatgtgcatacacacacatatctgtgatctgtgcatattctgctatgcctctgtgtgtaatattacatactgcatagggaaaaagtgtctgaaaaaattcacttttttatggggcatttactctgtgcctccatgcaaggcatgtgcactttatatctcatttaatctttatagaagcacttaagcagtagataatattttcccatttttaagaagaggacattgaacttgaagagcttatgtaactcaaaagtggtcatttggacagaaagttgggatttagatcccagagagctgactaccaaaatactccctttatgctacttaaagtagagagatcttgctggagagtgtattttggagcagtgctactcaaagtatctggtctatgagcttttgattcattggctgctgcaatgatagagggagcttgtactcactatcccaatgccaccttcattgataaaatcagctgaactaaaaacagatgcttagttacatgattgatttacattctggcttaggcttcttattttatcacaaataaaagttcataactatttcacaggcaaatgctaatctgcagaccataatttgtatacccctggacttgactattatggtcctcttacctaacaaaaactactagccattccgcatgaccagtgaagatatgcctagtggaccactctcctggcagacaccatatggaagattagggagcaacatcttcatattaaaattatttcacatttttgaaaatagttttgatttgtgtcttatccccatcatcttccaagaacactggatggacttgaatgagctgctgtggggcttggaggtctaagtaaagattaggattgatattccactgattttcactggcgtgactataccaattgctagtgcattacaagacttccacacctatgggttaatggcccctgctcatacccaccaagtgaatcccctacccactacttctctatcctattcttccccacacttcttacatgatccaccaggaccttactgagattcagaaacccaagggttaaagccaaacaaaacggaactcagctccattgctgtggccagcttctgttctaattggtcgttgtccttttcatttgagtttctcaaaatgatgtatgtaaccatggggagagcagcacctttctccttcttccctcactctgtggtcttagaaggaaagttcaaaattaggtctgagagaaaccatagagacccaggtctaaagagattactcctgctagtcaccacacgaggtagctgcaggtaggtttcagaagccaggatgtggagcttagggatcaaagggccagagaagatgagtgcaggaaacagtggtcacaacagcaaaggggagggaggcaggctgttgttgcacaatactgggcttgtgcatgtctctggtgccatattgagttttttggtggaggcatgagaaaagagagagggaatctggaaaggtagaacataatttataagaaagactgacctccagatctgcaaaagctcttggtaaacaaatccatgaagtataaagcctctgttgaaatggacaatttaatagagtcagggactatttctgtcactctggctctactgctacttaattacataactttttaaatgcagtttatgcatccgaaaaaaacagagtttggcttgatcagactctaggctacctaatgatatagtctctgattcacatttaccctctgtatgcatcctctagaaaaacatggaaatgtaatcacagagggttttgctgtctgctgtggtcattcatggtgtagggacaatttcaccaataaaagacccaaaggaaggtccagcatagaaatgaaggacatgtttgaagtctagcccacaccttcaaccctgctgtgccagtgaatatatggccttttttgcagttactaaggaaacaattgtcagtaatggattaggaaacctgggctgaaaggacacacacagaggaggctttatacggaggagcccatcagatgaaagctggcagagacaccaacatgcttagtgattgatccagtcctcagcatgaaagcattagagtccatttgttggggtcgataagtggagaagccacagagcccatccaccagccctcatgctttcttctctgctacctattagagttcacagatctgcatggtctgattgactcagttttaacttctctgttgggtacatgtcaaggcagggaatatacacacttaattcaagttcagagcctctccaaacctgtttaaaactccaaaagtcactgtctttcaactcatgctggctctttgtaaaggttctgagaatgtttggagggacaatactaaggaaatggatgtctcattgctatttcttcactagacctttttgctgggggtttacctcccctgccaagtagacacaagcctagtgaccctaaaaaagttaaggggaatctaggtgataccaggtagttcatgggaaggaaaaagtaggaccctaagaaactagataggcctaaccagctcattcctttgccttttattattgaatatttaaattaaaatattaaatttaaatttaatgatttataaaagttaattttaaatttaattttatttgtagatttaaaatcacatattacataaaataatatcttaattcagatacacttttttcaggcttacatgcattgctgaaggaaagaatgagtggcaaaagcaattaggtaatttgcggattttaaaaaaataaggaaaacacacaaagaaaatatttaaatcatgcaacctcatcgcgcatttctaaccagttaacatttttgtgcccatatagcattacaaaaatttaaagtaaaattggggtcataaagaatatagcatactatagtcaattatactttacattatgattatatccctatgacgttgccaatttgaaacacatgatgtcaatatttccacggtgtgaattcactcaagtttatttgactagtaatagactggtgcacattttggactgtctctgttgctcattttacgattatttccttaatattaatttctgaaatttgtattgttaacgccaagagtttaattaaacactattaaggctttcgaaatacacttccaaatttccttggaaagactgcagtctatcattttgccaatgatagaatgtaacagtgactgtttccagtccatttccaggagacgattatgatttggggctgagagtaagcctacgatgagaagagaatcatagtattttattgttatattaatttgcattttatatcaaagcaaattaacattttcttctctgttggaattatgtttattttgttgtttccattttagtttagtttatggtatttcaggttatttagatatattcaaattttatatatctaatcattaatattttcctttatgatttcttcctttgaaaatatacattgaaaaaccttctcctggtttggagatgataaaacattaatgtattctattcctttttatcattaaattctttgatcatttaactctttaatcaaaataaatttttttttttatatttggggtaagatttttctctcaaatattaaccaactgcttttgagtttttatctttattgtagtccttttcctgttgcctgaagggctcctttgtcaactacaaacttatttaccccaagatttttgtgctttctctattcttcctttgatctgcctgccatgttttatatcaataccgaaacatttcatcatcatcgcgtagaagagctttttcttatctgtaagggaaaaccctcattaatagtttttactttttattctgggatattcttgccatgtattcttccagaggggaatttgttttccaagtctgaaaatccccagtggtgttctgatttcctatgctttgatagactaataggaggagaatcgatattgcatggtcctgggccttgctttcccagaatttatttagatgttccttgctgtctcttggtcctaggatttatcacataacccttgggatatttattattaatttcattctcagatattttatagttctgttgctattgtgaatggaatttttattatatttaataatttattttgctggtttaaacaaagaaaattgatttttgtatatttaatttgtaacctgtctatttactcaattgttgccctatctctaataaattttgtctttcagttgatgtctttagtttgttttaggatataatcagtcttcaaatgaagataatgtgattattcctttctaatatgtatgactcattttttcttatcttattgaattgtctgggtcttgccaaataataggaaataacagtggtgaaagcaggccataattttggtgatagttttaacaaggactgtgttagtgtcaagtacgattttgacaattggttttgcatgagcatttgctgctgttattgataataataagtacttacataatatgcagtggaccaactactgatctcaatttatatattaattcactgaattatctcagcaactccatgaattagatattattatgcttattataattattatttccattacatagatgagaaaaccgaggcactaaaaagtcaaagggcttcctcaggaccctgcagttagaagtggaagcactaggactgtaaccccagcaatatgggtcttggggcctgtgtttacacacaccatgccaggctatcttctcaggtttacagagaatcctggtgggctcatatgagatgacttgtatcagacatagatgcatccatctagaagttcctgatattttcttctgttctctgccctttatcttgatatgttaggtatgttaacatctatactagcagatttcctaatgataccatcatcatgccattcttagaaaaatactctctaaatcatttatatttttatatatttatatttctgaacataaatttttttaaaattgagatatctatgtatgtatctatgtatgtatgtatgtatgtatgtatgtatgtatgtatgtatctatctatctatctgtctatctttgctgttggcttgctgccctgtttatatattagtaatgcaataatcagtttttggtattaggattatgttaatattataaaataaattatgaaactttttcttgtttatgatgtggtttgcattcaatgtttccccttctcttggtttgtcttcctgacactactacccaaaacattttgaggtgcaatactttctcttcaaaattatttatatcttgctccactgtcttaggtattagtagtatgaataaatattagactgtttaatttcagttatttatagggatcttgatccttttttctttattttctttaattatatttcaaatacttggagatcctgtttgatatgtaaactcagatattttttggaccgtaggtgagtactttcttccttctcctcatcctcctttccttccttttccttcttcttggcttctgctatgactaccatactatctgagtttgaaattccaaatggaagcatatcacttttccctaatctcttctaaaattcctatttatatgtttagctcatcattttaatctaatctgttgtgttagttttgtattgctgtaagggaatacctgagagtgagtaatttataaagaaaagaggtttatttggcttacagttctgcaggctgtaaaagcatggccacagcatctgctcagcttctggtgaggcctcagggagctttccctcatggcagaggtgaagcgggagcaggcatgtcacatggtgagaacagcaagagagagaggagcaggtgccaggcactttaaacaaccagctcttgcctgaactaacaattcactcgttcccatggggagggcaccaagccatccataagggattcacctccatgaaccaaacacctcccaccagaccccacctccaacattggggatcacatttcaacatgagatttggaggggataaatatccaattcatatcatccacctttgagatattggaaaacttcttgaagttgtcttctctgtaatatattttattttctacattgaacagtctaactcacaattttggcctttaatttagaaaatgaattttaatctcaatagtgatgtcacttctaatttcttattgtttcctttttgtgccttttaatgtagtttcaccaatgcaatatactcatttctttcagaaaatataaacaagaaatttcccagatttttcctatttctggcagtaaatctatttcacaaaaagacgtttttttggtatcttcagagtggcccccttttatctgcaatatttcttcacagatttaatgtctttcctctgtgcatgtttacagaggatgttcaatgatgctctgttttataaaaagtgattgccagaggttgttgtaagactttggggcagatactaaaccctgttcacttataacttggttttgtaacaaagacagaggcccatgcaaggtttgaggattgatttgggaccatcacacaaagccaggacctccagagatgacaactgtggtcaataaattagtaagaccgcaatctgcaaagggacaatgtgggcatatttgactttcttggccatgtctttgggtagagcagtaaaaatgggcaaagtcttcattcataatttctaaacacagccctccttcaagcagatttggaatcacaattcaaatgtacctgtagctcaaaaggcctcaagccaaaaattctctctatagtggttcctgattggtagtgtcctcaagtacttaggggagaaaaacaaaagttccaactgaagaaaagagcgctaacaccaatctacaaaaacagactttaatgttaaaaaaaaaagtttagcattttaaaaattataaaataattgagcaaacaggactacactactgacactcaacagaaaaatcaaactactgtacgatgcccagaaacactgcatatgcaggaataatcaggtatgataatataaaataaccatggttatatgtttttcagaaatggttttgagatgaatgagtttacaagtagattcaatctagttgaagaaagaattattaatatggaacaaaaatatgaaaaaaatcagaatttactacagtgaaacaaagaaatagaaaataagaaagtaaggttaagagatgtggaggacaaagggaaaatagaaaacataacatacgttgaatattatctttgatttccttgacagaggtaagggagaggcaatattcaaaaagatcatggatgacatttttctagaattattgaaaaatactaattatcttgtcaataaattctaaataaaagaaatgaaaataaatttaaatctacttcagaaaatccaagataaggagaagatcttacaaactgctaacctaaattccaccattcatttgtaggcatatataacttttaaaacattttttccaggtagcaataatttcttaaagtattctttaaaatttctgaaatatgtggatattttcttgatgagattatagagccccgtctcctggaaatgtttacattttcctggcaaactatggcaataaagtctgaaagtgtgtgtggaggggagtggggtctgaggatcatcacctctgctttcattgccaaatctttggcataaattgtgtgactgcctgctttgtaccttgactttattcaactttatttaaatcatgcgcatttttcatattctaaatggttgttataattatcattttaatagcttccttatattacatcaaatttattccattacaatttcctcagtcattcctcgcctattagacacttatggttttatttccctcaaatttggattattatatataatactgtcataatatacatttttatgcctatagcttcccttttattttggttcagtttattaggaagggttccctgaagtgacgttaccatgtcaaatgttatggagccactgccctgaaggtctcgattaatttacacttccaccaggtattttgatatgtgccagtttcagcatgagggtcagcactgagtattataagtttaaaataaaggccgggtgcggtggctcattcctgtaatctcagcactttgggaggctgaggcaggcagatcacctgaggtcaggagtttgagaccagcctggccaaggtggtgaaaccctgtctctactcaaaatacaaaaattagctgggtgtggtggcaggtatctgtaatcacagctactcgggaggctgaggcaggagaattgcttgaacccaggaggcagaggttgcagtgagctgagatcgtgccactgcactccagcctgggtgacaagagtgaaactctgacacacacacacacacacacacacacaaacacgctgtgtgtgtgtgtgtgtatatatatatatagcaaacttatatagtaagaatagtacatatatattacatatatgtaatagtctatcaatttgcagagtgtagaaggcatttttatttaaatgaaatggaacattttcccacatttccttatttttttctcttttgctcaccaattatcagtacttatgctatttagacatcttttttggacctgatgtttgtcttacagatatctaacagatactcttcttttgtggtgagttatcaagaaaagttgtttaaatcagagagggttgtactggttagctttgcttactaatactgtgcagacatagggacctatattttctagcagcattggcatcagaatactagtgtgatagacactgttggcttgcctgacactcatttctaaccctcttctctcttacctgtctcttttaaggagggtgaacaggctgaaacattgagtgaccagcgcatagtaaagctggaggtggttttattataaagcctggccaataaaatataagcaagagtgtgctggtgccgttgtgccacattttctctttctttttcctcagatgatgatgtggttgctggagccatagcaaccaccttgcaatcagatttaaacaaacaaacaaacaaacaggagaatggcagatagtgtggcctttattttattacattgctgaaataatgccatgaaccttctaccttttcctcaaatttatttttgtgcaaaataaaacctcgtttaagtcactataatcagactttgtgttactgtctgtggaaaaaatttctaattaagacatctgagctgggtgagaagggaattggatcttcattttatttatactcacttttaaacaaatccggagccagttttattcataaactttctactgtgaacccgtgataactgaccaaagtggaggtcaaaatttctaaattttatttacctgtttcccagtttatatccagagatatgaataagtctcctggagccaaaataaaatctgttttatttttaatgctcacaacatttgacaatgggagaacaagatttaaaggcactcacatacccaaacccagagaagtcaagttctacttgacagttacaatatgtatctgagagataaaaatccatccatgcctctccacgtccactcatttagagtcgctatttacccatttatcacatactgaggatatgacatttgacaggtatgtgctccatgccagagatgtaaaggaagaaacatactcctcagtctttgcctttgaaaaattctcttccacaccagtgatggggtgtgagaggaggtcatctacataaacaaatatatttagcccaggagttcaaggctgcagtgggctgtgatagcgccactgtactccagcttgggtgacagagcaagaccctttttctaaaacaaaacaaaaacaactctcaaatatgttttatactgtgtgagagtaaagagaaaaaaacagagtagtaaagagagattaatatcaaagggcaaaatggaatataagggccttgcccaagtctccacagccaatgaagtggtacaagttcctttaatcaaggtcttctggactacttgttacaatgacaactatgacctgaaatatgtggaccaacatctggggcatcaaattttttttacattataaaatactatcattttagctgttattgtatagaagttgactggtatgaaggaactctccctaacctaccagtatggcatatactgtgaggtttattttcctgaatgactccttcttttaacctctacagagcacctgttatgtgtctgctggaggctggggttgcaaatgtgtatgcgagtgctcctgcccccgagggccagagtcttactctcattccccttctcgcctcccctttgccacctgtgaggtggctgactgagcaggcaggtgtgaccttcacttccaatcaagccagccattctagaattgtataaaagtaacctggaaaaggggttggggaaagaatcagacctcggagctttagaaaagagactcagatttctctttctttagaaagtgatcttttctattgacttaagaaaaaaacaacttgttcaacatctgtctttcccttctgactgctgttgcttaaggaggaactgacttcccttaactctgaagtaatgtctcctttctttaggaaaacaggtgtcaaaacatgcagcaaatcagattttcaaacagctgaaataaacttgaggattttctacctttttaatgcttttagccaggaattcttttgtgaggcttatgatttcccagtttggaattttgtttctccttgaggtgcttatgagcaatccttctgcattcttattgtcccattcctgtcctccataataaatcattattatttggatgtgaaaatctattcataaaaaatgattcattattattttttatttaggtcaaatgtactttataaacaggaaggcctcaggaccacactgaattccgttgtattaaacgtctttataggaagagagaaagataaattgagctaattttgatcaatattatgactgtgaaatattccttatcaccagatgcttaggtatgaaggggagaattatgattccattttacagatgagaaaatcaaggcaaaaagagttcgctgagcccaagaccacacatttagaaactagtgaaaccagattcacacttaattctgatctaacttcaaaaaccacgcactttctagctcaccacaatggagtctcttctagtcgctatacagctttttatgttgagtagtcaagactgaatttacttattagcctctggtacttactagatgctaggccttggataagttacttgtattcataagtctgcatctccttatctgtagaatggagaaaagaacaatctctacctcacagggctttggtaaggatccgctgagttaatgcaaatcaaagagcttagaagggtatttggcatgcagtaagtgatcaattaagtttggtcaattgttattattatctgtttcttcatgaattatactatagagtacatgtcatgattttgctttcatgcatatatgagtacagctgaatagggggttctaaatgaatactggttttttaaagtttcagtgttcagtatttatatatgaaatatttcccctacttttctccattggccgataaattcagaggaaggaaaagttatctcttagtaagattctttatgaacttctgtttcagaagtgaaaaaaaaccctttttaaaaatacagataaaagcgttgctgctttgaccatggtgtgggaagggtacagattcctggatctccatatatccccctttccctttataacccctaccagctcattattgtcatgggggtacttctggggagccctggatgtcgacatcacacagactgagaaccaccactccacaatgcacacaacagaatgtaatggacagtgactgacaaatacaattaattctcactgtctgaaaaatgcctgtgtgtagaagtccttcttcctaatttcaaagtgtcaccactcagctcccattatacgttgccacagttaatgctttgtttaactggcagggtctacagtttggtaccagagaactggaggagatgggagccatgttctgtttgggcctcctcatcctggagctcaaatctgccagctgcagccatcagctcctggctcaagctgcaactctgctgagtgctgaggaggacgctctggaccagcacctccaacggtaagatgctcccaagggctcagagaaatttggaccttggtggttccattgctcaatatctcagtaatgaaagtcgagtggacctaggggtctttacacagagaaaatatggaagaattcccaagtaaaggtaggtacactatctcgtttcctactgatgaaaaagaggatgctgcctgtttgtacacatatatgcaaatataaaactatatgtatttatacatatttctaggtaacacatttatgataagatgtggcttggtgacacacacacaggatatctacatacacttatatttaccagttatgtgtttatatgtatacagataacatttttgagccattactcaacaaaaaacaatggcaatctcattgacaatatctaggcacctggagacaagaaatgttttactcttcccattctcaaacatcattgttccttcttggaagatgaagggaaccacctgaagatgattaatactttggctcagagaaccggactcccagccataggagggaaaggctagatttctgagaatcgtggagattattaatgagccaagtgagggagaaccattatccaaatgagccgttttgatgttctttcctgttgagaaatattttagacttgaccaaaacaaattcagtgggcaagaggggaagaaataatgggcatgtgagaggagagaggatggaggggagtccaagaagccaaaagcggctaagtcattgcccacactttgagtgtcagaatggatggagaaattgagttgttggggaagtgtctcctggtaaatgaggaggcatctggtcgtgcacttcacgtccaaaggcagagagaaagccattcatcctggggccatcttattttgagctaattttcttgaattttcctcctgttcctgttaggtggctgttgcagtgtgacatactgaatggccagtgaaacctagaaagatctagcagtatgccttaatactgctttggaaggccgtggtttttctgagacttgattacctaaatgcagtaattaacttgctcaccacactgggctatagatcatagactatagaaacttaagtaagtgcagggctctttccatagagctgccgttgctgatttattttgacatcacaaccacttctgcctgcccctggtcccttcaacacccctcagtgtctgaaggcttcgtgtgtttggtatctttgtggtgttttcagactctccctctgacagcaagcgcttccacctgccagcatatatatttcaacttgtcttttcatcttttcctttactaagctatcttgggtgtaggcatgcctggattttctttccttctttctctttttccccctctctcctctgctgctcattgagggaagattgagcagaactggcattgcttgctttcgtcaaattgattgtgcccgtctgtttgatccaattcagtgaggattagttgcctgcaaactggaacaaaaagaaatctatcaaagaaatgccttttctaattcaagtttaaagaatttgatgtcaggcttcaaatacaatggctgctatataggttattataaggagatagtattatttgcctccacccttccacaccatttcacacaattattcatttttcaattgcatcctgaccaaggggattgaagctagaggtcctcccatgacctctgacctttcctaggctggtgcagctcccagtctaggaaagatacctgaacacaggatgtgattaatatgtctactttgaatatatttgaattaagtttggcaggcatggagtttggtgtagatcagcaggagggaaactacctatttcacccagacatttgtatggtaatatattttcctattcgttatgatgcagttgaccacacggattgcgattcttgcccaaaggacctgaaaactgcatggttgagagggagatcaccgtgagcatttcttgaccccaaaaatgttccagccaataagcttatggtcacaaaaagatgacagagagaaaaatttataaaatctactggtttgaaaccatcaacaggctttttgagaaccatttgattagtttctgaagaataaagttaaatcctgagatataataatcagcagagtgaatcctagaacttttgttagtatcaggattcttattgtaatacaaagagtgtaaccaatgtttgtcaacacaaatctatgtatgttttaaagaggagacctctaccaccctcctctcctcctgcctctttctttgacataacagggtttccagcatcctacaagaagatttgtattgttgttgcgtggaaggaattgtgaataacattgtgggtgagggggctcttctccaaaggtctgccctaaagaactacaagaatggctgggtgcggtggctcatgcctgtaatctcagcactttgggaggctgaggcgggtggatcacgaggtcaggagttcaagaccagcctgaccaacatggtaaaaccccgtcttgaacctgggaggcggaggttgcagtgagccaagatcatggcactgcactccagcctgggcgacagagggagactctgtctcaaacaaacaacaacaaaaaaaatgcaaggatgtggtactgcatcctctcctaggcccacagacagcattaactccttgggagtgatcagccaggaagacaaagtgtggctgcacactgtggacatcatgttttctgacaataggtttcatgcttcatttaccataaaaacaattagagtgtactcaatatccacagagcaactcaacatttttcaagagcagaggaagagcagagatagcggatgtttgcctggtggctgacgctgaaaatgaagtacatgcatgctttgtttttggtttccttttgcagtcctcttcttcccagttgctcatttcagaaatgtctgcatactcacgaaagcatcttttgatctttcctctcctcttcctttctccttcctctcaatcttatccctggaaataattgtgtgtgcactgcaggaatgctaagctgcttcttcaggaggagccgtttatccattgtgacaggtcttttgcaaagtcacttaagttttgccgagtcagccactgttcgtctcgatttgtatccctccactgcctcttgctcttctcagccgagccccccacctccatttgtccctcacttaataacaagagaaagctaaagctcagagcttcagagctgtgcctcagcaatggctcaacacctcccgtgttctccgaaattatagtcctgttgctttagcctgggctcaccttagtatctacataaactaggtttgtttgacggacaacactaaaagaataaaaattctacatagatattagaaaaaaaagtttaataattaaaaaggtgcttgattttcatttgtaaaagtataattttgttcttttgaatgagaaaatgaaattaggaagacagacaaaagcgcccctatccctgtctcagcatccagataactactgtcagcattatggcgaaatatcctaaattatttttctgtttttaacttaatttattgttttaaattgacagataaaattgtatgtgtttattgtgtaccatatgatgccttgcagcccatatacattgtggaatggctaagtctagtaattaacctatgtatcaccccacaaagttatttttgtggtgggaacatttaacatccactcttctatcatttctcaagaatgttatatattgtcattaactatattcaccatgctggcaataaattatttgaacttattcctaggttatattttttacctatggataaatagacatacagtactctcaaaaacaatgtgctataagttctccttttttgcagctttataaacacttgttcctattttaaaacttttgccatttttaggagaaaatggggtgctgttttaatttagaatttgatgttttctgatgcagataaaaatccttctatatcatgaggagtattttttataaatttcctaatcacgtctttgtgcattattctgttaaccatccctttttttaaaaaagttatatttacatttaattttaatttctgtgttaaaggtactcaacttctgtttgtcttgtatgctgcaaatattttccccaaattgtcatttacctttcacattttctatatggtttattgacattgaatatttttgctttcaagtaattatgtttatcaattcttttctttgcttctcttaccttggataaacctgtctacctcggtttaataacagataaattcacacccactgtttatctatctgttattgaactgaggtaggcaggtagttttatagtgagtatatttacatattataatttattttccatttttactattgaatcattttgtatttttaagtaatccaccttttatcacggattagtaatgccggtttattatatagtatatacacatgcatataactgggtatattttttggatttgtattctgttccattagtctgcctgccaagagcacgtagcttttaatactgtagctttgtaatctaaatgtatgatgttgcaaacaccacctcattagtatttgtttaaaaatgtgttttgctgcattctcttctttattttcactgatgcactctataatgagttgttagctgccaaaacctaacccactgggattttaactcaggtaatattaaattatagatatttttggtctattgagtgctcgtctatgttacttttataaaatctgatatttttatttactgattcagatctgctttgatgttcatcagtaaagtattgtagggattctgttcgtatcctttttatgtagttcctgaatatatcatcataaacttttaatctcaatatttaaaaaagttttgttcatctaaaaaatgtgtatttttcactacattgcttctaagtgcttgttttagttatataggaaatttctgggttatttatatatttatttgtaacttcagtgaactctctagttatacctaaaagtatttccagggatttttctgtttttctggatagaaaacagtatcatttataatttttgaccatcagctttgcttacttctttttcttatcttatgatctgggctagagttttgagactaatgtttaaggctgaggcatttatgagcatcctcaccataaacctaacttcaaaatgagaatgactctaagcatttaagaattaagtgaaatggctcttggtttgatattaatatttgatatcttctccattattactatattttcttagcttattaatttaacaaagtccagattagatgattaattttatcaaaagattctttagtatctagaaaaataactatttacttgaattaataaaatcttatagattttctaatattcagctatctttacatttctaaggaaaatgtatctggctgtgatctgaaatattattttaatgtagagattgatattacctactgtgaattgaggagttttgtgcctatatttgtgagtgagtgaagtctgtgcttggtttctattgttctatgacctggaacactttaaatttcctaggtaggatacatctgcaccttgaacatgtacatactgcctgtaaaatcatctgtgttctatttatttgaaacaaaaatattatttttccaatgttaattttcccaaataagaattatctatggcatttaaattgtcttataatcatattcagatcattttaaaattcaactttgtgtttaatgacttgcattgctcatctctacccattgtatgcaatcatgtcctcattcttttttctcaatgttgattcatcttacatttttcagagagcaccttaaaagtagcttttcttttttaaaatgtaaatcaatggagttttttgcatattaatacatatgtgaatatccttctcttccctttacctaggaattctactttccctgcctagagattttatgggtaacacattaaaacaatgtagacgtggccaaatttactctggtatgtaatcttatggtagccagcctaatttttctttctttgtatgcaccctgttttttctttttcttttcttttttctttctttctttcttttcttttttttttttttttttttgagatgggggtctctctgtcacctaggctggagtgcagtggggcaatcttggctcactacaacctctgcctcctgggtacaagggattatcctgccttagtctcttgagtagctgggattacaggtgcccaccatcatgcgtggctaatttttatatttttagtagagacaggttttcaccatgttggccaggttggttttgaactcctgacctcaagtgatccacccacctcagcctcccaaagtgctgggattacaggcgtgagccactgcacctggccgcaccctgtcttttctaccttcatagttgtagtagtttctctgtgttccctaaaacaaaaattatttctctactacatcaaaaatatttctttctttcctcacttctttcttttctcttgtgtgtgtggtttagttcctttaattgattttgaatatgaacattctattctcttgaaacatgtctcaattataaaggatcagtgatgccaccccacgtcttcatttatcttcctctgaagtgtttgttatctgttttctcacctctgtatctgttatctcttcttctttaatcctttttacctccttgccccaattcatcaaattctggaagtatgtctcaagtttgccctcacacattcaattttctgcagcatggactctctgctctttgctgataacatattttaattttggtgactttacatttaggtttcattgcacctattcctcatctttcatgagtttccttttattcatgtttgtactattgccagctcactttccatttggatcagttatcttttcatttatcgtcccatagattcctttttgaaaaacaactttccagatacctttatacagcctcctgtgtcctgtggctagtcattcccctgaagtgcaccactgccaagcttctggaaaggcattggcctccttgtacttttgcaggatgtttcaccacctctaggttgtgcttcttacctgtttctgctcttccaacttcttttcctcattttcttttggtctattcattttgaatcatgagagctctatcatgacttacaattagtcaataatcaagagtttatatgttctttaagcccttttatggtctagctggatgtagagaggtcctcttgttttaatagaaagtaacgtgatttaggtggtgctttctcttcaagaattcatggtattttggcttttacctgagagtacaaagttgggtgattgtgttggagaggttaaggagagcaggcatggagaagtgaatgaagatggaaagtgccctactaatgtctatgggccaaaatgggaaatttgggattggagacaatggtttccataaagatcccattacagtaaagcgaaggatggagtcttagtagaatcttcagtttcaagttaactttctgtttccatcaattccaaattaatgctacgtgactattctggtaatagctctctttaattatctgctgttgtcttaattctattcagattttaaaaattagcgcatagtatgaaatatctgagactattcttagcttctttctatagttgcaggcaaataaatgctacatgttgggaaatgttggaatggaactccgcctgggaattattatagattatgagtaccatatcctgctttaaaacattaaatggctccctaactggtcaagggaaatgaactgattggccagaagaagtgctaattttaggctgggaaaacaatagcaaaaaacaaacaaacaaaaaccttgtttcattagctgttaaaagcaaaatcaaatatttttggtatgattttatgctgattcttctataatagataaattaaaatagtgaaaacccagtgttcacatttctgtgaagaaagaggtttaataatatcatgaagctattggtaaattgatttacttttctctggagagcaatttggcagtttgtaaaaaggcccataaaaatctctcatttgatcctctgtttacagcttacagaatattactcaagacaataaacataacagaaaagaatatttattatgcacatatttatataaatagtacttatttctccacaaaattttaaacaactcaaattcttagcagtaaaaaaagaacattattgattaattttctgaattactatactaccatgaaaataataagtatgtcaatttatatataagataataataaagcaaacatttattagggccttaccatgaactagatgctgtgctaagcattttataaatattatctctcttaatcctataaataatcccatgtagtagatgcttccattaacattccctttttaccaacaaggaaattaagttttatagaggctaataagtttgccaaatgtcatgactatatttaagggactgcactggcatttgaatctacttttgcctaactccatggctcaagttcttatcctttgttatatttagccttttgaataatagatgaaaagcaaagcagagtaattaatggtgtacacatgctgattacgagttcagcaacacaaaaaactgacagatgggggggcattaaatgtataatctaaatttaatttagttttattaatttctctttatagttccttaacgtatgtattgggtacatgtatatctgtgtgtgtttctgggtaagttttaaaactcaaacgacttgggttcattttggaccataaatatcccttgattgttttaatactattcagggaagattaatgtataccattataggttgaatgtgttgtaacccatggtgaattgaaaagagaaaaagattgcacatgccaaggagtgaaagtacattttcttcatactgcatttgctgcttccaaaatgttaccacctaataacaaccatgaaagttaacctaaaataatgcctattttacaagtgactccatgggagtccagggaatctaagtgacttgctaggtgtagttaagtgatttacacattgccagtcaacatgggggatctcattcacctctgcctcaggctcaaccaaatgaacggcaggtctcttgcctatgaaactataaatacctgaaaatagaataggctaccagcccctggaaaaggatttcaatcaagaaactcactcttactactctctatagcaactgcagcccttcccagcccttgtcttttgttgtcaattctaaaaatggaaggcaaataaaacttttgaagttttcccaaacaggagcagttgttgtcatttaagaaggcttcaaatagcctggcatgggtggtctaagttaactcaataacttttcattaattttacatcattaccgctttctcttctttctatctaattcttatttctttttattaagtaccctgtgacacctatggctcttaccgaagagctagtcctttaggtcaaagccattttactggtgagagcaaatctaccagatgtgctagaggaaaacaaaagtgtaaatacaatagtgaaggcaaaggagagaagggatggagggaaggaaagagggagggaggctaatgaacaggagaagaaatcaaggcatttgaactaacagatcgttatggggataaaaagcatcttagaatgtttacattttttggtttgaaagatcatgagcttagattactgatttagaagaaagatggtgccttttaaagtttctgtgaacatttccacatttttacctgatttctttatctttgccaattgccaagttgccccctctcaggaaggaaggaagtaaagaaccctggctacattctactgtacccaagatgaaatagtctatcatggcttttgctgtcctgtaaatttccatgaagtcctcactttagttagtacctagcatagttctctctttttttttttcttttttctcttctatttctttttgtttttgagacaggatctcactatgttgcccaggctggtctcaaactcctgggctcaagcagtcctcttgccttggcctcccaaagtgctgggattacagatgtgagccaccacacctgacccgtagcatagtttagatcacagacataaggcttaaattcaaggaagttcaattctgattcaaagtatttctgggatgacaagctctgtgaatctatggcgttgtcttaacttgtttactctcagattttttggctttaacattagggaatctcctttcggatctaatatcctgcatttactctcaaaggtacagctactgacaccctcacattctaacatcagtagtagagttgcaaccctgaattcaagatacaaaaggcaaagcagttgaattatgctaagtggcaaacagcttgtatttgactgaataaaaattaaattttatttttatgttgactggatagatgataaagaaacagaagccttactagtgcatgggtaacagaaaggagttgtaaacaagcaatgagaaaaagatgggaacaaagaggtatgtttagaagtagatatcaagatgtgtggaaaatatcaaaccaacatctagcatccaaagtagaatccgatacaagacgaccctttacaaggggcttaaatgttcttaccaggaatgtcaataggtactattttctgtttctggacatggacacctcaggagaaagaagtgattacctctgcttggtccttttagtttctttagacagatttgtccaattcagacctcaagtatgttctagtaagccagaaaaatatcttcggtcatgtgatagctcatcatagacttactgattctatttgtggtgagagatgagcctattggaaaacgaagataacttagcataagccaatattgtttcagtacaataggaatggaaactaaattagagtcaataagtttatgatgacttagcattcatcattttattatgtggctttgaatcagaaaagctgactagctccctgtgctttgccagtgagtaataaaataagtagaaggaagagacgataatgatatagaataccatgtgcctggaagtgtgataaagatttgataggcattatcttaaagcaagtttagaaagtcattattattattactattatgattaatactattttatagataaataaaaggaggtttatgatgctaaatgtttgataaaagccaaatcagtattatatgactgatcagtgattcaaatgttggtcactgaatcaaagctttttctcttttatttctgaaacatattgcaaatgattctgaaaatatattcataaaacagtttccaggatgaagtggaaaaattagtccataaaatgtgatctatataaatcactgttctttaccgaagagctgacttcctgtaatttcagtacaaagatcgtaacatcctccactatagggaaatatatgtgaaagtaagtcccaatgatctaaacttttcacccactagatgttccaggtcaggaagcaaaactagttagcctgcctttgttgttgttcttgatctttatgtatttaattacttgtggtcaacctagaaaaagtgaaagaaacttctcctccccactctcagcaaaggacatgcaatgattttttaggtctacatgatattggctattgaatgtttgctttttaaaggattgatctagtttttttaaagaaggcctggagagtttgaattgactccatctcctatcagtgaagtgctgaggacctagaagtgatttgcattccagtcttagctagtttttaacctctcacatgttagtgtgtgaagaaatagacaccagggaatttggtatccccatcagaaaaataggagttaatggcactactgataatagtaactgatgtttattgactgcttagcatattctaagtttttttttttttttttttgagatgaagtcttgccctgtcactggagtgcaatggcatgatctcggctcactgcaacctctgcctcctgggttcaagtgattctcctgcctcagcctcccgagtagctgagattacaggtgtgtgctaccacgcccagctaattttttgtatctttagtagatacaaggtttcaccatgttggccaggctggtcttgaactcctaacctcgtgatctgcctgccttggcctcccaaagtgctgggattacaggcatgagccaccatgcctggcctctaagtttttattcatatgaatttttatcatctctcacaacaaatagtcatgagatacataatataattatacatatcccattggacagagatgaaactgaggcacagagagcttaaataacttgcctaagcccacacagctagtttaaataacttgcctaagcccacacagctagtaagtgatgaagctgggttttgaactctggcagttagactctaagaccagaatgtttaaccactactcccatttgaacagtggatgtggttttgtaaaatcattcatctctggtttctaacttatccttgcaccggtcagggttttgtcaggaaaacaagctgctctatgaattccagatatcaatggcaaaaaaaagggaattagaggtttattaaggcattgaaaaggctatatatggaaacaaaggcaagaactctgtggccagtttaccttcaatagaaaagttggccattttcaagagcacacctagaagctgctgtgagcctcaagaacttctaagacactcttgtcaggcacctctgtctgcaaagtcggctggagaacttctgaagtaactgccctcacctgtttctgtagccaacaaccaagaagaaggtgtctggctgaggcttgcctgaaagctaattagaccctcatgtctgctgcttgcccatccatctgacacaaatgccccctacccaagaacaatggcctcttctcttctgcttccaaatccaacaaatagattgacagaatctaacctgaaaccttggagaatcagagtgaaaggataggatgattatatggctgaatactatgtaatattttaatatagtcatgagtgatttcaaaaatcatggcctgtgaatagacaaatctacagcttcaaagcagaagtatgagtgccataagagtaaagcataggctaagttagttccacaagttgctatggagtagattgatgggaattcttaaatctgcacgtttttgttgagtttccaaagtgtacataatgattacaataattttaatttatataattcttcactatgttcaggtgtttctatttatagcccctcgatgagtgtcctcagatatacactgaaatattgagagtgtgagagacccatacacactggcagccaggtcagtacaatcacctctcagcatttgtaaatcatatcccaggcacagttcccctatatccagtaaaatagttgttactaattccatcagcaacacagagattttgtcttccccaagaccctaacttttgttagcagcagaaatgagaacagggcatgaaatgagaacagagtatgaaacttccttaaaaagttggaatttataaaactaatgccaggagaaacaacaagcgcatgtcgttgtttcatgtatgaatgcagctaaaggggaaggcacattgcttggtgctgcaggggattgatgcttgaggagggaggtcctctctgacccttggatgctgctttcttcacaacataaagatgatatttagactgagaaagaggaggaggagaagggtggggaggacaagggaggagaaagaagggaaggaggagactagaagaaacttgccaagaaggaacagaggtcaaggtgagagagggaactctgaatgaattcagggttttcaaactgtctgaattaaaatgcaattctgaaatcatatgcaaattaagttatctaactcttttccaaggtatttgaggaggcttatttgcaaactgaagttgagcaaatattgttttactgtccaaaactgagaaagtggtatagtctcccgaatatacgcaagtgagtgtgatgcagatgtcaggagggcatgggatggattatcaagggaggtttattaggttcttagaaaatgaatcaaacattactcaaactaccaaatatttccctatgaagtgaaatgttcaaacaaacctgattttattatagctttaacgaggcgggcacaattgatacataataaactgcacatatttgaaatactaattggatgattttggcatatctatatatctatatatatgcataaaactatcaccacaatcacagttattcccatcatcacaccaaatatcaagttcctttgtaattcattcgtcactctactccagtatccccagacaacaactgacttgctttctgtccctaaatattagcctgcatttttagaattttatgtcaatggaatcatatggtatgtactcattttccatttagttttttacactcagcataatacttttgcgaattactcgtgttctaatcctatttcattttacttttatatggtaaatggtcagtggatcaaagaaagcagaatttgtttacctggatgtcgaccagatattctgtttctctaacagcctgagacgcatcagttctaacttaaaatttgtcactagttgttcctctgtctggcatgcattttctacagatggttgcatagctggctcctctttgacattcaagtctcagcttaaatgtcataatctcagcttaaatttcaccatctcagcaagacttttcatgaccacattgcctaaagtagcatttctagccactcctactgtaaggcctctaatttagtattatctgtctcctccagctagaatgtataatccatgggagaaggaattttatctgtcttatttaaagctgaatccctagcacctagaataatgcctgatgcataggaagtaatcaataaatataataaatgaacaaatctttgtcaagcctctcatcctgtatttatgggaagatatgaagacttacgggctaaataacagtataattccatgcaattgttgttcattgatggaatatattcaaaatacgctgattaatggatattaattaaccttgatggggatttacacccatggcattacctcaaattctgtcctattagagaacttttatgtattaaaaaaaattagctgtaactatagaaacgattgtcccttcctgtataatgtgatactacaacacattaggataatataattgatatttaaaaaaatctttacagattgaaatgatggatgatactaaaaagataaaagtggataaggataaattctgctcaaagtgttcctagccaagagcatgccaccttggaagagtacacggttctctatatgggaattgtaattggcagtgagcttaaggctctgtgtgctaaacctgcaaaagctcttattgcaactagtaactttggtagaaacataatgtctagaattagatagggaatggtttctgttttgctgtggtcaacacaaaacctagaatattatggttcatttctgagccacagaaatggaaatgggttcagtggattgactgcataatggtaagtaaagagtgatacatacaaggaatgttataagaaataggtagtgttcttttgttagctgtcttcaaatagctctgtaatgaaattaaagtcttgcttatagcaaggaactaagatttattaatctctgatactacaaagacctgtctgatgatcacagatgccccaagatagaatgaactcttactgacttgaggaccatacagtgtttggaaagacttaaaagtatgaatttatacttggaattgacagcatagggagtttgtaccaactctgaaatacaaatgaaaacatgtcatcttaataaagaaatccattcgttttcatttaattcatttggggtgagatttagtccattcacctttttaaacaggcaaaaacgctgaattcttccctaaattccttattaacatgggtaatccactgcagaggtaggtttgaaaagtggcaaggaactgggatttgtttgaaaatttatctcgaatcattagggtgacaaaggagagtaggtttttatttgtttaaggcacagaagagtagtgtgtggtagggtgttggaaggtgatgctgaaggcactgaattatggggatcttagtcaccatagaaaattatgcttcattcctcaatttctgtttggttgggtggttttgtgtgggtgcttgctgagagggtactgtccaatagcatgggtgctgaattgttagtctcttgaagggaagttttctcagcaatctcattagtagaatgaaactgcaggtgacaagataagcttgtctaatttatttatttatgaattctattgttcataattgtattattaatcagggaaatgtattagctattgatgtatttttcttttatgtggacatttattttaaattgtaagaggaacaaaagatattaattcatattaagtagtaggttgcatttttttttcctagacaattttctctattaagaagtggagacaaaggaagaacaaagacatatttgttacgtgatatggaagcaaaattgtttctaaataatactgttgtgtggtgtattcctggaggtactgacagctccttataaggcaaatgaacattttggctaaagtttgcaagcaaaacacaaggctaattataaaatattcttttgtctcttagcaaactgcagggggcaagagcgagcttgtgtaagcactgagagcttggatttccctgggtgctatcttctcacatgtgtttttaaatcttccaacttgtgattattatttttcagtactgaattagtgaatcattttacatagtgccattatgtaaaataaaatgatactttgtttctctgcattggccaattactgggaggggaaaattggactcctgaaaggcacatgtgtgtgtagtttggcagattacaggaaagccttgtaaaatgctcccagatgtttgatgcatgagagggaaaatgccaggaacaaggatcaaattgaggtgggtttcagacattataaaatctgttgatgtaaaaactaagaaaacaaataagatcataggcatgaaatccttctggaaggtcaataatgataaagttttactatattaaaccgatttgctccttttcttttcccatctgcctgaggctgttataaaaaaatattaaggaacattattgctaatccataataaatggtacattaactatgatccaacttatcttttctacacaagggccacgggactgcatgtggataaaatctggactggatttatttttttaggggcctgatcccatgtccaatcattaacctttaaggtggttcttaaaaataattttattattaagaagttgaatcatcataattatagtatccctctgacttcaaagagcaatttgaggcttgtccctctcttaatatgaggtttcttaagctcgacaacactgctggatgaggtaagggttgtaaaactgacctcctttggaatggtgtgaacccgggaggcggagcttgcagtgagctgacattgcaccactgcactccagcctgggtgacacagcaagactccatctcaaaaacaaaaaacaaaaaacaaaaaaaccaaaaaagctgacctcctttgagtgccagaattgttctcgaatcagtccacatcctagcatcaagcagatggcacatggcaaaggcgtaattgaggaaacttcaatgaaggaactctttacaaagcaagatcagggaagcaataaagaaaaggtgaagcaccttgggaaaagcagaagtgggaagttagtatcacccttagtgaggaagagggtggaactggcgaagaattgccctcacctatgaaagctgggggctgtagaaggactacccaccaggaactgcagccttaggtcacgtagccactgccaaacaatggcttcgcaaggagggaggttgaggaataaataccacatctctttcacttgctaacttcttactaacttactaaattcttctttcaaatttttttttatttccattgattttggagggaacaggtagtattggttatatgagtaagttcttcagtggtgatttgtgagactttggtgcacccatcacctgagcagtatacacggaatccaatttgtagtcttctatccctcatccccctcacaccatttctcctgattccccaaagaccactgtgtcattcttatgcctttgcatcttcatagctgagcttccacttatgagtgagaacatacaatgtttggttttccattcctgagttacttcacttagaataataatctccagttccatctaggttgctgtgaatgccattaatttgttcctttttatggctgagtagtattccattccatatagatatatcacaatttcttcatcctcttgttgattgataggcttttgagctaattccatatttttgcaattgagaattgtgctgctatagacaggcatgtgcaagtatctttttcgtataatgacttcttttctctgggtagatacccagtagtgtgattgctggatcaaatggaagttccacttttagttctttaaggaacctccacactgttttccatagtcgttgtactagtttatattcccatcagaagtgtaaaagtattctcttttcactgcatccacaccgacatctatttttttttaattacagccactcttgcaggagtaaagtggtatcacatggcagtttttatttgcatttccctgatcattagtgatgctaagcattttttcatatgtttgttggcaatttgtatatcttcttgtgagaaatgtctattcatatccttagcccacttttttgatgggattgttaatttttttcttgctaattttttgagttccttgtagattctggatattagtcctttgttggatgtatagattgtgaagatattctcccattctgtgtgctctctgtttactctgttccttttgctgtgcagaagctttttaattaagtcccacctatttatctttgtttttgttgcatttgcttttttggggagttcttggtcataaagcctttgcctaagccaatgcctagagggtcttttccaatgttatcttctagaacttttatagtttcaggtcttagatttaagtccttgatccatcttgagttgatttttgtataaggtgagagatgacaatccagtttcattcccctacctgtggcttgccaattatccagcaccatttgttgactagggtgtcctttccccactttatgtttttatttgctttgttgaaggtcagtttgctgtaagtatttgggcttatatatggattctctattctgttccattggtctatgtacctatttttatgccagcaccatgatattttggtgactatggccttatagtatagtttgaagtcaggtaatgtgatgcttccagatgtgttctttttgcttagtcttgctttggctatgcaggctcttttttggttccatatgagttttaggattgttttttctagttctgtgaagaatgatgggaatattttggtgggaattgcattgaatttgtagcttgcttttggcaatatgatcattttcacaatattgattttacccctccaggagcatgggatgtgtttccatttgtttgtgtcttctatgttttctttcagcagtgttttggagttttccttgtagcagtctttcacctccttggttagatatattcctaagtatttaattttttttgcagctaacgtaaagggtgttgagttattgatttgattctcagcttggtccttgttggtgtatagcagagctactgatttgtgtacattaattttgtatcctgaaactttgctgaactcgtatattagttctaggagctttttgatggagtctttagggttttgtaggtatacgatcacatcatcagcaaacagcaatagtttgactttttctttactgatttggatgccatttatttctttctcttgtctgattgctctgactaggactcccagttctgtgttgaatagaagtggtgagagtggtaattcttgtcttttccagttctcaaagggaacatgttcaacttttccccattcagtattatgttggctgtgggtttatgtagatggcttttattacattaaggtatgtcccttgtatgccaatttcgctgaaggttttagtcataaagcgatgctggattttgtcaaatactttttctgcatctattgagatgatcatgtgatttttgttttgaattctgtttatatggtgtatcacatttattgctttgcatatattaaaccattcctgcatccttgatatgaaacccactcaatcatggtggattatctttttaatatgctgttggattcggttagctagtattttgttaagaatttttgcatctgtgttcatcagggatattggtctgtagttttctttttttgttatgtcttttcccggtttgggcattagggtgatgctggcttctttgatgatttagggaggatttcctctttctctatgttgtggaatagtgtcaataggattggtactaattattctttgaatgtccaatagaattcagctgtgaatccatgtggtcctagaatttttttgttggtaattttttgtattaccatttcaatcttgctgcttgttattggtctgttcagggtttctaattcttcctgatttaaactgggagggttgtatatctccaagaatttatccatctcctctaggttttttagtttatgtgcacaaaggtgttcgtagtagccctgaatgatcttttgtatttctgtggtgtcagttgtaatatctcccatttcgtttctaattgagttcacttggattttctctcttcttttcttggttgatcttgctaatggtctatcaattttatgtatcttttcaaagaaccagctttttgtttcatttatttttgtattgtatttttttgtttcaattcatttagttctgctctggtcttggttatttcttttcttctgctgggtttgggtttggtttgttcttgtttctctagttccttgaggcatgaccttagattgcctatttgtgctttcttagactttttgatgtaggcatttaagattatgaatgttcctcttagcaccatctttgctgtatctcagaggttttaatgggttgtgtcactattattgttcagttcaaataactttttaatttccatcttgatttcattattgacccaatgatcattcttgagcaggttatttaattttcatgtatttgcatggttatgaaggttccttttggagttgatttccaatttgattccactgttgtctgacaaagtacttgatataatttagattttcttaaatttattgagacttgttttgtggcctatcttggagaaatttccatgtgctcatgagtagaatgcatattctgtggttattggttagaatgttctgtaaacatctatcaggttcatttgttttagggtatagtttaaatctgttgtttctttgttgactttctgttttgacctgcctagtgctgtcagtggagtattgaacttccccactattattgtgttgctgtctatctcatttcttaggtctagtagtaactgttttataaatttgggagctccagtgttagatgcatctatatttaggattgtgatattttcctgttggacaaagccttttatcattatataatgtttctctttgtctttttaaactgctgttgctttaaagtttgtttcatctgatataagaatagctactcctgcttgcttttggtgtccttttgcatggaatgtctttttccacctttttaccttaagtctatatgagtccttatgtgtcaagtgagtctctcggaggcagcagatagatagatacttggccggtgaattcttactgattctgcaattctgtatcttttaagtgaaacatttaggccatttacatccaatgttagtattgagatgtgaggtactattccgttcattgggctatttgttgcctgaataccttgttgttgtttttttaattgtatttttgttttataggacccatgagattcatgctttaaagaggttctattttgatgtgtttccaggatttgttaagagatttggagctccttttagcagttcttgtagtgctggcttggtagcagcaaatttctctcagcatttgtttgtctggaaaagattgtatatttccttcatttatgaagctaagtttcactggatacaaaattcttggttgataattgttttgtttaaggaggctgaagatagggccccaatcctttttagcttgtagggtttctgctaagaaatttgctgttaataagatagttttttttaataggttaccttttgcttttgcctcacagcccttaagattctttccttcatcttgccttagataacctgatgactatgtgcctaggtattgaagtttttgtgataaatttcccaggtgttctttcaacttcttgtatttggatgtctagttctctagcaaggccagggaagttttcctcaattatttcccctaaatatgttttccaaacttttaaatttctcttcttcttcaggaatgccagttattcctaggtttggtcatttaacataatcccaaacttcttggatagtttgttcattttgaaatctttttaaagtctttgttggattgggttatttcaaaaaccttgtcttccagctctgaattcctttcttttgcttgttcgattctattgctgagactttcctgtacattttgcgtttctctaagtgtgttctttatttcctgaagttgtgatttatttttatttatgctatttcactgaagatttcttccctcacatcttgtatcatttttttttttttaattttcttaagttggagttcacttttctcttgtgcctctttgattagcttgataatcaaccttctgacaattcagggatttcttcttggtttggctccattgctggtgagcttgtatgatttttgggggagtgttaaagaaccttgttttgtcatattaccagaattgtttttctggttccttttcatttgggtgggctatgtcggagggaagatctggggatcaagactgctgtttatattcttttggcccatgggttgttcctttgatgtaatactctcccccttttcctagagatgtggcttcctgagagcttaactgtagtaattgttatttctcttctggatctagcagattcctgggatgtgaactatcttcaggtctctcagccatggataccagcacagtatttgggctgtctcccaggtcctgcaacaacaatccacttccttcaaagagtctatgaattttcttagctttcctagtatattcctgcagtagttcttggagcaaaagttcacaatgtgagtctccacatgctgctctgcccatatgagttggatctgcaatttagtcctgcctcctatccgccattttttcctaccccttctttctcttactaacttctaaactgattatgccacaatttgtctgaacccaactaatagcccaaggcaagggagattggttaaagtagtctttagggttggtctcctaggacatagagtgggatgcagaaaactgatgaacagacctggaggggaaaagaaagaataaacagcacattccacatgttagtttattggttcttcgaaatatcccctaaaataactagtttccttatttttatagaaaaggatactgaggttcagagtgattaaacactttgcctcagtacgaataaggatttgtctgacttcaatttccacgttctttcccttccctataccatgctgcatacccacctgcacccccatacacagtgtttccaatgatgttctttaggggagataatccatggaagtaaaacaatatattgttgcatccgctccttttttattggaattccatctgtatatagtgctgatcattgtttttttttttttttaaaaagagaccaacaggatttatggaggtgactgatcagtactctcaggcaaggaagctcaatcccactatcctactctgcctatctagtgctgcagtttttctgggatgcctaaaaaagacagtaggaatttgagacagtggttctggaacaagacgtgaaatgccattctgagatcctgctgccattaatgaaatggattttgaaggtatattgtgaaggttgtaggttgtgaaggttaagatcattactgaaaaataaagatttattcaacgttttcatttgatatatatgtaatttagacttcttgtggattcctcttagtaagatgagaccaaaatatcagtttttaagacttcattaaaagtctctataactttcttttcaaataataaagatgaggaggtcaaagtattaaatcataaaaagcaggaagataaagtattctcaatctcaggtaacatgcctttcatattttttttagtgttttaatgttaaccttttatctttaaataatttcaacctcacaaaaatttcaaaaaaattttgtatatcttcattgagatttgtcaaatgttaatattttattatacacagactatatatacccagtcatttttttccaaatcatttaagttgcagatataattcaactttattccttaatatctcagtgtgcatttcctaaaaatatatattcctgcctaccagtgcagtataattaaaacaatggcaattaataatgtaaaaacaatgtacaaatcttactgaaaatgtttagttgttccagcagtgccctttatagcaataggggacaaataccttggctacaggatccagtcaaaataataagattcatttcgttttcaaatctattgagttttctttaatctagaacagttccttgatctttcttggcctttcatgacctttatgttttttaaaagattttagtcagttattttgaagaatgtctctcattttgggtcttcctgatattttcttttgattaaatttagcttatccactttgggcaagaataccacagggacggtgtttttgtctttattagtgcttcatacacttagacatgagcacatgtggttgatttgtcccattacagatgatgtttactttgaccgcttgtttaaagtagtgtctgccaagcttcccctctgtatagtttctatttttccttgtaactaatagctattttgtgagatgctaccctgagactatataaatgttctatttttaaaattatgcacctaccagttttagcatccactgatgattctttttcgtctgaaacaattattattatggtgaataaacgccaaattgttattttccaattccattatttcctctacatttgttagttggcattctgtggtaaggaagagctattccttccctcttctccccatttcattatgtatttatttaggtatatatctatggattcaaggattactcttttcttcagtgacttacaattcattattttatttaggcatatctctgtggattcaaggattacttttttcttcagtgacttatacttcattattatcattatttattttgatgctcaaattctcctaaatgttgatagtgggaatttctcatgctggctgttgtatccttttgttatgtctccatcattctctgagcaagtctttattttctggcacagcagtatgttctaggttcatcttgtacattccccaattcatctctagaatcacccatttttaaataatgcttggtccttttgtgaagttagtattataaaccaagatgtaggtgttgttcatgtttactttttcagcagactaatacacacacacacacacacacacacacacacacacacacacacaaaatctctcttgaagtggtctttctcttgacaagaagtagtttaggcaacaatatagtaccttctttagaaaagatatagagcattaacacttttcaagatataatcaaaacttgcaattttcagctggtgaaaattaggaccaaaaaatagaaatgatacactaaagatacaggcaaggatttttgctgccttgtgttttattctgtgcctcaagtaatcctaacttttctttttctgtgcttccctgttctcagagaagtttcttcatgagatctagtttattaccaagatacctgataccatgaaagttgagattcgagtgtagtttaaatcgattcatccaagtgaaaatgttagtgtttggcctggtgttcatgtggtctccacaaacaaccccaagagacagtcagagtcagccggatcaggaaccatgtgaaatgctgtgaatctgagcatcctccccagtcgtgctgagggaataaagtgctgagggttgctccagagctgtgtcctgtgctcattccctggatgaattccaggtgcacattaacagtttaactttgttaagaaggtgtcagcctcggatcatttgcattccattatccacagtgctttttaattttgtgcctgctttggaaagtaaatgatgacattctgctgggagaatttcagcctgtgtgctctttataaagtaaggaaatggagtaattatcacagagaaggagacaagagaggatatgattttcacatttggtgcttttagagagtggtgtgtgttggaggtttcattggagaggggaggtgaagggtgaaaaaatatggggactctggttgtgtgtgttcataattctgaagctagaattgttaataattctggaaatccttcataaatagttgatagaatccacatggatgtttacaaagtcccagctgaattgtgctgagtgtgcacaaagatatacatcatcagaattgtgggtaaatcaagattaaattgtgaaacaataagaggcttatactcaaaggttaagacttgctttgtctcttgaatggtctctagagattaggaaaagaaagcagttgaagagaaccagatagaatggtaaaacatgtctcctctcctctcctcccctcccctcccctctccattttttccctccccttccttccctcttctcttcctcctcccttcctctgccttccactcccttccctccactcctctctccttcctttcactcctttccccttcctttcactcctctcccctccccactccttccttccctcctttctcttccccacctctcctcctttccactccccatctctcctttatccattccttccccttcccttctcttttttctttccttccctttctttcactttcctcccatccactacccttccttcccctcccctcctctatcccttccctccactccccttctcactttctctcccttctctccccttcccttgtggctgatctaccccaacccttctctcctcttttcttctcttccctccccttcccttgtggttgatctactacaacaaattatcactaaatcctatccatagctccaatccatagctcatattaaacaaatgtaaatatcagagtattacaaagaaatatagacatgagtaaagagaggtttactttttagttttgaaaacttaaatctagtaaataagccatgacaaatattaaattagtataataaaaaggaactgacaagcaatgtgaatattatacctgtaataattccccatagactaataaaaatattttactttcatcaagtccactagagtggaactctagcaggacagagatggccttattgatttgttcagtgttatgtagtcagtcccttcaatagttctagatatatagtaggtgctcaataagtactgaatggataaatgaatcaaagggtttacattattttatcatcacttgtttctcttttcttaccctttcaaaattatacttgactcctcctttcccatccactccctaactcactgcagcatcactccataggaactactttcaacagggacaccacactgctgccaaatccacttccttctttccagtcctcattgcactatcctctttgtaacaagtagtacatttctctctccacctttaaactcttttctccctttatttccttcacacttttcttgcatctcctatgtgtctcctcttaacagtctaagtacttggtaatatagttcacttgcttgtcttcgtctgctggtgtttccaggagtttcttagcttccctttttttttccttgcccagtctcctggggtaattacgtcaacctccaatgacttggactataatctctgtgcttaaaaaaatctttcaaggaagcaagtgtagatggaaaagaaatataattcgaagactgacccctgggacacttcaacttttaaatgattggaggatgaggatgaattatcaaagaagactgagaatacatggccagatatagtggaggaaaatccagttattgtagtgtctcagaatccaagagaataattttaaggagcaacactgaaaggcttttatcaactgggtagagtggtgataatgaatcaatgtttccaaccatggttgtagtattctggtaaattcacattattacaagtggaatagcatttttgtttcacttgttattttttaaatgcctagacgaatagatatacatcaagaaaacagtttggatacactgagtttgaatactggctctgcctcttaatgagcataacatggtggtaagagcttggactctggagccatatggcgtgactttaactctggctctttttgtaagcagatgatgtgcttttaggtgagttgtttacattgtttatgtttccatttccgagtccatcaaataggaataataatagtacttcttttataatgttgatctaaagattaaatgagaaaatatactggaaaagcctagaacagtgcgataaaataaattcttagtgactgtttttctgttacggtttgtctctgtgtccctacccaaatgtcaccttgaattgtaataatccctgtggaaggacctggtgggaggtaactgaatcatggggatggttttttcccatgctgttcttctgctagtgaataaatctcatgagatctgatgttttcataaaggggagtttctctgcacatgctctcttgcctgctgccaggtaagatgatgtgtcttgcttcccctacaccttccaccatgattgtgaggcctccctgcccatgtggaagtgtgagtcaattaaatctcttttttttagaacaaaactggaggcatcatgctaccagagttcaaactatactacaaggccacagtaaccaaaataccatggtactggtaccacaacagatatatagaccaatggaatagaacagagacctcagaaatatcaccacacatctacagccatctgatcttcaacaaacctgacaaaaataagcaatgagaaaaggatttcctacttaatgaatggtgccaggaaaactggctagccatatgcagaaaactgaaactggaccccttccttagaccttatacaaaaattaactcaagatgcataaagacttaaatgtaaaatcccaaaccataaaaaccctagaagaaaacctaggcaataccattcaggacatggcctgggcaaagactcatgactaaaacaccaaaagcaattgcaacaaaaggcaaaattggcaaatggcatctaattaaactaaaaaccttctgcacagcaaaagaaattatcatcagagtgaacaggcaccctacagaataggagaaaatttttgcaatctacccatcagacaaaggtctaatatccagaatctacaaggaacttaaacacatttacaagaaaaaaataaacagccttaccaaaaagtgggcaaaggatatgaacagacacttctcaagacatttatgtggccaacaaacatatcaaaagaagttcatcatcactggtcattagagaaacgcaaatcaaaaccacaataagatgccatctcatgccagttagaatggtgattattaaaaagtcaggaaacaacagatgctggtaggctgtggagaaacaggaacgcttttacattgttgatgggagtgtaaattagttcaaccattgtggaaaacagtgtggcgattccttaaggttctagaaccagaaataccatttgacccaacaatcccattactgggtatgtacccaaaggattataaatcattctactataaagacacatgtacacgtatgtttattgcagcactatttacaatagcaaagacttggaaccaactcagatgcccaacactgatagacaagataaagaaaatgtggcacatatacaccatggaatactatgcagccataaaaaggaatgagttcatgtcctttgtagggacgtggatgaagctggaaaccatcattctcagcaaactaacacaggaacagaaaaatcaaacactgcatgtcctcactcataagtgggagtcgaacaaagagaacacatggacacagggagggaaacgtcacacactgggccctgtcagtggctggtggggggcaaggggagggagagcactaggacaaatacctaatgcatgcaggacttaaaacctaaatgttgggttgataggtgcagcaaaccaccatggcacatgtatacctgtataacaaacatgcatgttctgctcaagtatcccagaactgaaacaaaacaaaacaaaacaaaaaccctcttttttaaataaattacccagtcttgggtatgtctttattaacaacgtaagaatggactaaaacatattccatgaatttgtgtttcctcacttggacaagcataacaaataatttcaaactcatagagttatggtgaaaatcaatctaggtaatccacgtaaagtgttcttgcatggcaagacctccatatgtattggctgaattactggaaagtatgtttatcatttagcattggagttaaatgagccagccactcgcttcattcctcaattgagactgctagtggttatggggatgtaagcattatacagccttaaattgtcttattctaagtcatacattgtttaatttatactcttaatgtaccattggttggcaacaggaagcataaggggcattgatgtgcatgcattttcactggatctttgaggtgcattcatctgatcaaaattctcacagagcacatcaaggtgtctctagtgctttgaaaaccaatgttaaaaagataaaattcagtgatgattacatctagtttgattttcattttggggaaataaacactatcttcacaagcaacatggtgttatatgtggagaagtacttgcaaatggaatactgaaaccatctctcttacttcatcttttggaaaaaaaaaactttaaaaataaatagttttttaagtaccaaatgcaataattcaagacatgagatctataaggtaaggtttaatttcatggcttaatttccatctgaaatcaattattaaataacgtctgccaattgcaaatggaaaaagtaaaatttgtctatatggattatgaatactattgaaggttatgctaaattaactatatattatatatgtcatagtttaccgatcaaagataaaatatcgtttttaaccttaattcattttttattgtcacaataaaaacttaaaaaatattttgaaaaatcccaaggggtttttacaaaatgatataagattatgaaataagttcaagtggtaaaaaagaaaaagcttggaaaagctctatttaataaaaaatcatagaggcagaactcagattcttggacctggtctgttaatttggggataaatttgaaatgccagtcttttgagtttgattatagcacttaattatggtaatcactgctaaccttctcccacaaccttgcactcatctccttgagaacatattcttcaggaaagatttaagtttgctttgtaaaacttgctgcaacatgctagtaatcacaattccctaaggctcgcgatttgttttataagaaaaagctattaaatttaaagaaatggtgtacgtagacagttaacacagttgcctaacaccatgctgttctccttacaagacaaatgcatcccattgtttgttccaaattttgggcatattttatcttctgtctttgaggattttgcaaaataagcatattcaatggaatatacattttaactagccccaaatttaaatccaggcacttgcactaatttgttgtggaatattagaaacacctacttaacctagcttacttcagttttctctaccagttactcatctatgacacaacacattttcctatggagagtaaaaagggataagagtggaaaacgtagtcaaaagggaaaaatgaatagatataataagagatggactttgcatttactgataatgatgatgcaacatgaatcatataatgtgaacaactcaacattctgtccctgagctgtaagtctctctatctgttcatctctctagttttgctagctatgtgctagatcctattagagcacttcactcagcaagtacctgacatacagggattcctttcccttttcagctgtctcttctcataacactacatcacctttacatctgtgcacaataccataatagggaacaaaggtctactccaccaatgaatccaaaaattggaataaaaataaatccaggtatatagtcagttatttttcttgatggtgtcatgggaatgatttccattttatcagttggaggttactctgtaaatattactttccagtcaagcaaataggaaagaatatgttttcatgaaactgtgtagcttggctctgtttttgtttttcccagctctgtagagagagagcattaaataaaacatactctgccacgtttgcacacaccacatccctcatgttctaaagatactacattgtagaaatgtaattgactattgcatgctttcctctcatacctttcccataatttggaaaaaagacaaaatcgaatgtgtagagtttacagaaaccacaccaaagaaaagcaaagcctcataagttcaataaaaatccttttttctggactttctttataaaatattgaagcaacattgcataaggaggctgttgaattcttccatgacaaaaactgtttctgaaagactattgttatcatgagatcttctgagcattttcctagaagtagaagctgaacttcctttttcaatggagatgaggagatagatatatgttaaccaatctttaaaggggccatacttgattagactatggatgacagctctttggaaatcatagttggaaatggagggttaatagagggagcggggaggtccaacacagaccacaattcttttagctactcagtctcaaaacattgacattccatttaacttgttgccttctttcattttccttctgtagtctgtagctactgcttgacaattgccattcttaatatttttcatcctatttctttcagtgacacaggcattaacacatgtatactgcttttggacttaatcgtgctctcctctctccaaatgtagttacattaggggttaaagttgaagccaatatttggccaatattggattggacccaatatttggagatagggtcttaagggaagtaactgagattaaatgagatcataagggcagggttctgatctcataaggttagtgtccttgtaagaaaagacataggagaggtcattctctctgcaggtgtacacaaggagaaaggccatatgaggacacagtgagaaggtggccatctgcaagtcaggaaaatagccctcaccagaagcagaaccctgctagaccttgatcttggacttcaggccaccataactatgagaaagtgagaaaacaaattgctattgttaaagctttccagttcgtggtatttgttaccgcagcctgagcagtctaagacaaggttaattacaatattccagaattagagctatgtatatattatgccagatttcaaaaaatctttgcaaaagccctgtgttaatgaggttttattatagatgaagacactgatgttctaagaggttaattcactgaattataagaactcagaacttaaagatgtaggaactacaatttgagccttgctctattttataagtgtgtttccttcatgctactgacaatatcaccctaggccaggccctccttgttcagtgacttacttggttcacagcatctccctatagctacccagcactcttgttaattttgcacacttgccaagtcctaaatcatccattttgttgcttcacttccactgctcaagctcatttaatgtacctgtgagagttcccaggacaagctccaaatccttaaccagctttttaaggtgtgttcaaaatctgagcccacttaactaaaaggtatgactattttctcaaagctcaaatgccaaattccaattcacttcactacgtcaagattatactacattaattcttgtatttataatcctatctatggtattccctctcctggaaaacacttttctcatccctccacacacaaaacttgtactcatcatctgaagacagactcaatccaggcacttgtataaaacttttcttacatcagtctatagtgacctcctacttaaaactctctagacttttttgggcaatttatttcttttttgctattgggttgtgtgttatttcctacttgtcttatgtttaggaggaatttttcaaaaagcaggtggggaaggcaggggaacaaaaactctttgaatgcatgctcaagtatctagccaacaaatcaagcagccaagagatctactaatcaatacatagttactgagcacttactatgacctaggctttgcaaaactgaatggcattggctcgaaatatattttcctttctgtatttcatggctaattccaatgatgcaaagacattcaacaaatgacaatttatgaaatacataatgatatcgctgctatgtgcttgaaaaccaaagaatagccaacacaatcttgtctttgttcaccaataacatcaacaaggaattgtgactagagtaggtatttgatctatgggaagacagcatggtgtgatggaaaccatatggatgttagaacaatttaaatcttacctccatctactttgtccttttgtcctcccagataatgattaaacttttctaaatcatagtttccctatttaaagtttctatcatagagtctggcccatagtaaatgcttaatgaaatgtactaaatctcctaattgctatttgtgttcattgaaaatcattaaatagagagccttgttatcctgttaactgtactctttttatgtttattgctgccccaacttttccctgcttcaaagatgagcaatatgcatagctggttctaacacatggccaaaatgctagtctggctttgaatggggcgaggagcagataatttggaggggatgtgctagaacaaaggtactaaatagaaggattgtatgtgatcactttttgtcgcactcatcatcccttacaggaagaggctgatttgctgaacttagaaaaaaatgtgacagccaatccttcagatgcattacaatgctttgggaaaaatataattagacaaaacaccaagtatcgatggattgcatgttggggtgatgcacgtgattagagaattcatcgctttacttagtaagacctattagacccattgttagttgtcttttgaatcaagagatataaatgattataaaactgcaaataacatcccattatttttaaaataatgaatgactgtgaaccaaggtagttctattatttccaatggaaagataatttgagctgatacttaaggctctgctcagcattacatttggaaaagtgcaatttaattggtgtgaggcagcgtagatttgtgaaaataaatcatgtcaaacacatttgattaccctttaaaattaaattgctattggaccagctagaagaggaaacaagtaaatgcaatacaactgaattcttttttaagtcgcctggcaacattccttatcagtgttaagcatatggataggtttcagataggtttataagtaatagtcaagtggcaatagacaatgggtgccaaggttgaagatctagaaagaaacatagcaattctttggaatggctggaaaagcacaaaatgccaggaatggagggataagcagacagtttcaaggtcaaatattagcactgccaattactgactttgtgacaagtcacagtctttgaaacctcaaattttggatctataaaataagaatcataatagtttctttccagggttcttgagaagaacaaatccaatggttttaaagttcagggctcaacatatagcaggtttccatgggatgatttttctcactagatctagaccctaggccacaaggtgacttcccctgatcacataggactctagggagtttggggaagcaaatacttcaatatgctgtcaagactgtgggtaatactgaggtccaagctctgctgtactcttgagccgttggtaccttatatatgtttcaagtgttttcctctctgtaaatacctgtccaagagatcagcactgtaaaacccagcttagttctttggaaacaggaaacttgaggaagttgaaaatctttacaaaaatcctgaggtaaaagttccaacaagatcaatgaaagccttttggtaaatgagttctgcagtactttgaacctctctgtggcaagatatggcaagaagcctcatgtatccaccttgtcactgacatctgttctaattctctgcatcgtgccagcattattgggtgcttttcttgtttatagcatttgtgtccatgcttagtcactgcctcctcttataggaatgtaggtaagtcttacaagaatatgaattttccaagaactgctagcccttacagttgctaatctagtacggttgctagcttagtgtaggcacccagataaatatttgttgaatgaattaataggtcatggcaaagaacaggagttggcaaactatggcccactggttaagtccagcctatgacctgttttgaatggcctacaaagacagtcatgcttattcacatgctattgcctgtggctgctttgctgctacagtggcagagtatgtgtttcctgatccacaaagtctaaatatttactatctggcacttcagagaaaaaaagattgtccactcttgattcagaagatagaaatcaatactgtgatagtatcaccatcatcagagcagctatcacatatgtcttatatggacaagacattttaggtgctttcatttgctctcttaacagcctttgcaaggtgggtcttatttctgctgtcttgcaaatgaggaaactgacacccagagaagtcacttctgcaaagatacagagctgagtgctatctgagctcaaattcacccctgccctccacctcaacctttctgactctatagcctttgatttttatactaacctaagctactaatacattttagtatagacattttaagtgaccatgagaatattgttaaaattttcagtgtttccatttccttgtttatcatggatttagggtagaaataattaaaacaaacaaagcaataataaagatgtcccagcctcgttttgtaagtttgttgagcataaattgtctctctattatgtttctttctttgcttgtacttagtagaagggattacagagacgatgtgtactttttttttttttaatttaccactgacattaaaacggaatgttaagaaacccagctagaaccatttcacagaataaacactgagagattaggcaattgggcttcaaagtggaatatgaaacttaatgtggctaagtgatgcacttgggtagaaataatgcccaggctaagtacaacttaaatggtgcttaattagttaatacagcagagaaaaaaaatccgcctgtactctgagaatgaacatttacattttggattcactgtgcagcagtgatggaaagagctaaaatgctgtcagcttgtgttcagagggctattctattagtcctgggatacgggccttttgtaaggtgctgattggaacacaacaaggcatctggtccaattccggactcattaagtaacaaaaaagatgaggagtctgtttccaggaactagatacttgattagtgaagatagcagcaagggctggagctgaagcttagcctgctgaacagaagccttaagcaccctctgggatggggctcctgccctctccagcctcattccatggttccctcctctcctggtctgcatgatgcgattttaacaattgccacccccttcctatgtgataatgatgtgcactacaacccatcccacagaagggacaatttagcttgtgtgtctgtttccccaggagaaagcaagctccttgaggctggggtctttgtcttatttacacaggcattactggaccctacactccctttcctactacatagaatcttatttttgccctttccctttctccttttcttccactgaaagagaaagggaggctaagtatagctacatcattaattatgaaagagtttggggaaggacaaagatagaaaattcaggcagcatgtttatagaagagttttactggggaaaaaaatgctaggggtggagcagaagagagcattggaattagaaaaatgtgtatgttatgaagcgttgctgtggattgcaaacagggcctccttactttctaaaatatacaaatccatatttaagttgatttttaattaattatggctatggaagtgcattgctttaaacataatcccactcttggtctggactgcatggttgttacaattataagtattacattggtatccccagtgcccatagagcactagacgggttgtggaaattaaagtatattttgaataaatgaatgagcaagagggaaaagaactgggtgatgctaactagggagtgatctaatagaagacagaactgtgccccaatactcttcaaagtgtttcaggtcagcataataaattagtgatgggagcctaaagcactgctcctccagggtacataactcaccaggacgtgccttgggagctccttcagccccaaagctaaagtgaacaggctagagagtgtattttttttttcccatgaatctactaaaagaaatccactaaaatcaaataaatcatgaaagagctgtaacgtagacttggattagagtttgctaattaaagagcatttgaccaagttgagcatgcggctgttagagagagtgaaattatgccatgcatgatgggtgtctacgtgtgtctttccttgaacgcgcacacaaaggctgaaagcataggcaacaggagagaagaataacctgtgtcgatagctgaacttttactctgtctaggcaacacatgtggacaccagctatgaggcataggagttataaatataattgctaccaccacttccttcaaagaatatatagtgttagggaaaggggtgcatataaacacagaattaattatgaggcaatgataaggggcccaagaaatacaacccatgtgccgttaagttgcagaggatggcaaaggcacattttactggtgacagggataaaggagttcaaggctcaggtgatatgtgaatcagaactcaagtgtagttgaatgtcagtgggctgagctgagagggaagggcagaacacaaggatgggaagcacagcaaagactcaaacagatcataagataaactatcagtgggaaattagcctggaagcaaggaattgaagcagtttaaactctaggggatttggagcaatggctgtcttatcaaagccatgtgtgtgtgcagataatcaggagcctgagtggtatgagacatcatggagtggtgtgaggtctataagaaacagaaacaactaagattcaaacgtctagaaaaaaaagtttacagaccctgaatgccagcataacctttcagagcaggcatgattcagctttcctgacaaagtcctctactgtggagtaaagtcgtgaccttgttgtcaataaccctctgaaagtcaacatggctcccaaaaagagaagaaggcttcctgatgcttctaggcttcattgcttccccattctaccacgatgtaaagggtcccctgaagggaaacaagcagggagcatcaagggaggggcccctgctcagcatccctcctatttggagcttccttgtctgatgtctcccagcaggcatgcaatcagtctgcactccaagtattttaagtggtgtgctcaccactttaaatttttggattattgaaatttagggttgctcaaataaagttaagtactttaatgatcttccgtatgaccttcctcctcatcccaccatgcctctgtactccctgcccccagcacttttgctggcccagacgtgggaatgtaatctgcttttaggaaggggagatgtaagaaattgacctggcccagcaacttcactgatttaagcctgcaaagctgaatgctgagaatggagttgttctgctaggtctgaagtcagagaatgggggaaaataatctaaatcctgcacagtgaattagtggcagagacctatgtacctgttattgttgctgttcactatttctataatggcaaattatccttatcacccagcggagaagtcacaaaggaaacagctctgatggactgctctttggtattgcagctcctgcccctcacacagctacaatctatggtcttctcgtagaagcgtttatacctgagtatttaataccaagaaataagaattcacagatttttaactcataactgaactgatcccattttcatggtgatttagtcttattttacctttctttgggtctttagcaaatagaatagttactgattgatgtggaattgataatttggaatgaaaactgtattaagcttattctctgaaattttttgaggaagaagatagcttggtggatctgttttatctgcaagattgtgttactaagtagggatggctgttggaatttaaagaaagaaagaaagatgaaggaaaagcacagggaaaatgtataattaatgagttttaattgattagtttgtggttattgaaatataaatcaggccgggtgcggtggctcacacctgtaatcccagcactttgggaggctgaggcgggcggatcacaaggtcaggagatcgagaccatcctggctaacatggtgaaaccccatctttactaaaaaatacaaaaaattagtcaggcgtggtggtgggtgccgagtagtcccagctacttgggaggctgaggctgaggcaggagaatcacttgaacccgggaggtggagcttgcagtgagctgagatggtaccactgcactccagcctgggcaacagagcaagactccgtctcaaaaaaaaaaaaaaaaagaaatcagttattttcgctattgcattttagtttgctagtctattggtagtaatatctatattttaaagtgtgctagggatttctcctccattcctggaatctctctaccattcccagtctaggtctttctcaaaaggatttcagtgaagatgctatacactgcagagtgttacagtgaaggtgactgctaaatactcaacccagtcctttttttttttaagttagcattgctgcatgggggaaatctgaaaggctcggaagtgtagtggggtcccatggagggctttagttgatgatgtgtattttaacatctctcccaggatcaggtagggtacatgtcacttccatttcatgtgactttcttcccagtttgatctgtagctgagctaaatgtgtcattggtagtcactgcttaaaatttctacagcttggaagatcccagcaagatattaaagataaccaactgaccaagacttggaagggagcaagaaaatagaaaaagcagtaagaaaaaagctcacggctatctccagccaatactcagctttcagatgtcagaatagaaaggacacctacacctgagacaattaagacatttgattcaggagctcataacatagatgtcaactatcccaaagccgtcattgctaagatttggaatagatgcataaaccaaatttattttactcaacaaattgttaaattttaaataaaggacctcataggtagattgggaatccaaatgaggtggggaggttaaaagctcaggttctagggttgactctaagggcctactggaacccttgtccggccatttattacgtatgtgatttgggagaagttgttttatcattctatgcttcagaagtttttgttttgtttttacctttaaggcagagatgataatataaactgactcaaaaaatattttgtgaattaatccacatgaagtgcttcaggcaattgcctggtatatggtaagtgctcaaatattaactattagttaaagcaagatggaaatatgtcctaggtgacaaaatggttaagaggcaaagatgaaagaagccacaagggaagcgaagggcaggacaaggagaatttgagatgaaatgtgataagagctgagaacaaggagaaggagtggggtagcacttcataatgaaaagtattagtttccattttataaactcgatttctgcaaataaaattcatatatcaggggcaaaagcaatgggctaatatggtcagtgtggaacatgacgatctcttctaattgacctactaaacccaggggagaatgctctataaacagattgctaggctaagcaatagggtgccccattatccaacaaggaaggactccaccaagaccagaggctagattctatgggtcattgtaaagataagcacatttagttcttccattacaattcttatatagcccctccttttgaagttttcaatgttttgcagacatttcccagaaccttcacatttcactgattggccagttgccctagggagcagaagtagccttagccaagtagaaaagcaaaggcttggctccctggaagcatgtttgtattgcctctgattaatctggacttcagggatctttgttttttgccccattgatacctcccagaaaaatgggattatagtatcacagccatatttgagatggcagatttgggagaatttaaaacccaattcaggccgggcatggtggctcacgcctgtaatctcagcattttgggaggctgaggcagacagatcacagggttaggagttcgagaccagcctgaccaacatggtgaaaccccgtctctactaaaaatacaaaaattagctgggcgtgatggcatgcacctgtaatctcagctactcaggaggctgaggtaggagaatcacttgaacctgggaggtggaggttgcagtaagccaacattgtgccactgcactccagactccagcctgggcaatggagcaggaccccatctaaacaaaaaaattattatagaaacaggagaaaaaatattattaatattggctgtgtatgaacaaaacagccagagccagagaccctaccactgaagtaaggctgatcgctgcccagctagaaaaccatcctgtgttgagttcatgtcttttgtacagacatggatgaagctggaaacaatcattctgagcaaactatctcaaggacagaaaaccaaacactgcatgttctcactcataggtgggaattgaacaaggagaacacttggacacagggtggggaacatcacacactggggcctcgtggggtgggtgtaggcaggagggatagcattaggaggtatatctaatgtaaatgacgagttaatgggtgcagtacaccaacacggcacaggtagacatgtaacaaacctgcacattgtgcacatgtaccttagaacttgaagtgtaataataagaaaaaaaccatcctgtgttgatggagaagcaagcaatcaatgcagcttaacaaagcggcagtcagaaggacaaatcgtaccccaaaccaaggggagatggaggcatccgatgagaaagaatttggctagttggagttatgaagggaaaacaatgcttgaaaaatctgaggtgaagttaatgatcacagaaggggtatgtagccaggaggaggccaggaaatgaaggacttttttaaaaaaaattgtatttcataagtctgttttctaaacagaaacaaatgaagtaagtctttttggggaacaagagaacaatggtgattccaccaagttaactattaatattagtcctatccacccttaaatctaaacatttctgaataaatttgattggaatccctgcgtctggtactgctaaaagttttggcttctggtctaactgcctaatgaaatcaacgatctatccctcaacacccctttccccccattcagtagtctcccttttctctccaaagagaaaaaaaagttcatgggaatggctctctgggaaacataccatcaaaatttagtaagtgatagagcaaatataacaagaaaaaatatgtaagcatttgagaagagagggagacaaacttcaagtctgtgggggagaaattgggattcactcactcaatggctttttcttcccccagttgacctacaagaactggggttgggaaagtcagcagcagtcagataggagacaactctgtttttaaatctatatagccccagttttctgctgcctccaagcaccttacatacaatagtaagttaattaataccagctctgagtaggcatgtgagctaaagatggggtagagaaaacatccactaatctaaaaagaaaaagaaaaagacacagcatccttatagtgaaggttgaaatcttcatcaggagtaaagccctctttgcattcctttctatgcatagggagcagggtgagcttcccagtaaaaccagactccatcctgaagcttttctctcagatcactaggggtcattcattcagtcatcctatcctccctcccttcccttttcctccccttgccttcccctccctccctttctttgttccttctttcctttttatcctcaattaagatggtaaagggtgatggaagacacaggaatttttaagtgagccaacttcagtttaattaccaacactaaaatgtatcacttgtgtgaacttggatgaagtaattagtctttccaggtattgatttatttctgttagatggaaatacccgtgcctgtttagcaaggtgggaggatgaggataatgtgtgttcaatgtccagcacatgctagtgctctcttggtttctgtgacacttctttccagcctctctggccacggattctcaagctccttagccgatttttccctagctttctcatctagtcacaaaatgttgggctgcttcaggggttgactctgatttcccagacctttgcttatttattttctatcttaagtgatcaacttaggtttaaatgacaagtatatacagattactgtcaaattaatatctctaagcttcacttttctccacagagccccatacttacatgggcaatcaatcctgtgacatcttcgcttggataactcagacttaacctgactgatgatgataaagacttttttctccacctcctaaccttgcacattattccttgttagttttttcacctggatgaataacactactatctacccagttaccaggctcaaatcctgggggtcatcaatgatttcttctcttcagttatgtttactttctgtcattcctagcctcaaaatatatcttgaataaccaacttatttttgttcttaatgctaccactgtagattgtattaaagttctcaagtattccttcttcttaccatagaacatgtagggccactccacttatggaaggaatttacttcgctgccaatggggccacttgagatatgtggctatagatgggaaatgtgatcagttcctcagcttttcattgctctggtcaggactatagtgggcaacagttacctttagccattgtggctgtcagacaagtatgatagaaagaatgcgaagttgctgagagtgaatgtcaggggtgagtataccgatgggccatgggacataagaaagaaaagaagataagaaaggaagtggatagatcgctagcaagactaataaagaagaaaagaagaaccaaatagacacaataaaaaatgataaaggggatatcaccaccgatgccacagaaatacaaactaccatcagagaatactatgaacacctctacacaaataaactggaaaatctagaagaaatggatagattcctcaacacatacaccctcccaagactaaaccaggaagaagttgaatctctgaatagaccaataacaggctctgaaattgaggcaataattaatagcttaccaatcaaaaaaagtccaggaccagatggattcacagctgaattctaccagaggtacaaggaggagctggtaccattccttctgaaactattccaatcaatagaaaaagagggaatcctccctaactcatttaatgaggccagcatcatcctgataccaaagcctggcagagacacaacaaaaaaaaagaattttagaccaatattcctgatgaacatcgatgcaaaaatcctcaataaaatactggcaaaccgaatccagcagcacatcaaaaagctaatccaccatgatcaagtgggcttcatccctgggatgcaagactggttcaacatatgcaaatcaataaacataatccagcatataaacagaaccaaagacaaaaaccatacgattatctcaatagatgcagaaaaggcctttgacaaaattcaacaacgcttcatgctaaaaactctcaataaattaggtattgatggaatatatctcaaaataataagagctatctatatctatgacaaacccacagccaatatcatactgaatgggcaaaaactggaagtattccctttgaaaactggcacaagacagggatgccctctctcaccactcctattcaacatagtgttggaagttctggccagggcaattaggcaggagaaggaaataaaagatattcaattaggaaaagaggaagtcaaattgtccctgtttgcagatgacatgattgtatatctagaaaaccccattgtctcagcccaaaatctccttaagctgataggcaacttcagcaaagtctcaggatacaaaatcaatgtacaaaaatcacaagcattcttatacaccgataacagatcaacagagagccaaatcatgagtgacctcccattcacaattgcttcaaagagaataaaatacctaggaatccaacttacaagggatgtgaaggacctcttcaaggagaactacaaaccactgctcaaggaaatcaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaagagagcccgcattgccaagtcaatcctaagccaaaagaacgaagctggaggcatcacgctacctgacttcaaactctactacaagtctacagtaaccaaaagagcatggtactggtaccaaaacagagatatagaccaatggaacagagcagagccctcagaaataatgccgcatatctacaaccatctgatctttgacaaatctgagaaaaacaagcaatggggaaaggattccctgtttaataaatggtgctgggaaaactggctagccatctgtagaaagctgaaactggatcccttccttacaccttatacaaaaattaattcaagatggattaaagacttaaatgttagacctaaaaccataaaaaccctagaagaaaacctaggcaatgccattcaggacataggcatgggcaaggacttcctgtctaaaacaccaaaagcaatggcaacaaaagccaaaattgacaaatgggatctaattaaactaaagagcttctgcacaacaaaagaaactatcatcagagtgaacaggcaacctgcagaatgggagaaaagttttgcaatctactcatctgacaaagggctaatatccagaatctacaatgaactcaaacaaatttacaagaaacaaacaaccccatcaacaagtgggtgaaggatatgaacagacacttctcaaaagaagacatttatgcagccaaaagacacatgaaaaaatgctcatcatcactggccatcagagaaatgcaaatcaaaaccacaatgagataccatctcccaccagttagaatggccatcattaaaaagtcagggaacaacaggtgctggagaggatgtggagaaataggaacacttttacactgttggtgggactgtaaactagttcaaccattgtggaagtcagtgtggcaattcctcaaggatctagaactagaaataccatttgacccagccatcccattactgagtgtatgtccaaaggattataaatcatgctgttataaagacacatgcatacatatgtttattgtggcactattcacaatagcaaagacttggaaccaacccaaatgtcccaacaatgatagactggattaagaaaatgtggcacatatacaccatggaatagtatgcagccataaaaaatgatgagttcatgtcctttgtagggacatggatgaagctggaaaccatcgttctcagcaaactgtcgcaaggacaaaaaaccaaacaccacatgttctcactcctaggtgggaattgaacaatgagaacacatggacacaggaaggggaacatcacacaccggggactattgtggagtggggtgaggggggagggataacattaggagatatacctaatattaaatgacgagttaatgggtgcagcacaccaacatggcacgtgtatacacatgtaactaacctgcacgttgtgcacatgtaccctaaaacttaaagtataataataaaaaaaagaaaacaaagcaaattgatggatttgactaaacggaaaactagaacttatatatggcaaaaatatacaaaagaattaaaatgtaaatgaaaatttgtgagagagaaaaaaagaagaagaaaggaagtgagtatgtgaaagagatgagggggagtgaaaaggtggcaggaccaatgcagtgggcgtgctggcagagtgggaattgttggagtcaaagtttggatacttgaaaagcttgaaaatgagattatgagggagtaagatgactaaatcaaaaggtgttgagtaggccgggcgcagtggctcaagcctgtaatcccagcactttgggaggccgaggtgggcggatcacgaggtcaggagatcgagaccatcctggctaacatggtgaaaacccgtctctaataaaaatacaaaaaaattagccgggtgcggtggcgggcgcctgtagtcccagctacttgggaggctgaggcaggagaatggcgtgaatccgggaggccgagcttgcagtgagctgcgatagcgccactgcgctccagcctggatgacagagtgagactccatctcaaaaaaaaaaaaaaaaaaagaaggtgttgagtatgaccatgacagtgaatggctaaaaatcaatgacaagaacatcggcaataaggaaaccaaggaatagaggggccagaatgttggaggggctaccggtgtggatcttgaagtcctcaagaattatgacaagcattagattgattcagtgctaaaatatttaaggaaggaagaggagtgacctgaggtgtataggtgatagcatcatggatgaatagcaatagtgaaggtataatcttttggcccaaaaatcacagcagcagggggcaagggtagaggtaagggagaaagaatagtgacctggtggtgacaatgaggaacagggaggatatttgctccatttttagcataaaatgttgctataatttgaatatttgttccctccaaatctcatgttgaaatgtaattttcaatgttggagatggggcctggtgggaggtgttggggtcatgggagtggatccctcatgaatggcttggtgctatcccttcagtatagtaagttcttgtaagacccggttgtttaaaagtgtgtggcacctccgtcttctctctcttgcttccactgttggtgtgtgacaagtaggtttctctttcaccttctgccatgatttttagcttgctgaggtcctcaccagaagtagatactgacagcaagcttcctgtgcagcctgcagaaccatgagccaattaaaccttgtttctttataaataacccagcctcaaatattcctttatagcaatgcaaaaatggccgaatacagtggtatatgaagcatgagaaaaaaagcagccactgtttgtgagggatgcaaaggaggtagcattcttgaagggcagccagcagagctaaaaattaaatgtgggttgaataaatgaataaataatagctattattacatttcttttaaatttccaatatatgacaagctacaggagaacaaaatacattgtttcattcaaggagctcataggagctctggttctcatgtatttccaagaaaatcatgtacaatgaaactaatgcacagagacatggtctagatgttacgggaacacagaaaatgatcaagtaatgcttccagggtggtatagatctctaggatagggtaggggaggttttccagggaaagggatggtttaaaggtaagtaattaattcctgggaggtcagtttagcagagcatgggtgaagtctgaaaggtatgagaacacattaggggtaccaggcttagctgaaaagttgtggctgcctcttttaccaatgtagtatcagcagacaaaggcttgagataaattcctttgtatgcgtgaatctgcctgtgtgcatgtgtgaacatgtgtgtggcaatttttcccatggaactcttccagaaacattcctttgtaaagtagggtttctttctactggtaggtaggacatggggtggtgtgagctaccactaagtcaaagagcaaggtgacattgtgagttgtgttctgatgccactggtaggtatgcattatatgcatatgtgtgttatcattctggatgaatcaaccctaagtacaaaggcatgcacacacacataccagtgattgctgcagatttcactaaagcccttctaagtatagctatgattggaggaagaatatactggactatgagttcttaaaggacagagccatatcttattcatcattgtgttcccagtactaattctgcatctggcaaacagtatggtcaaaaaaaagatggtattttgttcaaccttcaccaatgaagccaatgaacagataaatgtgagaaatcatctagcaatactgtcataggatataatagtgcttgtttagagtacattgtgctttgtaaattttaagacttttgaatatacattaacttattagatgccataaacaaagccctgagatgcttatcaaattctgctttacctagcaaaaaagctctcaattacttggcagagctgtgactaaatcttttgttttctggtccatagttcagtgacagatgcaagatctggaaaaggcagtgcgctttagcaacaagaaagtcagggccaatttgggttgccaatatgggatagtgggaggagagtggacctcagagtcaggcataactggatccaaatctcagctctggaaacttgagttgtgtgaactcactctgtgaggatcggtttctccatctatataaagaaagcaattgtaaccaatagatgaaggttaacttaggattgagcaagataatatgcatagtgtttggcacaatacgcggctcttaaagttggtaggtactatgtattattattattatttgaaataggttcctgccttgtcacccaaggtggagtgcagtggtacagtcactacttactgcagcctcaacctcctgggctcaagcaatccttctacctcagactcctgagtagctgggactacaggcaggcaccaccatgcccagctaattgtttttatttattctgttctcactatgttgctaaggctggtctcaaactcatgggctcaagcgatcctcctgcctcggcctcccaaagtgctgggattacaggtgtgagccactgcacccagccagtactatgtatcatcattatcattggatacaccaggttttagtggcagttagtttctgacaaggctacaatgaatggtagaaacgtcgttttcctcgttggtcagatacacgtggggagcttttgagtcttggcacagttaagaagtcagtgggaggaaaaggatattaaaatgcagaacacgtttaaactccctttggactgtgttgtatcaaggaaatggaaaagaaagtgtcaggcagtacttgggatgatggggactctagtgataatgacactaaggcaaaggtgcaaaacctgtgacatgatggccaaagagggaatgtgattgcaccatttaaatgtatatcaggaaggtgtgagacatcctgccatactcagggaccttccacaccacaaaggtgacactaaaattcagacttagggagactctcttggccaggagactggctaaatgtgcgaattcagaagtatcagctgagatgtgacgcgatcacacatgggctggcaacgactattttgctctgaaaaaggtgccttgggaaagagatatcattaattttttttaaattttagtttgattcccattctatgttttatggccctgacactggactatcaactaatgaacatagtccttgctggataaaagaaatgtatagggatagttcttccccaagaacttgttttattttcaatgacaaaaaaaactaaattgctttcagcttcattatcttttcaaactcaaatgtaaagaaagagcatcagaagcaggagtgtgcaattaaagctggaaaagtaaaatagagtttatctaataataatgggatattttccataggcagaagcttaattctgatttctcaatttaaagactctaaggagaaatcaatttatagactcagagaatcactgaatgttaagttgcaaaaatcccacaaatcattttgtgtatcccttcattttataaatgaaaggactgaggtctagaaaggttcagtgactgcttatccagtgaatttactcggaaatataagaacaggtgcagttaagatgaagatatctggatatatacttagcttctacagtgacttactgtgtacccataagcaaagcttttgcaataggcaagttccttgatctccctttatgcaaatgatatacagggaaacattgtttagaccttacttctagcatgtacaatgaacctatacaaaatggtctacattcttggttccctctcctttcttggaatcctcagcctggcaaagggtctaacagtcattgaactggaaaggatgtacctattttatagatgtgataagtgaggtccagcaaaactaagtaaccgtaccacagttacccaggaaatacacagtgcaggtggacctggggcctttggcttcctgctgcagggttctttccattccatcatgtgacactatttaaatagaagcaggctagagttgacaaaatgagttcctttccatttgcatgaggcactgagcttctaaagaaattctattcataaaagtcaacaagtttctttttggagcctgtccacaactgcccaggcttagggtagaacgaggcattccaagtcctcagtcagacaggtggccccataggtatcagcagagcctaccttttcgcctccagcatcttttcagctgcctttttactcagagccttgtggagccatactgaagcctggggctaaataaaaaaaccttgcctttatttagaattctgatattatgctcatcatgaattgttttgcattaagttttgttttttaaaatactacattaagacattatttgtcttgactactgagggtttttctttttcttttcttttttttgttcacatcttttaaaattttgtgtctggagttatcaaggggatagaattccaggtttctctttacttgctgtagcctctggtttcactgtgttaaaatatagataaaatgggcccattccacccattttccagatgaatctaacctgcacatccagatttagtttgcactaggaaatggacttgtgaagccattcacatgggcagggattttgtgtgttttattctctgatgtatctacagagttcagtacatttagtttgtagaaacccaattgatattcattggataaataaataaatgcaacaaaactctacagtttttagtgtttatgacctgttaacatttatctaagctccctccaatagagtctcctaggcctgtaaccaatttctggcaagtttctgggaattgagctctctgtcttgccaggtctctagagtattctaaatagataaagagaacaatagtgattttcaaacaagccactattaatgttaggttttaactgaaaaatagctcaaatgattaactattttctgaaatcttcgctttttctttgtttctttggctctttattttagggtcaggaggcacacatgcaggtttgttatgtgtataaattgtgtgtcactgaggtttggtgtaagaatgatcctgtcactcaggtagtgagcatagtacccaatgggtagtttttcaacctaccctgctttccccactttagtagtccccagtgtctaccgttgccatcttaatgcccatgtttactcagtgtttagctcctgcttatgagggagaacatgcagtattttgttttctgttcctgtattaatttgcttaggataatggcctccagctgtatccatattgctgcagtggacatgactttgttcttttttatggctgcatagtattccctggtgcatatgtaccgcattttgtctgtccagcccactgttgagcatctaggttgactccatatctttgctattgtgaacagtgctgcaatgaacatatgagtgcatgtgtccttttgatagaatgatttattttcctttgggtatatactcagtaatgggattgctgggtcaaatggtagctctgttttacattcttagagaaatcacactgctttccacaatgcctcaactaatttacattcccaccggcagtatataagcattctcttttctccacaacctcagcaacatctgttatttttttgactttaaagtaatagtcattctgactagtgtgagatggtacctcattgtggttttgatttgcatttctctaattagcaatgttgaacattttttcatgtatttgttggctgcatgtatgtcttcttttgagaagtgcctaagattgaaactggactcttccattatatacaaaagttaaatcaagatgaattaaagatttaaatgtaagatctcgaattatgaaatcttataagaaaacctggacattggccttggcaaaaaatttatgaccaagtcttcaaaagcaattgcaacaaaaacaaaaattgacaagtgggacctaattaaactaaagagcctctgcatagcaagagaaactatcaacagagtcaacagacagaatgggagaaaatatttgcaaaccatacaaccaacaaagatctaatatccagaatctataagaaacttaaataatcaaacaagcaaaaaactagcaactccattaaacatgggcaaaggacatgacatatttactttttaatcactcttaaactttagaacattttattttaggtccgtgggttttttttctttcttccatcatcccaggcttattcagatacaatgtagggtctcttgctattagtgtttccacagttaagtgcatgggctgccatttgctttcctggtagccttgactatgtgtccccatgtttctggacatgaaattcttcatttgtcatctggcaataatgatagttattacaaactgcttggaaaaaaataagaatgcatgggaatggactttacaagtggtaaagagaacacaaatttcagagtgtataattacaaattccatgcaaaagcaaaaacttcagatttgtacctattttattttattttatttatttatttattttgagatggagtcccactctgttgcccaggctggagtgcagtggcatgatctcggctcactgaaacctcggcctcgtgggttcaagtgattctcttgcctcagtctcccgagtagctgggattacaggcatatgccaccatgccaagctaattttttttatatttttaatagagacatggtttcactgtgttggccaggctggtctcaaactcctgacctcaggtgatccgcccgtcttggcctcccaaagtgctgggattacaggtgtaagccactgcacccggccttatatataaacaaatcaggggtcaaaaagagaaaagacatgaattatgtccaaactattgaattatgttcatagcctttctggaatgatagtaggttcagttgattttttgttttttacattgaccatcctagaaagaagtctcacgtacctgaaagtctctcgagactaacttcatgggggacacagtctgattctcttactctcatatgcacatccaacattctcagatcctaagactagagattctccaccattgttgaaaatagaaaatgtcaccagggatctccaaattgtgctgcgatctttctgctttttatattgtcaccaacaataaatattctgcagtgggattttagctgacggttcaggtgatgatttgccaagcagcaaagtctccagctttgttcttctgggattctatctgatcctgcaaagctaggaaggaaatcttgttggttttctttcccacttctgtaatgctggcagatgagacttgaaagccaacaagatacaaagatagagagaggaagaagctatcattttcacctagaattttctccaccaaccagactgactttcaagttgcagagtaagtcactgacctaagataacagagtagcttgcatttttacagatgtcttgaagtaaagcttgcttatgtgtaaggcagcagctttggaagccagaaactggggtgtcttgaggggtagtaagcctctgaaatgtgccccagggaactggcttgaccgttgattctgaacaaaataaaaactcagttctttaaggaccatcttcttctttctgcatttactcacgtggcattcctcaagggcactgatctgcagtcactctgctttgtctggttatcacatgaagattgagaggaaggtttacttaacagtcttatgaggcagatgttactgttatccccattttacagaggcagctactgaggcacagcaagattaattgccttgcacaagaatttgcggacagtaaatagcagagcaacattttgaatgcaggcagtagggctctagagactaataaataaacttaatttattcttttataccttagtggtctgaaaaaataataatttcatttattcaaatgatagtgcatgtgtatgcatgtatatttgtttatgtgatgttttccagcgttataggttttattagtaataggttgatctcatataatctactccaccacagctggaaattgaaatttcttgtgatgtgattttacaactgtttgtaactatgtagctgcccttgtcaatgcctttttttctcatccttgttttccagattttctgtttattttgtgagctccctaatattctttctatgcatttctaaattaggcagatttggttttagttccttgtagttaagaaccacgattgatttgaaatgtggagattaagaaagatagtactcttttgaaaattaagttcttgaatatggggtaagtaacaaggagttcacttttcctcattttgaaggcaatatagtattcactatacagactctaagactagactgcttggaattgaggatttgattctagactgtgccatatattagctgtgtgacttaggtaagccaggtatgtatctgtcagtttctttatcttaaaataggaataatgatagcatctgtctcatatcctcatctctgagcattagaagatatattagggttctctagagaaacagaaccaataagatatatatagatagatatatagctatagataaatctacaaatatatatatagatagatttgtagatatatatatagagagaaatatatacacacatatacatatacatacatacaggagatggctatatatcttatatataatatctctatatattaatactatatacatgtatatcccgtatatatcctatataaatcatattatatataaatatatatatcttatacatagggatttatcatgggaattgactcacacaattatggtatccaagaagtctcaaggtctgccatctgcaagttggagaaccaaaaagccaatggtatagtgcagtctgtgtccaaaagcctgagaactggggataaggggtgggggtagagcttgctcctgcacagaatctgaagacccaaaaacagagagtgtgataaaaagttttctcttcctcttcctttttgttctatccaggccctcaacagattgtatgatggccaaccactgtgaagatgagagcaatcttttttactcagtctaatcattcaaatgctgttctcatccagaaacacagacacccagaaataatgctttaccagctatctgagcatcccttagctcagttaagttgacacataaaattaactgtcccagatgagaatatttaatcactgcttgggatgggacctggcacttagtaactataatataagcattaactactattattcccagtggtttgttgttgttgttgtatttaaatatcactaacatgcattgactgtttactatgtagaagtcatggtactaatcattctatatgtgctcgtaacaatcttatgaggagctatcattagccatttataaagaaaagtgaggctcagaaaattcaaagatcttctcccaggatctcataaacaggaattggcaaatgtagtattttatcctggttaaaagtgtctttatcctttatgggaacttctttgggaagggtaaagtccctttgcatgggtcgtatacacccagaacactctgccttcatacacttactgctgatgagactacacagtccttctcaccattctgtaagtaaactcctcctcccttctctaggtctatgacatctccagtgaccccttatacaggttaaatttgatcccctctgataccctcatgagaaggggagtgacctttattgaaaccgttctttgtactggaccctgttctaggcagtttgcatatgttttcttttcaaatgatcaggctataagcaaccctaggacatacagccatatctgttttgacccaaggcacttacgttcttaaatgttatgaaagttgttcaaggtcacattgtgacctagaagtagagtcaagattgaaaaccaggcttgtgtgactctaaagtatatatttctgtgtaatataaccctgagtggggtattccaataagaaaaatggctagagtggtaatgaaataataattcaattataggaagaagtatggcatgacaggtttcatgaacttgatagcagggagtgacaaggagatcttcacttggaaaagatgtagagactaagaactgttatatgaagggaggtgatgaataaagagatttaagagagtaaggagaggtgtgggctgtgcctcaggtctgcaagaggtgagagatgagtgctgaaggaaagctaggtagaaatgggcatacatccttcatgctggttctcctacctgctcagagccacagccggccaactcctatgctgtggagtcattgtcactggtggttcctatacttctctattgcgacaaagcaatgaagtgacatcaggaaaaatgaggaggagacaacactggctctttccatgatgaggccagatgactccttcccactggcagcctctttagttttttgtggttcttaggttggttctctgtagacaaaccaaaaagaagataaaagagcaagcctttccttacatttctgccactgttccctgagtgagctgatggggaatatgttgtagaattgtgagggaacaataagggaacaggagggaaaccatagttccctcccacaaacacatatacatgccccagattcaggatgtgtttccatccagttttctattttcttttgtgctcataccttgatatgttcataggcatcatactcagtgtgaaataaagatgttgtttcttggcatatagttataataataattattattattatttaagacggagttccactcttgtcacgtaggctggagtgcagtggcgcgatcttggctcactacaacctccgcctcctgggtttcagagattctcctgcctcaacttcccaagcatctgggattacaggcacccgacaccgtgcccagctaattttttgtatttagtagaaatggggtttcaccatgtcggtcaggatggttttgaactcctgacctcaggtgatccacccacctcagcctcccaaagtgctgggattacaggcatgaggcatggcacccagctggcttataattagattaaagccattacacacacacaacttaaaaacacacacacattaatgctgagtgggcagatttcaaaggaaaatgcacacatatatattgaagatcattagaacatctatctatctatctatctataaatcaaatctcctgtcttcctccaactattgcacattttactactaccttctattgtctcttttgatatagagatacagactgtgtgtgtgtgtgtgtgtgtgtgtgtgtgtgtatttcctgctacaaagagagatatatatatatattttatttgtctgcatactgtctctctgggtctctttcaaatatcttattttgtcaaatgaaggtaaatttttaaaaatgaataaaattgcttggcacaagtgtgctatattttaaaatgtacataggcgtgactcatggcctggcatgtagcaagcgctctgtaaacagtagcaggggtgccgtacctcacaggtgtggctgctagaatttcaataaagtagaaatgagatacgacttttatgctcactttgctcttgattctcattgcttattcattttaattgtacagcaaatatttatggaggtgccagcacatgcttggtgtggtgcttgacaatgaggataccaagtttactgcagcaaggtctatgacctcaaagagctcagcattgcaaaggagataaatattatgaataaataaagtttattgggccaggcatggtgactctcgcctataattccagcactttgagaggccgaggtgggcagatcacgaggtcaggacatcaagaccatcctgtccaatatggtgaaacccatctctactaaaaatacaaaaattagctgggtgcggtggtgcatgcctgtaagcccagctactcaggaggctgaggcaggagaatggcttgaacccgggaggcggaggttgcagtgagctgagatcgtgccactgcactccagcctgggtgacagagtgaaactctgtctcaaaaaaaaaaaaattatttagcacctatattatgctagatactctgcctagtgcacttctatatagcatctcccatttaattcacataacaactttatgagtgggctccatgatcaattttttacagatagggaaacagacgtagagaacttctgtagcttgcccaaggccaccaaggctataagtgatgtcactggcattcaaggctattctcatgtaatgtcacagcaaataccctttttcatattgtgaaacaatttggctcttccactagccgtaaactacaccgcttcatccatcatcccttttaatattcatgtaaaattgggcatagtctccatggggataaggacataagtatgcatgctggaagtataaacaggcctgcgacattaatacctggcttttagacatgcttatgagggtaccctttgaacatttttagctcccttcagcctcttatttttttctctctaaactcctaggtcaagaaagtatcatgcatttggaatcctcacgtattatgtttgatcattggtaatttctggtatgtgtatttgcttcttagaagtcaagttctctggaggcaaagatcctagcttgtaacaatcccccttatgtctttttcctgacaatattttctggcatttatatgccctgtactgtgctgaatgctatgtgtagaagacactgtgtttgtgacacataccttgtcttcaaattgctgatagagaagacaaaaacatacagaatattattgaagcaaggtgctgaatggtgcaggaatggaagacaaggcatgttttcagtgactgggggaagggagctggaaggttgctggggaagtagtagggcctggaaaatttcacggaggaggtgatatctgagctgggcctgatcaggtgaaaggattttgctgaggagagaaacagctgatgcaatttccaggcaaaggtgatattccttgttcaatgagagccataacaatggtgatttattccaggtgtcttaagacacattatttctggttatcacaacatctctacaaagtgaagtttgtttcgttttcttttaaatcaccatttcacagacaagaaaatggaggtttcaaaagcctaacaaagtgcctatgatatctcggcttgtgagagtatgagccagagtcaggagccaagttcttcctgctataaccacattgtgtagtatgagctgagccttgatttcctcctacgtagggtatgtttcagggagaatgacatctgggagaatgagcacagctgagcattattaggtggggtttcaatggtaaagatcccacatactgctgctctgctccttttataatattccataagggaaaatgtgaccccttttaatttcaagatcacatttcactttattattaatgaaaacatttgtcaaaagcatttggtgtaaatgtgcagtattttaaaatgtaaatgggcttcatgaaattaactttttctgataaacatagatgcaaaaatccccaacaaaatgctatcaaatcaaatcaaataacatatcaaaaaagttaatacaacataatcaactagtatctatcccagggatgcaaggaaggttcaacatacacagataaataaatgtgatatatcacatcaacagaatgaaggaccaaaaccatatgttcatctctacagaacacagaaaaaaatcctttctgtgtctattgagataaaaatatgggatctttatatgttaattttgtatcttgcaagtttactaaattcatttatcagtttgataaaattcaacaccgcttcataataaaagctcttaataatttaagcatagaaggaatatacctcaacttaataaaggtcctatgtgacaattacacagctaacatcatacttgaatgagaaaaaattgaaagcacttcctctagaactagaacaagacaaggatgcccactctcaccactcctgttcaacgcagtactggaaatgccagccatagcaatcaggcaagagaaaaaaataaaaggcatccaaattggaaaaaaaaagaagtcaaattgtccctcttgcaaatacatcatctcatatatagaaaaacttaaagatgccaccaaaaactcttagaaatggtaaacaaattcagtaaactggcaaaatacagatttacatacaaaggtcccatttttaactacatgggtttttctgactctcttcatccgttacgcattattgtccattatgcattattgccaatattctggcaatagaatattgtctcatgtgacatgaaatggggttctgaagtcaaatgaatttgggaaatctaagttatacaagaaacataaatatctctattgcaggcctaagaagtctttaatatgctagagtgcattataaggctccaaaagatagaagttgtgtgggggaagataatttgaccatgaagccacttctacatacttaaaaaaatatcccagccaggcttggtggctcacgcctgtaatctcaacagtttgggagtccaaggcaggaggatcgttgagcccagaagtttgagaccagcctaggaaacaaaatgagacctcatctctaaaaaaaaaataaaaataaaaaaattagctgggcatggtggtgcatgcttgtagtcacagctactcaggaggctaaggcaggagaattgcttgagcctgggaggttgatgctgcagtgagccatgatcacaccactgcattccagtctgggtgacagaagcaagaccctgtttcaaaaatgaacaaataggctaggtgcggtggctcatgcctgtaatcccagcactttgggaggccaaggcaggcagatcacctggggtcaggagtttgagaccagcctgacaaacatggaaaaaccttgtctctattaaaaatacaaaattagccgggcttggtggcacatgcctgtaatcccagctactcaagaggctgaggcaggagaatcgcttgaacccaggaggtggaagttgtggtgagccaagatcgtgccattgcactccagcctgggcaacaagagcgaaactccatctcaaaaaaaaaaaaaaaaaaaaaagtaaaagagaaaaaaaaatttttcacaggatccatcaagattcattttttttttttcggggggagcaagaaattagacatgtgagagtaacaggtgaaaaccatgatttgcaatcttcaaaagacctgggttcaaatcccacctctgccaactaacttactgtaccagctcccataaataatctatccacccttagaataacagacttaccttggcacttggaaagtacaggaaatggcagcaactatcattattacttttatcattgtccctttcaaaaccctaatgcactggaaacaagggaggatgcaaagataattttcactccttaaacagcaggatggcagagaggactggatacctccagggttttgtgacactaagtttataaagaccctccctctccagaagggtggcctaatgaatcactgagccctgctatgaagagaaatgtttatggttttctgatgctgcagctggctagttcgataacactcttaaataacccctttcacctttaaagcctgatacatttgcctcctgtttactgttccaggagttctaaagctataaaaataacctcactttaaagaggcaatacatttttttttaaagcataaaagtgacttggctagagccttagtaatttaaagaatagaagcccagcaagtacatttcattcactacagctcagtcttctatcagggaagagttggacagttttgtctcttttgttgtaaagtataaagaagaaaattgtttccctagcatccccatactgggattgccccagacctttcagacatgggagctcatgctgaatttcattaactaggtaaccattaactgctctgaacctctgtatatataaattgaagaggttaacattttttgctccagcttgcccacccagaaagttctaagattcttgacataaaattgttgccaggtatgccccacactcttgtgttcttttagtctgaagatctgagggaaggagtaaaattgggagttctgctaacatgcgagtagattcaagatgatccaaaattgtccctgattttaaggagattgctgtctaattggggacataagactgaaatagaaaacagtcagtgtgaagttgagtgatgattatggcacacaatttataagtgcttgtagaagattagtagacagtgtgattacatccgttcagaaatggcttcatggggagctgggtagacagatgaatgagtgttggacagatcaagaaaaagaaggtgttctattcaggatctttttactggcaaagataaggaaatgatgtaaggtatcccaagtaaaaatcaagttttaatacaatgataaggtattttgtgaattccagttaggaaagaaaatacagccaaattttaggtgaatagaaattgataactggaatgccgcaggatccagaggtgagatcccctccatccctcagaggatacacagttgactatagatcctcaagtatacctgctcaacctcctctctctcagaggacacatggaagaacgactgcttactctttattttgcctgggagcacactcaaatggcagctccagcctctgaatggtaaaactcctctatgtgggcagaacactacacatcatttgctactagccagtcttttgattgcatcctcacaagttaggggaccactgtggtttgtcagctatgcccaagggtagggtcacatagtacagaggacttttcgttccaagggctacaggcaggactgtttatattagcaggaaaaggttcctcaacaaggaagacaaacaatactgctggtgcaaagtgtcacatcaggttacagaaaatgaggggcagaaacactgagcctgtaaagagaatttcctagcccaagtgaacagtggtctaaggcaaagcaaaaaaaaaaaaaaaaaaaaaaaaaaaaaaaaaaaaaaaagaattcaaccagatgaagcatggctttgaaattcaaggaaatgatgaatgattagaaagaaaataagcactgataatgtaaataaataggataatggattttgaccattatggtggggacaatgttgaagtcttgaactataagacatcatagttctgcatgttgatgaagtctcttgaaatttagatcaggaggcaatcaaacagcaatgagaaaggaactctatacactgttctaattgaccttcaggaaaagaatttagtcccttactgaattttgaaacaccacagcttgatgaaaaagatccttggctccagtttctaatttagctttaatatttgctagcagacattttttttttaacctctccttgttttagttattcaatctgcaaaacaaaaggacaatgcttacatttaagagttattttaagaattcatacagtgtgcctaggatagtgtctggtatatggtagatgttttataaatgttaatttcagtttttctctattcctcttcagatctaggtccatattaattctctttatccactggagttttttttttttttaaactatgagtggcttaaaacccatgccacgctaaagatgatgaaagggaagggtaagcttttttgtgtggagaggagggttgagaggccggcagtgactctgaaccagcagtgaggcattgagccatctatactcactgatgacatggctattctttttattgggcatacataaagaaacgtgacccagactgcaaaggaccaattgtgtcacagcttctttcctagaggatttcctttttgtactttttatgagcccctacaaatggaatcagacggcatggcttttccagacattttgtagaggaagattgattaaaattagttacagatgaaacaatgccctctgcttttgtcgagtccctttgtcaagaaatatatgacagaagtgactaaactcttctttacccacactttggcaaaagccaaaagttgtttctctgttaatctgaccttatccttatttaccaatgaggctttctttagcttgttgttcccatgggcttgaagtatcacgagatcagattatgggatgcagggaaggaaaaagaagcacctaccctcatcttctgtttgtccctatgttctgcctattgcctctgcctctccaagttacctccccgtaggccagtctcagggctgtggctttcccaaggatttgcccattttgccacagagagggacttggactctgataatattgccattagcagtgtcagaaaagaacctctttccttcagtgctctattcattcctctgatagaatctgggtaaatacaagtctccttatgcagaataaacagtccctgctgctctctctgctttggtctgttagtcactaaattaaattctgcattggaaagaatcagaagcctacaggtagcttagttcagcaaataatgagaaaaccaaactgaaaatcaacatacttcaatgcttgttatatggataaattctgtggacgctgtgggggtaatagtatcatatataatttattcaaaaaatttgtattttgttttgtagcacctagatgaaagcagggctcaataattgtaagctggatgaatggatgcattttgaagactcccaaggagcgtggtcacagcaatgttaaagacttgaacatatagctcctcaagacacccaagttatatttttctttaaaaagtatttttttaaattatttatttcgatagttttattaaggtgtaatttacgtatcttaaaattcatctacttaagtgggctattgactttgcgattatttttgacccaacatttgttataatggaaggaaggaagaatatctctctgactgaaactctaggggagcctaagggggttaaatgttatcatcaaatctgtcactcccctaggttctggggaacatctttcaaatccacttcatcctattttcatccttacagcttctcagaaccacctgggctgtttttcccctcttagtaggctgagcttctggcaagagagcgtcccctggtgtcgggttgtgagatgaaggttgtggccatagtgcatgtgggatcttcacttacatacactggggagcgttcttacctgaataacccaatggacctccattagaggagtgtgcttttaaagtgcagattcccaggtttcactttccaaatggctggttctggagggctaatgtaggcccaagaaatctgtattctaaagaagaccccaaggggattctgatgcggatgatccctgaaaaatatctgagagcttctgaatgaccttatagcaatattggaaaggttatgagttggaaatgttgactgccctagtctaaccagttctagctttaactacctaatatggcctttccagtgtatctgatcacacacccccatcccccgcaacacacacacgtctacacacaatctttatttttgacaaaaagaaaagacaagttgatatgggtaagttaggaaaagataacttagaagtaaaataaatcataattttctgggaaaatattttttagaacaatgccatcttatttaaatatatatatttactttcaagggatacagatacatatgcatccacccttccaaatgttagctgagaccagattcttgctgagaaatgaatgaaatgggagattcaactctagtttaaaacacaaacatttccaatgactaacggtttcctgccaccttagttaaggcaggacttcctattgacaggaataattagctttggaaataaaagtggaaatggaaactaaggatgctagctgacgagcccgctttgcatatttatatattctgccatgtctttgcattgtgctttctgctcaggaataaatttgcctttattgtttgtcccggcctaccccattctcacagagctcctgccgtgccaacagagatatgaaacaaggccaagtgatctgctattgaagctggaagaaatatctccctcccagtgaccttcctagataatgagcagatatggttttctaatataaagggaataaatcaagggacctttcagggaatcagggcaataacagtggagtccaagaccatcaattccgaaagcaaagggcagaggcacctttctttatagatcaacattagactaaggcaagaagggagacattcacccccagagggggggaggagttaaaatagatcagctctcccttccccgtgtttctcccaccctccctctttgcactgagtcctgagactaatatgggagaaaatcacactttcacaggatgtctcactcgctgttattttctatcagttgagttaatacatagttttgagagatgggttgtttgtctttgcctttaactcattataattttttggtgtgaattcagtgctagacccaggtgccagattggtgtcattctgcaaacctctgttgatctgcggagcagctctatcctgctcttggtcttcatctgaaaccattgatctctctcgagaagtacctattagggatagggctaaaagcggggccaggaagagtttgggaccaggtggaccactgggggaagacaaggtaatagagtatgtctttccgtagacgtactgctgtttgctgatccatttcttatatatgtagcaccaaaatacaccagtgaaaacaaaggagagagtatgtttaattcaaggaatgacatcctggcatattaagaataaacatatagataattttgatagaaataattgctatttgctgaggtcttagtatgtgatgggcattgtgcccaatctttctgaatatattaaccttgaagaaggggtattattatccccatttaaaaaatgggaatatagaggctgtaagtttacatgacctgctctgaattacacaagtatagaaaatattaagtgaaacattatattgagggccgtctgacccccaaagtccgttgttttaaacatgcatctatgccacaggaaaagttgtcagtaaatggtctaaaaaggaggtgcagagaactgggaactactgcccagagaggctcagtctttttctggaccttatgtaggaaccagttttttggaccaaaatcttggtcaaggggagatggcattgagggcctggcattttcaaatactacgtggtgcatgtcagatttcagaaattttatttaaatcccacctcccgattttatctgtgaagaaacagacctaaaggggaaaatggattgtccaaggctgagccgaaattgtaactcaggtctttggtgtataagcctctcctactggtagccagtcattatttggtggcagttaaaacatcttgttaacgcagtaagatctatttagctcatctttcccatgacacctggagaaccccaggcacttggtctcacacaggctgtcagcaatagatttgggacagaaactcacagcccaacaccatgggcaccagagcacatctggtctaagatactctgatgtctctctttcaggtagagaatacagctcccattctttgatgtgctaagaagccagggcagtgcaggatagtgacccatttggttcctgttggggcttcttgtggttatgcctctcacctagtacttcatcccagtaagggcctcccctctgcctcttttctcccttccctgaagtctgttcaccacactgtagcccaagagagttttcacaacacacctggttatgtttcgctcttattgacaagatgaagtagactccttccgcacatccttcttcacatgacttatgcatgaccttgtaagaaatggttgtttcttgttctgtaaacccatccatattgaaaaggttttatttcttcaaacatgacatatgtctcttgcctctgagcctttaaccttgctattcccagttcctaaatctttgtatgtctggcccaagtcctggtcattcctgaggtctcagtataaacatcacttcactcagtaagtttacccttgatttttttattttgggttcagaacataccttgcacagagctcaggcctagacttatcaccccatattataattccctgatcgtgcacatcagcctccaccgatagactgtgaggtcccaggagctggtaaccatgtttgtctgatttacattatatccccagtgcttaggagaaggtccagcacaaaataggtaccaaacaaatatttcttcaatgaagcacttattggatgttttgtgaacacatcctttctcttctgtgtattttatggcagccactgtatctagtgttggtcattaaatggagaggaaattagtatgacgctggccccctaaagacttcagtctattggccgaaacacatgtaactatgcaacaacataggcacacacaaacaatataactataaattctgataaatattctatgtaaacattacaagagaccctattacatggtgacctaaactttttcaatcatagattaccttctgatactgtttaactattaaggaattgataagatcgcatgaaaaaatattcagtaactcagcaattaagtggcatgctcatttccataatggaaactggaagtgaatagggatgataccaccaatgtctcagcttcacagccccccgagcatatgcaccccaggactctagagggatcacttttgcccttccgcctttaaaagagcatgggccccaaatataggccatgatttcatgctgcttttccttagaaatccatggccatgagaggagaatgtaagagtattttcctgcctcaaataatgcttattaaggagtttgtaaaaatatttgaaagaaaacagtaatagcccatgtctccattgtctagatggttgctgatgacattttgtagattaaagtaatatacaaacttagttagaaaattaaactgacagataaaaattgaaataaataaaaataataaaacatacaaaattgcaaaatgtctaagtatgaaagtctaaaaaacacgaagtgaaatttcttgccaaaggcaataattcttttcttttattattatactttaagttctagggtacatgtgcacaacgtgcaggtttgttacatatgtatacatgtgccatgttggtgtgctgcacccattaactcgtcatttacattgggtgtatctcctaatgctttccctccctcctccccacaccccacaacaggccccagtgtgtgatgttccccttcctgtgtccatgtgttctctttgttcagttcccacctaggagtgagaacatgtggtgtttggttttctgttcttgagatactttgctgagaatgatggtttccagcttcatccatgtccctacaaaggacatgaactcatcattttttatggctgcatactattccatggtgtatatgtgccacattttcttaatccagtctatcgttgatggacatttgggttggttccaagtctttgctattgtgaatagtgccacaataaacatacgtgtgcatgtgactttatagcagcatgatttataatcgtttgggtatatacccagtaatgggattgctgggtcaaatggtatttctagttctagatccttgaggaatcgccacactgtcttccatcatggttgaactagtttataatcacatcaacagtgtaaaagtgttcctatttctccacatcctctccagcacctgttgtttcctgactttttaatgatcaccattctaactggtgggagatggtatctcattgtgattttgatttgcatttctctgatggccagtgatgatgagcattttttcatgtgtctgttggcagcataaatgtcttcttttgagaagtgtctgttcatatccttcacccactttttgatggggttgtttgtttttttcttgtaaatttgtttcagttctttgtggattctggatatattagccctttgtcagatgagtagattgcaaaacttttctcccattctgtaggttgccagttcactctgatggtagtttcttttgttgtgcagaagctctttagttgaattagatcccatttgtcaattttggcttttttttttttttttttttttttttttttttttttgccattgcttttggtgttttagagatgaagtccttgcccatgcctatgtcctgaatggtaatgcctaggttttcttctagggtttttatggttttaggtctaacatttaagtctttaatccatcttgaattaatttttgtataaggtgtaaggaagtatccagtttcagctttctacatatggctagtcagttttcccagcaccatttattaaatagggaatcctttccccatatcttgtttttgtcaggtatgtcaaagatcagatggttgtagatgtgtggtattattcctgagggctctgttctgttccattggtctatatctctgttttggtaccagttccatgctcttttggttactgtagccttgtagtatagtttgaagtcaggtagcatggtgcctccagctttgttctttttgcttaggattgtcttggcaatgtgggctcttttttggttccatatgaactttgaagtagttttttccaattctgtgaagaaagtcattggtagcttgatggggatgggattgaatttataaattaccttgggcaatatggccattttcacgatattgattcttcctatcaatgagcatggaatgttcttccatttgtttgtgtcctcttttatttcgttgagcagtgatttgtagttctccttgaagaggtccttcacatcccttggaagttggattcctaagtattgtattctctttgaagcagttgtgaatgggaggtcactcatgattttgctctctgtttgtctattattggcgtataagaatgctggtgagttttgcacattgattttgtatcctgagactttgctgaagttgcttatcagcttaaggagattttgggctgagacaatggggttttctagatatataatcatgtcatctgcaaacaggggcaatttgacttcctcttttcctaattgaataccctttatttccttctcctgcctaattgccctggccagaacttccaacactatgttgaataggagtggtgagagagggcatccctgtcttgtgccagtttacaaagggaatgcttccagtttttgcccattcagtttgatattggctgtgggtttgtcataaatagctcttattattttgagatacatccatcaatacctaatttattgagagtttttagcatgaagtgctgttgaattttgtcaaaggccttttctgcatctgttgagataatcatgtggtttttgtctttggttctgtttatatgctggattacttttattgatttgcgtatgttgaaccagccttgcatcccagggatgaagcccacttgatcatggtggataagctttttgatgtgctgctggattccgtttgccagtattttattgaggatttttgcaacgatattcatcagggatattggtctaaaattctctttttttgttgtgtctctgccaggctttggtatcaggatgatgctggcctcataaaatgagttagggaggattccctctttttctattaattggaataatttcagaaggaatggtaccagctcctccttgtactgctagaggcaataatttttaatactcaggattccctgcagaaaagttttctagtcaaataactgtgtgtgtgcatgtgtgtatatatatgtaattattattaataccaaaaggagtcattcaacaatgttgttttgtacttttttatttttaattattaagtataagatttaaaaattaacacatagtaattttacatatttatggggtacagattggtatttcaatacctgtatacaatgtgtaatgatcaaatcagggtaattgacattttatttttcagcgaaaaatagaacctggtaatttctgtataacaataacaccgaactccctttttctttttaatagctgtgtaatcttttgtcttatggctagatcatcagttatttaacaagcaattgtagttgtttgtttttgctttgaaaaacaatcctggcaggaacattcattggcattttccttctagtgtaactgtaaattaggtattaagcaatgggattgcttataagaatgatatgtgatcattttattttttattttttaatttttttaaacttcaggggtacaagtgcaggtttgttgtgtaggtaattgtgtcatgggcatttgttgtacagattatttaattgcccaggtattaagcctagtacctcttagttattttttctcgtcctttgcctcttcccgccttccaccctctgataggccccagcgtgtgtgttgttcccctatatgttcatgtgttctcatcatttagctcctacttataagcaaggacatgtgatatttggttctctgttcctgcattagtttgccgaggataatggcttccagttccatccatgtccctgtaaaggacatgatctcattcttttttgtggctgcatagcattccatggtgtatgtgtaccacattttttaaatacagtctattgtcagtaggaatgtaggttgattccatgtcttcactattgtgaatagtgctgcagtgaacataaatatgcatgtatctttataatagaatgacatatattcagtaatgggattgctgggtcgaatggtatttatgtctttaggtctttgaggaatcaccacactgtcttccacaatggctgaactaatttacagtcctaccaacagtgtgtaagtgttcctttttcttcacaaccttgccagcatctgttattttttgactttttaataatagccactctgagtcatatgcagaaggttgaaactaaacccatttcttacagcatatacaaaattaactcaagacagattaaagacttaaacataaaaccccaaacaataacaactctggaagacaacctaggccataccattcaggatgtaggcatgggcaaagatttcatgactaagatgccaaaagcaatgtcaacaaaagcaaaaactgacaaatgggatctaaataaactaaggagcttctgcacagaaaaagaaactatcaacagagcattttatatattgttagatattgctaaattaccctccaagtcacattgatcagtgtaggagtagattcatttcttgcagcctcctgagcaatgttcaatgaccatcttatagatgaaaactgtattacatatcttatttaaatgtttttaaagtgaggttgcatatttttggtctgcttactgatatgtgtatttcttaagatgctaccttaagatcagttagaaatgaaaaggtttattattagcacatcctaaatacacacaggtttgcacagacaatggtaaagcccttttagggaaaaaaacatgttttaatcacaggtcccagaattttagagatgttcatctgtcattaaaggcttcatattctatttacaaaccaccctcaatctaagttgttctggaatgatctttagtagggagcactttattaccttggttcaatttgttctctatatggaataaattagctttcaccttatgtcattctgtaaatcacacacccctcccaatggcccatcttagcaggagttaatgtaccacaggtggacattctagaacctctacttatctgtttgtgtgccgtgatgccaggatggagaccaaaaggctaaatgaagccctcacactgtgcagcagttactccatcagctcacagctctgtccctcccaactgatatattccaatctttctgattttctgtgtatccatcttttcagtctcattggaactagcatttgtagcctgtgggtttgtgatgtgctgggtcctgaagcaaaacagatgtgtttctgaaatgtgtcttaatccatccagattttaaagacaaagccattcatcttttatctggtacaaaagggatttctaggttcttcctgaggtaatgagtttgagtctagtgatgtggtgataggagatgcaggcagattcttccatgtctgtcatcaccttcccagatccatgctttagggagaatgcaggagcacaggaactcagccctgtttctgctccaggctctaccccattgccaggggccagaggctgggcaggaaggctccctgtactctttttactgttatctatatttttcagactgacattaaggatgacagccttctcccacctccaaagaatagatacctttgaagccatattctgggagaaaaagttgttaagagaggaaaccaaactctctgtgaccaaacctttttgttttttgttgcttataaaaggagtagctatttatttagtaaatgcattttctgaaccaaaaatcaaggacccttgattagatgagggacattaattgctaaattaatggaccagaatattgcaattttcacatacaaaatttccttggtacagaataaccagtcaatttatctttccttgctcccgccctttcttcagtccttctaaaaacaaggcactgtttataagacgctgtcctattttctcctccttgacaactcttttcttttaaaatcactttgttctgtaaatttgttacccttctatctaaatctgttaaaaacagagacaaacgcatgtagagactgtgtctctatgttatatagataatatgtgtatgattatattatgtggtctcaatctggccctgggtggtgtcagatccatggtttttctggctcaatctccattcttgctgtgttagccaaggactctgaccaatgatgaggcaccaggtacgtttttatgtctgcttcaaggagcttcattttcagtaaacttgcttagggacacacaagagtaacctggggcaggaatcaaggctttctttctttttctttttcttttttttttttttttttgagacagagtcttactctgtcgcccaggctggagtgcagtggcatgatcttgactcactgcaacttttgcctcccggattcaagcaattctcttgccttagcttgctgagttgctaggattacagacacccaccaccacacccggctaatttttgtatttttagtagagacggggtttcaccatattggccaggcttgtcttgaacttctgatctcaggtgatccacccaccttggcctcccaaagtgctgggagtacaggcgtaagccactgcgcctggcctcaaggctgtctttctaactgtcaatcatgtctaggtctgaagagtgaggggagagatgcccctttatctcacctacaaacacttgtccaggttaaactctgaatgtcagaacactgaacatgtgaatcacaagtctgtctcccttgcttagatgcaggtctccctctatcccagtgtcttttcaggttccacttgctctctagagctaggcatcagtgacttgagagtagggccactgtacttccatacctcctatgtcctaagcatgttgagaatcttactcatcatatgctgtgacaattgttccacagaaaagaaacctaaatcaggaaacttgagtcaaagacttggcttcaaccaaacaacagcatccatcatactaaattagaatggttaattcaaattttattagtagaagagctctaactataatatattttatgtttgtgcagatttaaacactattattttaaaattatcaacaaatttaagggaatattcatatttaaaagggattcgtgcttactccaagtttgtggaagcatagccttaattagtacttgtgtttgtcttttcatgcagatatatcttgcttgcccagctagattataaaattcttgagggcaggtgccatgagcaacttgatttttggaactcaagggtaccaaggaatttaagcaacaatcaaacaatattgattgattaatggttctgtcaccaggtaggttctgatgtctgggttttgtttattttcctctggattttttaaggattgagagttgtgcatggttggggttcttggcaagaagagagtacacatgtcaactcttttgtgtctgtccatgagtccaaagggctcctgatcccattaatccctgacagagattcctgcagggctttgatgtgtatacccaccccaagtgagtaagtgctcctcgtgtcctgaaagcatcagcctggcctctcctcagtgacatcttccactccggtgttcaattgtggctgtgcagctttattgttgcttatggcactaatatccctgcataaagtggtttctttattcccatccttttatctttttgtgttccctgttcagaggcactgaccttttagcttgcatgcattgccaggctcaagagaaaacccaatctgtcctttacctggcaattgtagctcatccccattcctctccccttatcccttctctctcatatccatcctttgctttcgatttcattttcttccccgtatcacatttggagccttactaactggagagaaggagggggtatatgatgtgggacttgagatttatcagaaacctttcattgcaaaatgatggcatgggaaattgcatcatccatatatatgtctgagaaagaccagatggagaaaatatttccacaatgtgacggactttcatactactttcatacttgtgtctgctctatggaaaagaccaaaaggaaaaaggaaaggagggagcaaaaaacaggaaggcaaataaaagtagggtggatgacctaatgtttttggctgctggttcaacccatccctgctcaaaattaaaatgaaaacactctacagtatagaatggaaagtgtggaaattctattctatacttcatttgaagtttgagttattattacagctgagtagcggacagaccaggaacacccagagtcctgagaaggcaagctttctgtgttaggtttagagtggtgggtgaaaagcacagctaaagttaaaatgccaggaacaagaagttgcccatcttcttcaaggagcaatggacaccactgccatttcctgagtcttttctgtttttcagatataacgtaccgttcattttaggttgacctcaaagtccccctcttccaaggattcttccctgattgacaaccctctgtatacttctatgctcacttgccgctctatcttacttttgtgaatgtgttgagttcttgtcctgtgcctctgttccttcatgtactttcctgcctgactgcatggttgttgagagtagacagtgagtgctttcattttagttcttcccagctattctttcctattagacaaggcagccttgcactattgttacctgacttctctctagcacaggacatcttgcttcacccttaagaaggaaggatgaggtagtgttggggaggagactctaccagggcaatcagtcagattgtgcacagctggatttgtttccccaagagctggttcctaaaagatatccattaaagtgacaatgaaaaaagatggctagaggctggaatttccccatgctgtttagccaagagcccagatggcttggatgctcttcttttggttctcagttgaggttagcaaattccccaaggggcatgcagaaatatagtagggtcaattataggttgtcatactgaccagagggaagaatgggtaatattagcatttgatgccaggagccaggccaaacaaatatcttgaaatatgcaaaaacagctcacagaaaaagataagtccccatgaaattccagtagtgcccccgcccccaccaaaaaaagaaaaagactacacagccattttctcagaaaaatttcagattccaagtgaagtttgctatgtaatcttcaaatcccttttctagagtccatttattcatgcatgaactttctaaaggaactaccatgtgctggggattggggactcatcagttcataagatagacacaggccctgcctgttggctcctgactaagtaagaggtgaagaagaggacagagatgctgcccttccatgccatgggtgttttaagaagggaagggcagagttgcctgggcaggtgtggaaagaatttaacctagaataagggaactggggaagatttcccatagtagctgattcctaaatgaagatgaggagttctgagggtgagagaaggagggtctggggtggagcgtctataaccaggacccactgtgtgaagtagagggtgcagcatttgtaaaacctggagcatcatgggagtgaagttcagtatggccgatcgaattgtagattgaagtcaaaagttgttgagagggaaaaaatagacagagcttgtcttataaataatggtaagtagcttagagtttgtcaataggataattggaagacacttaaggtttttaaggaagaatattgacagttcaaatagctccctctggctgtagtttggttgtgttgaccaaatttgaatccaataaacatgtcttttttttttttttctccccatcctctactcattccgcttgtaactaattacttacctacagatccccagatccccagagactgtcatatattggcttttgaaaattgttcattaggctgagaatttacaactaaaaacagtatacgattttctgagtatttataaattcctatcatctctgaatgtctagacaagtttattcatgattaacattagatgctgacttctgaagatacatagaaaaagcgtggtccttcttgctatttctagcggcaagtgagtaaccttgatgttgctattactgctgaatctgagcagccagagtgtgtcaaaggtttctctacattctctcattttaacctcacagcactgctacaggtaggatgagtgggtagcactgtattctacttgtcacacttggggaaatggatcactttcttagctatcaactttaatgtcctcctgtgaactagaggagtgacctaatttttactgagcaaatgctaaagtgaaaagtactttctgttgccatttcttttgatcttctcaatggcactattgggaaggatttattaactctgattttacagagggaaaaaccaaggctcagtggggttaagtgacttgtccaagattcacatagctctggagtgttcttggaaaacagaaaagaaaatggatatgtttaaatgacaaatggtcttgtctctccacccttttttgtcattttctccattccggaaagttgtcttggccacgttcttttagttcctaggaatttcctttctttcctcccgctggtcctctttgctggcccattatgcctctctaagcggatttgtagtttctagccttgaactatgagtgctcctgccgtggctggctctttattctttaaccatagtagaacaagaaaacccagattctctgaatgattctgattttaaaatgtaagacaagtgattctagatacattttattccactttgtagagtttgttgtggctccatctctaacaaagagaatagcaattcctcctctttatttaaagcatggaggggatctcaagacaatcaattatcagggcctttgaagttcttttcattttacatattttttctgagtccaagtcaatgatccccatggcttcccaattctcctatggtaaaatctggaaactatactatagcattcaaagcccaccatgtccactctcctgtgccttcccctgccacatgtgataccataagactatttgtttcttgtgctccatctccaatggccttcctttcatttcctaaacactccaagctccttccttctacaaggtctttgcatagtttctgcctgaaaacttcttaacagctttctggttcataatctactcattatcttaattgatggtgacttcctcaaggaagtattttctagcccctagagtagtttgggctattatatgtgttccgtagtaccatgtatcataccatgcaaattgttatttatattgtaattaattgattaatatctatttcattcactggatgataaacctcataataatagaggccaagtctgcttttgcaaaccattgtggtctaagtaactgggacttaggtgctcgataagcatctgttgaaagtttgaatgaatgctctggattatattatgggtgactaaattgccatctgaattgttctgatccaggtgccgaggactcacttttgttagaatttaaactgatacctggccagttgtggtggctcgtacccaaaatcccagcactttgggaggccgaggtgagctgattgcctgagcacaggagtttgagactagcctgggcaacatgaaaaaaccctgtctctacaaaaaaatacaaaaattaactgggcatggtggtacatgcctggagtcccagctactcaggaggctgaggtgggaggattgtttgagcctgggaggcagaggttgcagtaagtggagattgcaccatggcactccagcctggatgacagacaccctgtcaaaaaaaaaaaaaaaaaagaaaaaaaaaagaaaagaatttaaacttatacctcatgagagtagagagcatgattatacttgatatagatttctttgaatcaaaggagtttaaattgtatcttcttaatatggatctcttcgtattcccatcagttccgaactctgtatttaatacaaaatcttgcaggattcatgtttagttcagagatccaaaataatatgggattaatttatgctttttaaagacagttggccagtagaaagtaaatgttaacagagaaagcatttagggaattagagtagtatagtggttataagtccgagttctagcatgagacttttttagataaaattctgcttaataggcatgtgatttggtgcaaaatatttagttgccctcttagtctgttttctcacttgtataatagaagtaataacggaaacttcctcataaagttgaaaaggcttaaacaaggtaagctaggcaaagtgcatagcatagtgctgggcatcaaggaagtgcccccaaatgttcttatataattaagagattaatacattatcaagttatttaagaattaatcaatgttaattgacttgctttggctttcctccccaaatcacacaactagtttccctttgtaacatttggtgaggtagccattgttagaaagtcatgatttgagatgacatctagacattcattgagaatctggatacagaatatggaagaacattaaaatctttgacaggaaacatgcaagtagattgttttaaggaaagaaaacaagatgatgactctacattcttctcgatgatcttcacgtgattctaattctctttggcaacaatagaaacatttattgtaatcatttttaaaaatcacaaacactcccacattatttctggtacttatggtaaccttatcacctttcctagagcagagtaaaggcaggcattctgacatttggaaaaatgaggtgtgtggttatttttagacttactgaaacagcagcagcaggcttccatttataggaactgtaggaaccttcccctatgtctgggacaaggtaatgacttctatgaagtaatgattttgccatcataaattttatcccactgatgatcaactacctctttagtggcctttgcattatgctagtttgtctttttagtattaagagaatgaggccctggttgttctttgcattttatcatttctttcttcccgggctgggagaaaatgagaagcaggggcagactacctcatgactaaattgttcctggctaataaaactgcaggaactgtacgttagggtgtcttccataaatcagccttggggagaattaggtgctgagagatggaggaatgatgtttaatcatcacttgtaggaaatcattagctccacacccgcattctcctacttgcccattcgtcattccccaatccctagattcccctagaccattaacatttctcaatgactttctaaatgcagagaaaaaccacagaaggggtgagggatggaggtgcattacggaaaaacacaacagagagatgtctttgctgcttgcttcctgctcctgtgaatgtaaatggacctatgtaaaaaccaaatgatcgataacttggccagccagctgctgccacaagaggtaaagaaactgttgcctcctgttttcccctctgcaaaaagaaataacttggttcccacctagatttctttcctttggcagtgtgaaagacagctctttcttttcttcattatcataacttcctgacagataaggaaagtgaggacgttggctggttcttggaggagtaccaactttgggaaattaattgtgtcttcctaaactgccctctgtcccaccctagagaggaaaagccacaacttaagtttctgtaaggtctacaaaaaagtgaagtggacagttcagtaaaactgaactggttcatggtctaaatgcattggtaagcacccttaaaagggttaatccaatagcgatgtgtagacagacagatctgttcagcaattcatagagggaaacagtattctagccttgccttctccaagaatatacttgttgatgctaatacatgtacacaaagggattttaggagcctcttccttagacaagtaccccaggtttttgcctctgattacttccggaattaattttgatcatggatcttagacactcttagctttcatatactgttttccaggcaagactagaaggtcaggaatacaataacaagttcattgagaacttactgtatgccaagcactgactctaacaagaaacctgacatatacaaaaaatggctaatttgcaccactgcactccaaagtaaggatttaattttactggtgaaaaacctagtgctagtgattgtgtttctgaattcatgcagctgagacaaggcagatctaagttctgtaggtcctgaaagttacttgaatagcctgtatgaaaaatgcgggaatacaaatgtaggtacagggatacagaaagggcatgtgaaagggagggtcactgtagctgaatcttcatcagctctgtggtaaatttgcttccattcagttagaagcagaagaagctgatctgactctggtctccctgatatctcaactgcaatgaaatttggcatataaaaaagaggagtgtctgttcataatcatttgtgcactttttaatggggttgtttcgtgttttaattgtaaatttgcttaagttccttgtagattctggttattagacctttgtcaaatggatagattgcaatatttctctcccattctctgtaggttgtgtttttgctctgatgatagctttttttgctgtgcagaagcgctttagtttaataacatcacatttgtcaatttttgcttttgttgcaattggttttggcaatttcatcataaaatctttgcccatgcctatgtactgaatggtattgcctagattttcttctagggtttttatagttttgggttttacgtttaagtctttaatccatcttgagttaatgtggcacatatacaccatggaatactatgcagccataaaaaggaatgagattatgtcatttgcagggacatggatgaagctggaagccattatcctcagcaaactaacacaggaacagaaaaccaaacactgcatattctaacttataagtgggagctgaacaatgagaacacatagacacaaggaggggaacatcacacagtggggcctgttgggggaggttggtgggaggagagcattagggaaaagagctaattcatgctgggcttaatacctaggtgacaggttgacaggtgcagtaaaccaccatggcacatgtttacctatgtaacaaacctccacatcctgcacatgtaccccagaacttaaaaaaataaaaaataccccctgccccctgcaaaagatgagcgtcctaacaagttgaatccaaatgtgaaatagtaaagagtcatgttaatatcccaatagactttgaggcagcagttttggaaagcttaagagaaggtgaaaaattaatcatggagttttctttgtggctcaggaatttattactccttactataaagctctgagggaagaagccctgactggtaggctctcaaccactctacaaaggagccaatccatggagaaggcataggaaatgggggtcagaaggactgtatcctagccctggtgctagtgctgataaaccctgtgactttagagaagttacatttggtttctttatctctgaaaacagagggctttactgtagcttctgaattctttgattccaactcaaagaatgcattattttctacctatccttggtgttcctccttgtggaatatttgtgggatagttgagtgtgttgtaaagaggccacctccaagagaagtgtggaagtgaagagagaagagaaaatattgctttgcctcgggtgggtagagacagaaacagagaagggaaaacaccatagcactgtgctaaaatagagtccaatgtctatcacacacaattcaggttgcttaattttgtgtaaatgaaaagctaggttgaatagcagaagatgtgagcagttgctgatcacgtgatgtttggagttgcattactgtaagtgcatttttgttccaaatcacactcctttacctagtctccactgaccacaaggatgacaacaacaacaaaaactataacaataatactatagatatgtattgactgtaagatttatgacttatgcacatggacactcagaagatggctcatgtaggcaatctctcaaatattttccaatagagaaaatgttttagattatttgtgggttctcaggatgtatcactaaagaactatttaactcacaaagtggctgagaatattgtatcctcaatgaattgcagtagaaaatgttgataatttgttctcaacaaattaggaaaaaaattacaaaaattatactcactttagtgaaaaaaacacatatttaaagatgatggggagatagatgatggggcagatattcttttatgaatatctgggagagctataggacttcagagattgtggttcccgattgcttgtcattatttgactttaaatctaggatgttccttttatgttgaaggagttgaatgcctaacacagctctcacctttattggccaagattattgtcacttgtcaatcataggaaatgggaatcagaaggactgtgtcctagccctggcactgttgctgatgaacctgtgacttcagacaagttacaattggtttctttagctgtgaaaccagagttttactgtagctttggaattctttgattctaactcaaacagtgcatgattttccacctatctttggtgttccttcttgtggaatatttatggaatagttgagcttattgtaaagagactgcatccaagtgatggaacaggaattctattgtgaatatctggagatacagagatagaataggattgtgggatggaaaaatgaaatgaagtgagggacaagtattttcctgagataattgggtagggaaagcgaagacagacaggttgggtagaagtgaaagaacttttctaatggggaaagacagaaggaaaaacagaagttgctttacctttctgatctctctgaggagaaagtgggttggattagaaagtccagctgccactgcttggaaccattgaaccttacaatatacacgcttccagaaacaaaccagggattgaagggcaggggagataaaggagaaagaagcaagataatacatgtagcagtacagctaagtaccgggtgatacaatgtaagctgtatatgggtacagtgatatgtagtgaaagtttaaaaacaatgacagtatagaagcatgctgttgtcagatggggttattaggaaggcaagataggaatatgataggggtattggccaaagtaattaactgagtgtgtctaatgctctgtgtgggtggatggaagtgtgtttatgtattttaaaaggatctgagacaaatatatcaaatattaacataggttatatctataagatgggcacatgggtgcctattataaatcctgtatactcttacattttaaagttatttgtagggtaaaagtataataaaggcgttgtttatgatctacaagaatattaataatagtgttatagatttgattatcaactctgcaaagacttccctttctaatgtaaatttcttaagcccactttgcctcagatgctaaagttattaggaaacaacatgtccaacttattttataactacgaaatttttaaacatcttgggcgtgaacattaaaatgaattttcatgttaatttgggccacctttgagctgggtgaatgtagattatacagaaatcacttgattaatctctactctaatgaacctatttctagacaatgataaagaatattgatcctctgtaatccattgctctaggatgctttgattctccaggacaggcatttccattgcaggtggatagataggcagagtaggcttgtgttcctaggagaaaccagagggagaagaagcttggaaaaatccattaggtatagtttatgacttgaatgaaacttaactgcttctacaccatgtcacattgcagatccataaggattacatgtgtggttttccatatttgaagatgatacagacccggaagcagagaagcccctgacttgtatttttatgacagtggaaattccctatgttcagtttctttgccttcttccccttgcaaaaaatatgctttttccaacaaataatcattgtgctcctaataagtgcaaccatgacagtcactggagacacagagctatgctagacccagatatgtttgttaaggccctcacagtctagtgaggaaaggaagcaagtcaacagacaactacaatcccaactgacaggctctgctatgagacatttagtgtattatagcgagggcaggaaagggcacccactttgcagctggtgtttcagaagacacatcgtggagaaaggagcatttgcagaggagcagccattgctaagtgaaacagatggggaacacattccacatggtagggacagcatttacgattccctggagctttaagggggagagacgtgacaaaaaaattccaagtacaggcgaaagtctcagtgttctgttgaagtatcttgaggtgaagaatgactagacttcggcttttttttaaaaatttttaaaaacatctctgtcatggcagtgtagatgttatcttattggagtatgaatctgaagaagaaagatacctatggctgggaaataatttataaccaaaggacagataaaacacaacaggattatagggacctgacatgacatatggtggtttcagtagactgagctggaaaaagtctctaggtgttgtctaaaagagggagagctgagcctagtttagtcagcaactattttccttaaagtacctttagctctccatcacccagactggttgtaatttctaatagttaataatagtaataataatcataaccaatatttactgagtgtttactatgtgccctgcatgtttttaataattcacctgcattcactcaactctcacaacagcccagtgagataggttacagtggtgtcccattttacagataaagtagaaggaggtttagtaatttgtccagggtcacacagccagcaaatgagtggagccaagagtcaaacccaagtggtgcagctccagagttcatactctgtctcccagggtgtaccgcctcctagatcaagaccattttatgtttaatgcaatttacaatgtcactccactattttttcttgtaattttatacatgttatttagaatttgtttccttccgaccagacactggtccctttataaaactacttatggtataaatggaggattttgtaggtctaaccctatgtctcagacaagttaataattgatgttatcattaaactcattgataatgaaattattccattcaacgtttttatttcatcctaggcccatcaattacaagaaatacaaaatttatatgaagatagatggtcatataattttttttctattataagggaacaagtcatagtgatttttatttcagtgccaagattcccttattcatccatttgtccatttattcttttgtcatatattgattgagtgtcaactaaatgctggattatggttatgtactagagatactgtcaaaaagacacagttctaaccctcaaaaatctggtcatttgggcctaatcaaatttctgctgtccacaatgaaggaaacagggaaacaagaaataatttttttgaaagaatcccatcttgacaaaataatctacacacacacacacacacccctctgctctgagaattaacaagacaacctacagacgccatttctaaaaatctggctggctggaatagagggaggaactatagctctgacataaagatttagggtaatttagtaaaatattagattaaaatttaagtaggaaatttatgtgttattaaatagtaatcatgtttaagaattaatgatgaggtattcagttgtgtttaatgcttaattcttagctattgcttaaataagtatcaacttttaaaaaacatgattagctatataagtgaagctcagatttttgaatctattttttaaagaatgcaatactgctcagaggtgaaccctgagaatctatggaactagatagcctaaacttaacctccggtcatcactctagtagcaaatgcaggcattctgatcatgtgttcatggcaccagggacagagacgaatgggcctttgtctggtgtcattataaattattctaaaataagtaaagccaagctagggaaagacagactttttccctctttgcttgtttgaatttcactttctctaagaacttcaacattaagaagaactttattattaaatttcttaaataataaatgctgaggaggcatgttacccaaaggatggatttagtttcaggaggtagcaaatatttcagaggcaaacagtcaaagaattctattccttgaactgaaggaaataatatagcatttattgagcttcagttttatatttgttatctcatttgacttatttctttcaacactttcccatggatttattaatattcctatcttatagtagagaaaactgagatttgcttctgaggcttttttctaagatcacacagttcaccagactaagaacagagattttaaaagtcagattttctgatgcgatgaccagaactacttcctcttcttgttgttcttactggtagcattctgtaaagcatgccaccatctctctgataatacaagacatcacaatcgagaagtcaaacaatcttatgttctattcaaatgtgaaaatttgcataactcaacctttttggattttattttccttgattaaaccatgaaaaccgtgagttgagtagaatcagacagagctacacagagatgaaaaaagggccttcttagattgctttcatttatacagaaagaactcatcactgcaaggtgtctgccctgatcatgttgcttcaagccagccatatcctcaatcattgctccacagtgaatctagtcaatgtgggaacattgcattacagctgatgggaatagtcttagaccctgctgatttgctcgcaaattttattcagtctaactttacacctttggcatttttctccaatttagttttactccaaatttctggacacaaacatctccatacccttcccattgcatataacatagtttaacataacataatataacgtaatgtaacgtaacatagcataacatactcataacaacacaacataacattactgctatagcccgcaagcatgatccacccagtctttgattccccttcccaccttatcttataccaccttctgccttgttcactgtcctccagctacactggtctcttattttaaattcttcaaacattttgcatttgctctggtgtaagggtctttgtgcttgctttttatgcttgggatgcctttaccctgacctttgcatgcctcatttcctttaggcacttcaaatttcagcaacgtagggaagcctgacctgacaacctagtgatcaactggctcttggcccacatcaagtcactatctaccacattgcattttctagattttctttatgggagttataaaaattaaaccatatgaaattaactttttaacatgtatagtcgtttattgtttactaattttctgcaatgtaagttccagcaaatcaggggcctcttatatcatattaattgctgtgccttaagggcttacaggaatctctgaaatataataggtaccctttaaaaataatctgtagaatgagtgaatgtttgaagagattagatatttagaacacaatgttgtcagacactgtaaagggtgtgaggtttttaacctacttgctagataacatagacccctgggttagagacaaagacagtttattactcataacaaaagcagtcgccaaaggagcatattgcatcagttgccagtgtccaatccttggatccagtgagggcttgatgggacctgtacatgcaatgggatacattacaggagaggaacccaagattaaagctgttggtgggcttctcattttgagagggagagagagagagacagagaaagagggagagagagagagagagagagaggaaaggagagggaagagatattccatttttattctggaatataagcaaacatttcctgggaaaaggaatgagagttctgtatcttcattatcccaggctatctctaggaaggaagatttctctatgctttactatcctggaatgtatccttatataagtattcttaatttggctataaatgcctttgctcagaggaccgagaccctgtgtaaacatgagatattcatagaaaatgatttctcatcacacagtttccatgtcattgactaaggactctgagttgtatttacttttaccttctgcaagtaatcttgtccaagaactctggaaacctttccattgtccagtttgactgatgccctggcctggccacctgcaggagagcttagacccaaggtatctgagtccaaggacacttgttcattcaccatccccatcgacattggtagcatttgctgttaatggtgactttccttggactttactagcaggtggagtaatacagctcaagttaaataatactcttccagtagcagaagtttgaaatgcaaggctcatttagagacatgtttgggatgagtatattttcctccacctcatctcattgcctcccttttaaagtcacaaatgcaaatctggggagagcttccgagaaaggcagattgaaaggcttaaagatgactgggttctagtgcatatcccagaacaaaggaccagttatataccaagcattaagaagattccgctgggctcctcaacccaatttaaaggctcttactttaatcctttaatactgtatattgactccttacctctgcaataggatgaaaatattctgcccaggttgttccttttcaatagtccctattggttttcttgttcttctttatttcttatttcctttataaatgaaaaactaaacaaaactaaacaaacaaaagcatagacagataatctacatgtatctggcgctatagttagtttatagagatgaataagactgggtcctgctctcatgaagctcactatctagtggaacagatacataaataactatcacagtgcagtggtccctccatggggttgattttgcatccccgcacaggagacatttggcaatgtctggacacggtttttttatcttcatgactgggaaggtagggttggttactaagaacatctactgtgtagaagctacagctgctgctaaacaccttagaattcacaagccagtttcctacaacagaattatttggtccaaaatgtcagtagtgctaagatttagaaaccctacaatagggtaaccaagctgaaccagaaattaagaaagacaccgcaattgcacgatggaggattgagtgtctcaccgaaggatggcagagttggtcagaggagacgtacctgaagaggtgagttttgagctgaactttaaaggacaattaggagttttccaagtagatgtagagggtatcgtaggagcaagctccctcacgggctggggcatggagcattgatttcctgctagagaactttgtgttccccaaggctactgaagaccacagaggagtagtacacaggaagcaactaggattacacagaataataacaacctaccttgttcagacatctactctgtgctaagggcagggaggccagtccttctcaaacctgggcacacagctagattacctatctcagctacactcatagttagatgtggccatgtgactgagtgcagtcctggactattggcaggattgaggtgtccacttccaggcctcactcgtaaaggcatccaatgtgtggtccttgctctctttcctcagccacagtctagaggaactctaaggccctgaggagggaggtgtcaaagatggaaggaagttggtccctgaatcactgcataaaagattacgcaccggacttgactagagcagagactaagttgttatgacattaagctactgagatttcagggtttatctcttatagtagaaagtgctactataattaatctaagtataaatagtgctaggtactttagctacattatccctaatccttttgataatcttgcaatacagatgttattctacatattttaaacataaggaaaaagggttcaaagtagttaagtgacaaaagctattaagtggagtgaatcagggatcaaatgcttgctctttccaatgcgcttaatggtatgtgctttctctttacaagagctagttttgaatgactctggataactttttggagggagagctttcctatacagacttgcattcttctgtatttcttctggtttggtatgggggaaagattacccctaacccccgtatttccatgcctggtttagtataccaatgcagtactctcatcgcctaaaatttttggtccactggtaacatgttcggtaaatagaaactgcacttgcgtaagtggtacattgcttgtcagacattcagggatggataaaaaaaaagaaaaagctttcacaaatgtagttgtctttctccttaattatttttttctccaatgaactggaaaggtacatgaaacaaaggaccattctgcctctcttagctgctggaagccatgttttatttcccagttagagagcctattggcccctaaggctgctggatggggaagttgccagtaggcaggcagagtcattaagggaaatgggtgtttacatatagcagccctgggagatacggaagttcttgtgtggatagaaatgaagtaagggcctgagaggggcagaatgtacatatttgatggggcacttatgaaaaacaagtggaagaacagtgtggctggatctgagagtggaagtataagacatgaggccgggaggtcactgtagtggtctcaggctttcagtctgcccagcatctccttcagcatctccttgggaaaccacctctcctctattattagtctttgaaattaaattggggttgagcaccttctacttcctggtttgggaacctgacccagacttggcccatcacttgatttagtcctcattaccctctgctgatcccagccacagtagctgttatagaaatgagcatattacccaagcagcaccagtataaataatctctaagatgtttctgtgtgggaaacctataagaataacaaatttggaggtgaagtcaagatcatcagtttacattttatttgtggtgtctttgtcacattcatatagaaatttcaattaggcagctggaaagttgagtctaggtttcagagaagagctctggacaggagagaaacattggtaaatcatctgttccttggtggtaattcataagcacacatgagatcacagagtcaaaggttaagagtgagcagagaagagggcctgtggctgggcctgggataatgccaatatttaatggccaaataggaaataaggggtctgaaaatgaagacacagaatggataatcataaaggtaggaggaaatcaaggaggtcattttgtcaactaaggcagaaagaaaatgtttgaagatgttgtaatcagcaatcctgatagctgctgatacgtacaataagctgagaacagagaaatactttgaaattgagcaacatgcatgctattgctgacctttggagctgtttcagtagtgtgatcacagcaaaagccagagggaatgggttaaggagtgactgaagagagaggaaatggagataagttatcataaacaacccttccaaaccagtgaacccttaacgtgcaaaactgagccactggcagctggaagcctgcatgacaaactgtggtttggggttagatttacctggatttttcggaatcaagggtgcacttatgggccttgattcttgattcttggctttttgtccatggttcagttctgttcaaccaacattattgagtatatacattgtgttaggccctgagttgtagggaagaacagaatttggttcttggctttgagaaacgaactatccaggtggggaaaaagacttgcaaaaagaatatttgaattcaacatggtaatgcagtgatggggtacggaggaggcactcctgagtggaagaggtgtgatagctgaaccaagcctcgaaggatatgtagggtttaagtttctctctccggaaatctaactcttccacatatggagccaacccatagaaagtggatgtcaatacatacgtatacatgtgccatgttggtgtgctgcacccattaactagtcatttaacattaggtatatctcctaatgctatccctcccccctccccccaccccacaacaggccctggtgtgtgatgttccccttactgtgtccatgtgttctcattgttcaattcccacctatgagtgagaacatgtggtgtttggttttttgttgaacatgtaccctaaaacttaaagtataataataaaaaaagaaagtggatgtcaatacaattagccttcatgcactcagtggaataaatgtgcagagaagcagaagcctgtttctttagacccctgatgctgtccacctaccactagttggctctgtatccactgaaaaagaaaaaagcagagcagctaggtgtgtatggaaaagaatctctcctagatttcttatctccatggggtttcagaatgaaatataccagctccacaggaaagcctctgacagatgggaacctatttaacaagccatgggaaatgaataggctggctctgagagggatagcacagccatataaatctattctcagggatgtgggtgtcggcaagccccaatgacccacattcagaagtatttgtctattaattagggcaggtggttccatcccagaaggctttgcctagcaacagtaaccaagaccatctgcaacttcagtcctgtgagagagcttcaagtgggagaaattagagtgatgtgcacagtagcaagagaagaccgggaacctgagcccgatgctgtattgtgcccctgtttttccctcactgaaatcaggagtttctgacagatcaacacagtccttaaaataaaatctttctcccctcactaatttaaaaatctgtatggcttttacatctggcatataattacaatagtggatgatttcaaataagaatattaaacaatgtttaagagttattgcaagatggttgggacatagaaaaaggacaatggagtctttaatacatacttttgttttattcaatttattcgttgagcaaatgtttatttagaatttttcacatattgggggcacaatattgaatgaaacagagtatctgacttcaaaaacttaaaatctatgggaataaatcaataaagtaatttcagtgcaatgagataattactgcaacaggtagctctcagggcaggaagctctaagtacagggagctcctggaagacagaagcagccctatcattgagggctagtggaaagttaagaatgggaggtacagtatgagaaaaattaagatttatattgaggaaaacaaagtatggtgttctgagaagtgctacaatatgtatcaaggccaggagacacaagcagggcatatttcttgaatgaatagttcactgtggcttgggacttagagggctgggatagaagtataagaaatgaagtggagaggaagagaggtaaggagcggctatgacattaagagtctaaaatgccatgctaaggagtgaggatgttgccctttaagtcaccatagaaaagttttaactggaaaggaagcaaactcatgtttgtactttgggaaatgttcatttgtttattcatatcccaaaaaatacacagacaacccctgctctatggcagacattgctttgggaacacagtggtgttcaaaacaggcatgattcctgcccttgcagcacttgtaagacagatgttaaacaaatgatttgaagggtcagtgggatatcaatgtggaacatgaacagaaagaggctagagacagggaggtgacttaaaggcctgtggcgataaaccagacagaaagtgatggtggctcaatccaaggcagatagcagggttgggagtaatagattaattccagatgtggtatagagtgagaaaccctgggacactatgactgaatatatgaagaaaaatgcaaaaggcaattgggatctcctggtgaccatacacttctcttgatgaaatagcatgctcaggattagttcgctccatgaagaaaaaggaaactgctcaaattttgcaaatctattggtgcatcttagagttaaatcctgtggtggtgagagatgacatagaaattcaggcagccttgatatttgaaaagagctgtcaatatctcatactctctgaagaagatcacttggcatggctagtttctgggtggctaacatgaaaaagacttagtacaggttaagattcaaaagtctatttaaaatttatacttggaccttttcttcagccagagctcatgcagtggtaaatacttacatttttaactcatgccagaagattttttccaagctattactatattttatattaaaattgtttacattttatttataaacatttcaaacacataaaaacatttagaaaatattatgacagacacctatgtactcagcaatcaccaatcttaagtaatttttatttaagctgttaaaatacaattaaatcaccatttccatttcatcatccttaacatcttagagaaaagaatcactgtgaagttgataaatagcatcctatatacttctttttctacctttgctagacgtaagtgggtccacaaacaacacatagtttctttagcaatccaacctaaattgtagctgacaatctggtctctgatgattgttcagtggtcatcaatcattttccacctcctcttgttcactcaacatgttgcgcttgagattttcaggttgataaaagtgaactcagtttattcattctaatggctgtatatgctcattgcatagatgatcacagtttacagatccattttctttactgagagacagtacctttctgtcctttgccttgtataaaagttctctatgtcagcaattgagaagcagaattgctgagctacttcctcatcgtaacttggtgatatccatgtagttgccctttgacaatctggaagtgatataatctcatggttgcttttaccttcattttctgattagtgaggttgagctcaacccctcatattttatttatttgtgtttcttccactgtgagtcacttattaatatgctttgtccattttttctattcgttgcttctctttctgttcttttttttcttattgatttgtagaagttcattctgtatcttgagaacttaggcctttgttccagggattgtaatattttcatccagtttgtgacttgtcttttcatttttgtggtttttttttatttatggaaaaaagatttttgctgttgttttgttttgcttttatttgaatggatagcattcctgattcatattttattctctgtgaatcaatggcttagaattatatatatatatgtgtgtgtgtgtgtgtgtgtgtgtgtgtgtgtgtgtgtgagagagagagagaattaaggggaatttgttaataaaacaggtttttttaaaaaatcaacttttagacacgggagtatgtattattttttgctagttttacttaatatgtgttaaaatatgtgatttttcttcattacgtattatgtttcttttgtgctctaagaaattgttcctaaccaaacacaataaggttttttttcttctatacatttttctaaacattttagaggattactgctcacatttaagtattttatctagctgaaattaatttttgcatataggcagaggaaacgttctaattttgtctttttccatatggacagccaattaatggtcccagcaccatcaccagttttataaaaacctacttccattatgtgccaaactctcatatacatgagggggttgtttcttttttccatgttatgttcccttgatttatttcctattcctgcacctgtaccatccaggttaaaatattgacatttcgttaatatttataattacttactggtgaaatacttatttatatattacacaattatattaaaataaaaatattactcatataaattcatactctttctcttgtgcctcccctttccttcttattacagtggcctcttccatctatttttttttccctttacaatatcatcttagtcattatttaattttcagtttccataggaagtttagaatctgcatgtcaaagttcatgaaagatctttttggaattttaactataaccacattcaatttgcagatttatttagggagaattgggatatttatgacattataattaccatccatgtagatatatctgtttttatttataacatttctttttagtcttcaataaaattttacattcaggccaaacatgttttttacatggaaaattttattttgaatatgtttcatcttgaaactaattgtccatttacatttgacaacagccatgttacctcttctgtttttttcttttaatttttatccacatttaacatatataaagataagtgaacaaatcataatagtaagtcttgattacagaggggtcataatcaagaaactgtcacctagacaaagagaaatttttaaaagctaattatcgggggaaattcagccagatatcctgcgaaattcagccagatatcgggcgaagttcacccccaatatttcatgtaggttcttttctatgttccctaagggtcagccggtctgagaaataaaaggacagagtacaaaagagagaaattttaaagctgggtgtccaggggagacatcacatgtcagcaggttccatgatggcccctgagccgtaaaaccagcaagtttttattagtgattttcaaaaggggagggagtgtatgaatagggtgtgggtcacagagatcacgagcttcacaaggtaacagaatatcacaaggcaaatggaggcagggcgagatcacaggaccatgggactgggggcaaaattaaaattgctaatgaagtttcgggcacacaatttcattgataacatcttatcaggagacagggtttgagagcagacaaccagtctgaccaaaatttattaggcaggaatttccttgtcctaataagactgggagtgctacgggagactgcggcttatttcatccctacagcttcgactgtaaaagacggccaccccccgaagcggccatttcagaggcctaccctcagggacgcattctctttctcagggatgttccttgctgagaaaaagaattcagcgatatttctcccatttgcttttgaaagaagagaaatatggctctgttccacctggctcactggcagtcagagtttaaggttatctctcttgctccctgaacattgctgttatcgtgttcttttttcaaggtgcccagatttcatattgttcaaacacacatgctctacaaacaatttgtgcagttaacacaatcatcacatggtcctgaggcaacatacatcctcctcagtttacaaagataatgggattaagagattaaagtaaagacaggcataggaaatcacaaggatattgattggcgaagtgataagtgtccatgaaatcttcacaatttatgttcagagattgcagtaaagacaggcgtaagaaattataaaagtattaatttggggaactaataaatgtctgtgaaatcttcacaatttatgttcttctgccatggcttcagccggtccctcccttccaggttcctgacttcccgcaacagctaaacttgaaagagaatattatgcacatcccagaagtctcctggtgtctccttttgctctttgactcatcacccttcctacggatcgttcactattcttattatcacacatcattgactagtttgtcctcttaaaaatgtgatatgaatgggatgtttgcccttcccaccatgtgaggacacagggagaaggcaccatctgtgaaccaggagacaggcctcaccagacacagaatctgccagtgccttgatcttgaacttctcagtccccagaactctaacaaataactttgttttattcataagctatcaagtttatagcatttggttaaagaggcccacatgcactaagacagtattccattgtgtgaatattatttatccattggaatcatttattccctgaaatctcagtgggcatttggatagtttctagtgggggaccattataaatagggctgctatgaacagtattgtacctgtcttttgatgaaaatatgcatctaattatttgggtataaatttaagtgtgggcttaatgagtcatatggtatatatattcaacttgtagttgatactgccaaagaaatttttagcattgtatggagaattctgatgatccacattaccaaccatttgtatctcttttctttttcactgattttttgtaatggggaaatagtgggattgcattgtggtttaatttccatttttttcagatgactaataaaatagagtattttatttttatattttattaaccatttgagtctcttcttttgtgaagagcctattcaaacttttgttcatcgttgtattgagttgattgtgtttttctgattgagttggaaaagtatgtgttggacacccccccaacacacacacacacacacacacccctacacttttcactcccttgtcagtatgttttatttctgagtctaatgtactataacttatttttcttttaaggctagttctgctcatatcctatttaagaaatctttgcctactctaagatcatgaagctatcctcctatgtgtttttaaacctctattgtcttacctttcacatttaggtctatgatccacttttagttatttctgtatataatatgatgtaaggaacaagacacattttcttgccattgacatcagttggcacaataccatttattaaaaaggccacctttgccttcactgccgtgtcagttttgtcataaatcagatgaccatatgtttcagaaactatccctggattcttttctgttctactgatttatgtttccctttttatctcaatatcacactgtgttcattaatatagatttataacagctctcaatatcttattgggtatgtccttcatgtttattgttctttgatattactttgccttttcttggccatttgcattttcatgtaaaaatttagaatcaacttataaactcccaccaaaagtacattctggatctttattggaatcacctttattggaatcgcattgagtcagtagatcaatttgggggaagatttggaatttgacaacataaaagttttttattctatggctataaaatatctttcaattaattgggtcttctttaacttcttttttttttttttcttttggtgagacagagtctcgctctgtcgcccaggctggagctcagtggcgtgatatcttggctcactgcgacttccacctcccgggttcaagcaattctcctgcctcagtctcaatcccgagtagctgggattacaggcatgtgccaccacacctggctaatttttgtatttttagtagagacgtggtttcaccatgtttgcctgtctgattttgaactcctgacctcaggtgatccacccacctcagcctcccaaagtgctaggattacaggcatgagccactgcacctggaatttaacttcttttaattgtttgaattgctcatttttgaagtttttataatttttattaatttaatttattcctaagtatttaacatgttctgatgttattgtaaatagcaccctttaaaatatttgtatttatttgttaattctgtattatgttcatttctctttgaaataacatagagatgaattttttttcaagttctctctgtcattacctgacatgtttagcccatgtatgttactgatatgtgttaatttattttctccaacagtttatgaattttctacttactatgttttgcctttagttttagctctatatttcctgccttccgtagggttaatcaattttatttattctcacgttcctctttactgttttgaaaagtgcacattatgcctctaattgtttataggtttcccttaatatttcaatgtaacacctcctttgtgggagttgatataagaatttagtagcaaacatgaggcaatgtattctgagtgcatgacccatgacaggtgctcaaaaccagtaattatcattatgaggatttttaggactcttagagatcgttttaagacacaaaaatcatcttttcttaccccactctttgtatatctccctgtgtcactctctacatacctttctaggactaaacagtgacattaaacctatccttaaagaacttttatatctgagtcgtttcattgtaagaagaaaattgagtcactaaaatctccagggatggttaggctaccaaagacaatatagtcaagagtagtggagcctcagcttgaggcttatgagactggaagctgaaacatgttttttccacctcatttacatgtatcttgttaaaagttgactatgatgacactctgatcatctactgggaagaacaagcatgagaggttttgcccatttttttttttaattggccttgttatagctattaacagaatcatggcttttactttttatcgagaagtttctctttgtccttccctcttaatcacaatttatagatcttctggatctgtggcagagttattatagatcttggacttcatagtcttttaatctacaaaaattgtgactcaaaagtcacaatctcaaaacgctactcattcaaatatcagtcctgacacaatctaggaatcaaaaattatatttgtttgttatttctgtattacgtttttatctcttttaaataattagagccttaactctcaaagggccttgactcatttcaaaatctttattattttttaaattttaaggattatttgacaatagtatttataaaacaatgaagagtactattttccatatataatgtctgagtcattatttgactctatgctacctggtagatattatctcccattccaagatatatattattcccttgcaaaagcagacaagacaattcaggtgtaaactctacaggagagacagtaggattttactatttctcatttctaaaatgtgtttgaaatgctatgtaatctgctctaatcttatttgaggaattggaagcaaaatccaaaaataatcatttcctacttttgtgtgcgttcttgaaagatatgatgagactggtggttagacacaaaaatatgagtgaaactaatcttggataatactctaacaattgcattaatttttgcttcaagttgatatcagtcaacttaaagttggggcatatcaatcaaattcaggatcgatcaaggtagggataggtggcaatagggaagtaagaaaaatctacatatacttagaaaacatttttataaatgttgagatttgctgaaactttgccttgcaatggtaaagcaaatactttattcttgtgaaggtcagcagtgaaatgttttaagaattaaagacagtggggccatttttgttaaatttgacaagccccaaagctaactactttctatgtcaacgtctgattgaagggaaattagctttaacttgcactaaccaaattctttggccacttttccttgtttgtttgttttaagtgatgtttcatctctccagtgacatgtataattagttaaaaggctgagaaaaacagttgcatcccagaggaatccatatccatgaaattgttttactccttccaagttgcttatgctttccagttgttataagaagttattccaccaaatgaaattgctattttaattgttaccccctgctttccatgtccccggtactgcctttcccttcttgttaatccatttagatgcatgtttattcttctaccacgagtcctaagaataagttctggtcctctattctgttttctttctcatcttctactaaagacatgcatctgttctgtaattaatgttatcagctactatggaatttcctaatctctggggatctccagaaagtctgttgtttaaagcaaactttttcactcatttttaccctttctttttctttgggaatagaaatggtcttctttttcttcacagcacaagaacaggaagaatgtgtggtctatgtgtccaagaatgtcttcccatcatggtagagtggtcctgtctccaaggtgcaggactccctgccattggctttctttgcatcactatttgaaaattataattagaggaacacactgtgaggttctttgggactctaacccatttttatttgtatttttttgagacagagtctcactccgtcacccaggctggagtgcagaggcacagtctcagctcactgcagcctccacctcctgggttcaagagattctcctgtctcagcctcccaagtatctgggattacaggtgcatgccaccacacctggctaattgtttgtatttttagtagagatggggtttcaccatgtcagccaggctggtctcgaattcctgacctcaggtgatttgcccaccttggcctcccaaagtgctgggattacaggcgtgagccaccatgccttgcccccacttttcttaaaaaaattttaaactgctggtttagaggaggaatggtgttggagtagaagtaagaacatggattttgaggtcagagtgacgtgagattaaatccctgccctaatgtttacttactgtgcaattttgcacaatctcttaacctcagttccctgtctgtaatatgtgaataataataatacttgctataaaggagtgttgttaattttaaatgagataacttatatagtatttaggacagagctggcacatcataagctcttagtgccatgttaaatattaataatgatattaataatgttggagcatagaaagtcctgttccccacagaggcaacctactgatggaattcaggaaaaatatagccagaaagataatttgctttgtgaactggtcgaatgaaaacaggagacgtggttatgcaaattccagaaataatagccaacatttatttcagcttgccagagcatattctctgccccactggttttcggattttactgtgaataaaaatccctgggtagctcgttatgaatgcagagacccaggttctatccttagagattttagtttatttgcccttgggttcatgattctgctttctagggagtaccccaggtgtcttcattaactatatattaaaaactgctgtactgggctttgattcaggctgaccctattgcttgataaagcttacttttcttatacagtttcccaccactctctgagccacagttcagaggtaactgtggcttctactgcgttataaattatccatagagacaggttagtcagactgccttggcctatagaatactctaaaatacaatagtgctcagtagctatagcccgagttcctacaaggcattaggttctttctagtttatagctcattggtgaaatggagtttgacgtcattggaacagataatctttgtactactatctttgcaacttttctataaatcaagttattcaaaataagattattaaaaaaaaattagctcgtaagttcgtattttctcaagtgccttttcaagcacggtattacaaataatagtaataattatcagtataaattaagaggaaggctgtactttctcgggcaaattcttacaatgaatgcaaatgaattggtgttactgcagaggaaacctcacttcctaaggtgcactctctgccctttccatccctgaagctaaggaggaataggagaaaggagagccagggcacagctgtagggagcacatccagatagcacttagtaaggggcttaagtgtctgggtaggaggtgcagggagagaatcaaggggaagcatggtcaaggtcagtgtttggaaaatctggctgaccgtcggaatcctttaggactttttctgattcaaaaggtctgggaagaggcacagagatctgcgggttcttttttttttttttttttgtttttgtttttttgagatggagtgttgctctgtcacccaggctacagtgtagtggtgtgatctctgttcactgcaacctccacctcccaggttcaagcgatcctcctgcctcagcctcccaagtagctaggactacaggcgcacatcaccactaatttttgtatttttagtagagacggggtttcaccatattggtcaggctggtctcgaactcctggcctcaggcgatccacccgccttggccccccgaagtgctgggattacaggcatgagccaccatgctcggcccgagatgtgcgtgttttaaagggtcagtagtgattatgatgagcaatccagtttggaaaacacagatatcagcaatgaagcagaagttaggagaaaatcacaagaaataaatcaggtaatcgaaccccaagagaactgagttatagggcaactgagtagtcagagagctctttctagtggggtacagagggtaagagctagtgtctagttacagaaactcaaacaggagagctgggactacatcagaggcagaaactatgactggagatgggaagtgattttagtgttctaggttagtgctggtgacataggatataggagtgtatcaggtagtttgtgtacaaacacccactgggtaaatagttgtgaagggatttggcttcttttcagagactttttggttttctggattttttttgaaagtttttctggattattttattttattattattatactttaagttttagggtacatgtgcacagtgtgcaggttagttagatatgtatacacgtgccatgctggtgtgctgcacccattaactcgtcatttagcattaggtatatctcctaaagctatccctcccccttcccccgaccccacaacagtccctagagtgtgatgttcccctgattcttccgggactaacacttgtgtcaaagccttggctctgaaagctcatgactgccaggggctctgggttgtagaaagagagtgtggcaggatatggcttgtgcagtcatcaatacgtacaaaggatattgggtacaattaattttaataaaatatttagggcatatttatgtattaaatacataaaaatataatagacacatacatacttaactaataagctaaatgctaaaatatcacaaataaaatggttatcctctctatacccatgtcagaatccatcttcctctttgcaacctaaaataaccattattctaaatttagcttttaccattttaaggaccatctctctatcatttgttgatacatctcaactttcatgtaattgttgtcatgctttatgaatccttctttcttatttcagcatgtgttcttgagacatatgcatgttgctacatgtagatctagccctttagttttgttgtgttagattagaaacactagaatttatgcatgtgttattaaacactgtgctacatttaacattctcacacctatctccttgtacccttgtactactgttttgccagtatggagagtgtcgagccaaaaggtatgttcatcttctggatgttgccaaattggtctgcaactggtggtaccaatttacactcgtaccaacagtgcatgagatttcttaatgctccacattttgtcaacacttggtggtgtttgcctaattgatgttgtttgaagggttattactgattcttttgtactaatcaaatatttaatgggtattctttgattgttttttaaatgaatttgtatatatttaatacataatgtttatatatatatatactgaaatgattactacagtcaagcaaactaacatatccacaacatatccataaccttccatagttacccatttttatgtgtatatgtgtggtgagagcacctaaaatctattaacaaattttcagtatgcaatacagtattattaactatagttttcatgctgtacattagatctctagacttattcatcctacatactctagacttactcattctatgtaactgcaaatttgtacccttaaatctatatcctctcattttcctcccctcccctaccctagtaattgctgttctagtctctgtttccatgtattcaactttttctttagactccacatataagtgaaatcatgcagtatttttatctgggtctagcttttttcccttagcatgtcgtcttccagattcattcataaatgtcaggatcttcttttttaatgctggataatgttcctttgtatacatatgtatgtggacactttggttgtttccatattttgcctaatatgaatagtcctccaatgaacatgacagcacagatatatttttgaggttcttattgcatgtcttttggggatatgtccagcagagagattgctgggtcatatggataatttgcatttttctcaattactaccgagtttgtggtcacttaggtttcttcttccaagaatgttttatcaatacttacatcttttttttcttctttgaatttttgatttttttaaatgttgatttcaaagagtctatatattttgaacactaattcttgctatttaattgcattgaaaataagttccatgaaactgtggtgcatctttttgaaggccaccttcttgaacataagaaagtcaagtaagggaacaaagaaatgtacatcaactttttataaagtagaaggatgaggaaatgggagatgctggccagttgctaaggccggagggaaaagaacaggatctagaagttgatggagtttgaggtagtggctctgcacggtgcccactgaggccaagcccttggaaggacttagatgctttctttggtctcttgcttgtgagcttgagcagacctattaccacagaacaaaatatgaataaagtaaagaatacatagcctggttgttattttatttagcagattcctagtaaacacatactatatgccaggctgtgtaccaagttgctagtattatacacatgaagatgacacagaacttgaccttcaagagatttcaggattgttaaaagactcatctctaatgaagtcactgcaagaaaatgtggtaagagttttaatagcactaagtacgggacaatattggagccattgatttcttcatttgtaaaatacttatagaacatctactatggggtctagggatatagcagtgaacaagagaagcaagacctcctggagcatatattttaaagatgcgagacggtcataggcaattagtaaataaacatacaaaatcacggccataaattagtgatcattaaatatgtttataagtaacataattcagacagtgacaaatgttgtgctgaacagttttataaggataatgtcatgaaaagtgttgaggaatggatctgcatccagcatggtcgaaggcctctctaaggtacaaacatttgagtgagctatatgtgatgagaaagaatcagacgtacaaaattcagaagaatatcacagaccaaaaaaaagcaagtgcaaagtgcaaggctccaaggcaggcataagattggggttcacagataagcacaaatcatagaaaaagaagtaatgggatctgctggcaggcagtagggtttcaggttaaaggcaagctttgcagagtagatcacactgcaaaatctggaaggatggagaataagctaaagaaccttctagctagaggaaataacatgtgcaaggtcaaagcttttgcatctaaatccattactgtgtctaattacagagtcagaaataaggtcctacaagccactgcctgcaatgtttcatgatgtctgggctcagcccaattgcctgtacacttgtgctcctaatctggagtcccaacacttccataggctccattgttaggcaaggaatatcacatcatgcaacaatgaaatatgttttcccccagggaagtagcataatgcagactcggattatcaattggagttaagagggtgagatagagatcatctgagacaagtttcagccaaattcccatcaccgcagcttgtactttggctttggtagttgctgccaggttgtttaaatttttctttgctggaaatttcatgtgagtttatagatgatcccattgagggggacaaacagctgaatacaaatggacttgattccaccctcttggaaagctaagggggaggtgagtaatgagcctttaaattatacctcctggccaatgatccaggtctaagtaaaactgcaatccagccccggccaacctggattgccacagtgcccatttcagtggctctcaatcctcactcactccagagagtggtttgaaacacgtgtaagttttagcagtctttgtgatacttagagaccccctatgtttttgaaagagtaggggaatgttcacttgaccaagtgagtgcttctgatgatagggagcataagatatctcacccttgcctggggctagccctggtaagtcttatcaaatttatctgtatgactctcaatttggcttagatggctccaatcatttgaattgtttctggtgatgaaaatagtcaccaggagactaggaaactccaccgtcagtaacatatacactgtcatccttgatttccactacttttgctttctcttatctgatttcttaaaactcagcagtattataagggtgtttttgttgttatttgtaacatgatgatgcattctcattacttatttctcatcccaggatctgaaaaactttctgaagaaggtacacagagctgcattttgcacttggcaaccattttctaatcacaaagcccacagaaagaaacttcaggtgaggaaagtactgtgtttctccagaaaaaagacattctagatgttatttcatcaaggcatttgggtaacattatcaacctgaggaaaggaacttgtgtggcatattaacttcaccagctgaatagaaaggaagccatgggtatatttttgtccttcaaacacacacacacacacacacacacgcatgcacgcacgcacacacacacacacagtcctgtatctttttttaaaaaaactttctctccccactctcacacacctctatcttaataggtgtttgagcttcctcagagcttggtgggcatcactataggacctgcaagctagtgccctgtggcaaacttgctatttgaacctcttttctagaatactgagatatagatgatgaccatttggtctcttagtttagggttcctatggttttttaatgtattttatgggaaatgatttccattggaatactaatagggtagcagcatgaaacatgtaatggaatctaggaatttagcaacttactctcaggactgctccctcttcatcttgtgtgcctaaaagtccctcctgtcatagacattcactatactttcaatttaattcaacaagcatttagaaaatgtataacagttctatgtggtagcagctcctggaacacaccgtatggcttctgtaaccaccaagaagcagttgcatgaaagaagttgtaatcagtcccaaacactaaaacaagaataataataagttgtaaaatctacagacaaaataaccaaaataatccatgtagcagatgacaggaaggggaaagatcaatctttgtcagaattttcagaactgtcagatgatcaacaagtaagagatagcattggaagatagatgatatttggaaagatatgaaaatccagtctttagactgagatcacatccttaatctggaaaacacacgaacgtaaaatgatttgccacagtggatgaatcctcccagttagttaccattagattggatgacctggtcactttagtaagctacttaggtctgaagataagtttcccaataaggcttaggctaaactttctgagtagtatataccaaatgtagatagtattatatatgaatctcagtacttccatttattatttgtatgactttgaataagtattgaaactccatgagttttcacttttgcctgttacggatgcactgtagtttgcatgatcatttcagaattaaaacaagtaattcacctcacccatagcaggtgctcggtaaatgcccacctgtatccttaggcaggaaagctggccacaatggcctcagtctttttcaagctcagtactccttagggaagtaaagtcagctggaactcagacacagaaatgttgcctaccttcacattgcttttctacaagctaatgtcattgaaactctcttggatacctcagtttcttgggtatctaaatctttaatccaaacagcagtcattgaatcttttcctctgatctttgcaatagtatcagctgaattctgaactcatctttccttgttttttatatatatatatatatatatattttgagacagagtcttgctctgtcatccagactggagtgcagtggtgtaatcttggctcaccacaacccccgcttcccaggttcaagcaattctcatgccttagcctctggagtagctgggattaaaggtgtgtgccaccacacctggctaattttttattgttagtagagacagggttttgccatgttggccaggctggtcttgaactcctggcctcaagtgatctgcccacttcggcctcctaatgctctgggattacaggcatgagccactgcaccggcctgttttatgtagtttctaacacaattccttgcctcaacatatatttgattttataagtttaacattgtatgattctatatctaactccagtgcccacacttattctgaagtaggcctgtcctaactttcaataccatatactatgtacagctgtcccttaagcattagaacagagtactttacttttgctctgcatcagaattccatggggtgtttgttcagtgcctttcttctctagtccccttcttcctttcatgttctaatttgattaatctgggtagattctagaataatttgtttattagcaaggagtactctagtaattctgatataacctgttcattgtctagtatttggaaagtgtcattccaaatactagacagcaaagatgtcaagcaaggaatgaacatggtctgtttagcatggaagttattgagagtggcctgtaagatttttattgggagtttcatatgagttatgtgaataacttgggttcatattatgaagaaatttgttggagagaataaagtggttaaatagactttgaaatcattacccatccacccagacctagttctacctggcctgcacctttaaaataattcttttaaaatttaacaatattagcggggtgtggtggctcattcctgtaattccagcactttgggaggccgagatgggaggattgcttgatcccaggagctcaggaccagcctggacaacatggcaaaaccccatctctatttttttaaaaatataagagaaaagagaaaacaattaacaatatccagaaattatgacaaaaggttagagaagtcaaagctatatctccatgattcccagtaatattatcaacaaaaatatagatatttgtctcttccattgtcaagtcagtcccattctatacatattttagaactacacaggtatttgcacttttgtgcctcttgataacttaaaaaaattagaccatagttaaaaaaaatagtaaccgtagttaatatttttaaatttaacgccatcctcaaggtacagaaaggagcctatagaatttcccattctttttaaaaatggtaacaaaaattttcatgataaaacatttattatgggagttagaaaagcaccatagactatcattcatccatctgcctccttcctcccaatacacatactttagatatgagaaatctgatgctcaaagaatggattaacttgaccaaaagaatatttagggaagactggcataactctagacatatgaaccagtgaaatagaattgataatccagatataaacccatacatctatggtcaattgattttggacaagagttccaagatcattcagtagggaaagaatagtcttcaacaaatggttcaagacaacttgcaaaagaatgaatttggaccttacctcacaccatttacaaaaattaagacaaaatgaatcatagacctaagagtgaaaactatatatctcttagaagaaaacataggcaaaaatcttcatgacattatatttcacaatttgtttttaaaatatgatagcagaagcacaagtgacaaaagaaaacagataacttggactttatcaaaattaaaaacttttgtttatcaaaggaaactatcaagaaagtaaaaagacaactcacaaaatggaagaaaatatttgcaaatcatacgtctgataacggtctagtatccagaatatacattcaacaacaaaaagacaaacaacccaattaaaaattacgaaagtcttgagtagactttttccaaagaagatgcacacatggtcaacaagtatatgaaaagatgttcaccatcactggtcattagagaaatgcaaattaaaacaacaatgagataccactgaatgcacattaagatgaccataataaaaaatatggaaagtaaccagcgttggtgaggctacagagaaactggaaacttaatacattgctggtgcaaatgaaaatggtgtatccactttggaaagaagtttggcagttcctcaaacagttaaacataaaattaccacatgacacagcaattccactcctagaaatatacccaaggaatggaaaacatatgttcaaacaaaacttgtacagaaatattcataacagtactatttgcaatagccaagcagtgaaaacaactgaaatgtctatcaactgatgaatggataaataaaaagtggtgtgtctatacaacagaatattattcagtcacataaaggaatgaagtactgatataggctacaacatgggtgaacctcaaaaccattatgctaagtgaaagaagccaatcacagaaggccacagagaagataattctatttttatggaatggccaaaataggcaaatccacagagacagaaagcagattagtgattgccaggggctagctgaaagaggcaatggggagtgattgcttaacgggtactgggtttctccttagagtaatgatgttctagaattagatagtggcggataattgcaaagcattgtgagcgcagtaaaagctactgaattgtacacagtactttacaatgattaaagtggagaactttataatatgtgaattttactttgatgaaacaaaaaaaaaacatgcagggtctcatgtttactgcttctatatcagtgtacttttccccaatccatgttcagtgatattctgaaactggacagcccttagatatatacctcatgactatccatatggcaaaagtaatttgcttatttcttaggtagctggatgaaagtaacattagtctttcagtgctaagcacagtgctgtatacaagcaatggaactgctagttttatattttttctagttatgttgagaaagtcccaaagtggacacaatggactgtgtcatcacatcacagaaagttcctaattagaaggccacccggggggaccagcacctgtcaaaagcaagaaaattgccaaagggggaaaataagagacccagcaccctgggggataatcaattaaacagcttcaggctcagggccatctgctaaagatcagctgaaaaaagtggctatcaaaatttgaaacttagtctccatggctctgagggctacaaggcccagccctggcactttagctgcaattggaatcttcagctttaattgccagatcgtcaatttccattgactatctgctcttgcttggatcccctgcattgtgaaagggagacatggggatagacaaatcattgcctggacggaggctgattggtggagccctgttgtgatatctgacagccgatcttttataaagccttctgggaatgaagaggaggactggaattttgtggaacactcagaaatgctcgtccttgaaataatgtcattgggagcattccctgagggtcccattacctgggatggggagcatgactctgcaattgcttgtttgagacttagatccaatgtgatgttcaggagttcaactctcctatctaagtgacactgcccttcctcatccagcccctcagcacaggcatttgactagtaaaccttgctttctgcttgattttttttttttttgagacggaatttcactcttgtcacccaggctggagtgcaatggcgcgatctcagttcatttcaacctccacctcctgggttcaagcaattctcctgccccagcctcccgagtagctgggaatacaggtgctcgccacaacacccagctaattttttgtatttttagtagagatggagtttcaccatgttggccaggctggtcttaaactcctgacctcaggtgatccacccaccccagccccgcaaagtgctgggattacaggcgtgagccatcctgcctggccggtttctgcttgatcttacagcccagaaggcacacaataagaaagcaccagattgccttcctggagacatggcacctcagtttcactgtgttaggaacccaacacgtgtacatgaggcactcaagactatgcagcagtcttcttacatgtgtcaaccaactaaaagttttaccaactctatgaggcacacattggtacaattatcaccaagttaaaatgcataaacttgggcccagatgaatgaatgcttttctcaaggtcacataaaaaattaactgttggtgtcagcattctcttctcattctttctcatgcaaagaccacatttgttccacctcacactgggaaaagtgaagagatgagttggatgactagacatttgttctgtcagaaaagtaagcattattgggctttgaacataatacactctgtcctttcatttctgtcacaaaggattgtccctaagcctcaaaggacacaagtaaactctctgaaacctgaagtagttggtctcaatctattctttggcatcaagcaagtgcaagggtcaaagataaaaactgtattgcttgcttcttggatgccacagtccgaaatacctctaaccaaatgtaagtcacacccaggacatgacaagaatctttaatagtggcccaagatttagctatggctttggagttctacagtcattcttgctcataccagttagaagctcatgcactctgaaatggctttgtttggttttggagcaatagtcagcaaactatggcacaggatgaaatccagtcctccacttgcttttgtaaataaaacattattagaacatagctacacccatctatttacatatcatctgtagctgcttttgctctacaaggcagagttgactatttgcatcagagactgtttagtccacaaagcgatactgtctggctctttatatgaaaatgttttcaagccctgttttatgaattaggaagaaagggctttctaagtctttctcactacaaagtttatttctcagaatcaaccagaatgaactgtccagggctgaggtagctgtgctgactccaagaggtggtgcagttgtacagaacatggactctgaacattagacaaacctgagttcaaattttaacaactatctggctgtgcactcagaaaagtcacttaactactctgagtttcctcgtctgtgaagtgcccattagaattctgaccttgcaggacctctgaagattaaattgcatgggatatttgtagcaccttgcccagtgtcaggcacatagtagtattcactccgtgatattttatatataattctcaaaggactgcatgcccacataatgaagacctcagttaaactgacattttgtgggtatgcacgctggagctcactatccctgggctgttccagcatgacagattcctctttacatcccagtgataagtgacccacaggaggctgtgtcttcatgctctaagaatagaatggaaaaccacgctcatttcaaaaaaggagcagaaccccctcttatttccctttcctggtttctcttcctcatgccagaacttgttatcctgcaggcatttcaacctgctcactctgagaaataaaaaatgcaccaggcaattgctaattgctgatagctctctccctattgatctctccatttggctcaaacatctcagattactgagtgatcacagttgagataggtcaggacaaagaggccctgcttaaatatttctatggaagaatgacagagtgtctgcaggaaaaaaaggtagaaatgcatttcaagaggcaaggaccttcaagttaagagttttgtaacatatttaaagcatggggcaggggtggtggggaggtgatccatcagcaaaatggaaagggaaggacttggaagaacctgcaaagggaaggaagcccttggaggtggaggccttagaataagatcagaagtttgatatgaggtaaaattacttcttttcttggatatgacctttttgtcaaatggtattctgctaatgtatttgtcagggttttagtttaagcagaaagaaatttattaagggcaattagttacagaatgtcttggaggttcatgcagctaaagcttgggtcctgcccagctgtaagcaatgcagccaggagaaatggccgaccacttggtacagatgttgcaattgaaatcctgaggctgtcactgcagtcccttggtatccattagactgcagaccatagaacagaaattcagtttcaatatctacaggaaaacagaacaaaacaacaaaaacaaccgattccaccacatttatctttgccttcaaaatctcgagtgacagagttggcttggtaacagtcagattacctgtggaactctgactactaaggagtctgggaaatttagactttaactctccagcattaagtgagctgggacacacactacaagggtgttgggatagggttgggtgaatcaatctataatgtctgcatcttaaggattatgtaaacaaattacatgggattattaaaagaatctctttatgttaagagtaccctcaatccctggacattcttagaaatttgaattgagaagactctgctttcctttgttactaagattggttagtaacctattgaatgagccactattctataatagcaatgaactagacactttacctggcataatttatttagttgttttttaacaactatgtttgataaatattatttatttcaactttcctcttggaaactgggaggaagacaaacttagtaacttgtcctgttaatactacatacatgctgggtagtacgtctggatatccaggaccggcaactagatctgctaggttgaggagcccagagtcccatatatttagagagcctgaagaaaccatagtcaggagacaaaatcttcagttgttcgtggtggagtttttgttgttgtcgtttgtccgtttttgattattattgttggaagtgaacctcctgaatgaggagactttgacttaaagatttggggaagaagctggtttgcttgggcagtcttcatttggcattctgaggaaaattaaaataataaatgtatttgcctgaggtgagtattctttttgggaatatccttcgttcaataccagggcatttgattagtgctcagtgtctgggtaggaatcagactccagattcaaagtcctatctagtaagacagttctctctggttccttttgtttgtatctgaatgcaattgtaattttattttattttattttactttattttattttattattattatactttaagttttagggtacatgtgcacaatgtgcaggttagttacatatgtatacatgtgccatgctggtgtgctgcaactgtaattttctagggccacttgttgtgggcagaaatcttcaggcagtttttttctctaacattaaataaatctatccttgatttcttgaaaaatgcatgagcacacagaaattgcccttgcaaggtgtgggcgaatagggtgggtgttaagagatgaatccagactaagcaagtgccaagaggtaacattctcttctttacatgggaataattaatgcacggctataccacatttatttcttaacactccttctcactcattttcagagtagctcatcttatttaaaaaatggcatctgatattgtgacggaattatgtaaaatctagaattcttgctctaaggattcccgcatctccagaaagttggagaaattgaataagtaatttgaatttcacttctatttttttgttgactttggacaaaaaaaagaaaacccccttacatcttcatttgactccacaagccattttgaaattgttagctgaaaagttctagggaattgcatataaaactaatcattaccttgtaatgaaatggttctgcaagttactgcttaataatacttgaagtcatcaaaaagttcaaagattaattaccatgtaactggcagtgtttagattggaaaattaaggctccagcgaagaactgaaaaatatccatataattacccaggtataaaatgcagcttaatacattctggaacccgggcttctcaaaatagcaagtcccttttgagagcgtcaagtggtttttcattatttttcattattctcatttttcatcttacagcagccaatatcatgcttgtttactaataagtaatggccactttccctttagcaaaaaacacctgcaccaccatgaaataattagaaccagatcatttgataggatattattttttttgtcgtagatcctggcaattaaccaacacatcatatttatacatattattttgggacatatttatgagctgtagtttgcaaaaccatgccacaaaactataaaatgtttgaagccatgtaaagagaattatgagttgactaatttatattaggatagttttgtatttgtgtttttgtatttgtgttttttctcctttccatatccttgcaaatagtacatcttagaagacaagtgagaaaaaaggcccagaatttcctttaaagagattctaggacagaaggaatccagaaatatggaacctaggaatccttcttccataagtctatttggtgttctacactttccctaatttatttccaagtacctttctcactttgcataactggtttacaaatttggcttagaaaactggcccttatgttttcaggagatttttaaaagtaagacataatttaaaaattaaatatggcaagcagtgctaagttcaagcatgagccatatgctagcaagcaaccaccacctggcaagttcattgcagaacagttttgggatgctgtatatcctgtttgaaaatatttgctttaatatttcctacctgaagaaaagaaggtcacttacaaaggtagaaatagagaataaagaaatggagactggcccaaaaaagagaactaagctatctgattgaagacaatgacttgttatcagaagcagcagttgctgagttaggttatagagaaggtgacattttaaggggtgagatgcatgaaatatcaactaaagattagtgttaggaaacttttttttaaagcaaatttctccaacaaaaggtcgttgagtttgaaataggtgtctcttcttagcacatctttgccttcagacaaaaaaactcgaacttacatgtataacacttttttatggcccatcctcaaaatgatccttacattcaccatcttacagcttcaaacgttgccttttcctgtagtagcaaccatcatggttcctttagttcttttaagtttttcttctgaattctatcagggagtaaaactctttcttggcaaatgttggggagaagcagaaaagagaatatgcatgttttttcttggcttataactgttgatgattacatctatctatctatctatctatctatctatctatctatctatctatattaaagccttcttaaaagcccctcagaaacttactcatcccattctcttctgtgcctgctacttactgtgttgcttcatgatgagagacttctagtttattaatattttacctgcccatggaccctggttctcactcatgttacatcacactttatttccgtttgtgggatattacctacttcaatgaagtctcataaaggaagatactacattcccaagaacgtctcttggcatatatctgtctgtatctgtgtgtatctctataacttatctatctagatctgtttaaccttcaacatagagataactatatctagattctttttaactttaacatggagatctctccatcatggtacagatttagatgctaccagtacattttacatgaagatttggtggagttattattaaaccagttggaatgccctgggagaaaagcaagtactagtaaatagaaaagatcattgctgtggttattacatgtgccctctggagagagctgcagaggaacctggagctctcagagacttaaagggaatgggagtcagaatctggtcagtttatgctaaagatgagaaatgatcaagccctgacaacaacttatggatgctattatacttgggaagaattaaactttatatcctttggagactaaacagctccctagatggtgggaataaatcttgaaaacatttttgatgatagttagggatttaaatttgccgagttctttttgtggctatacagggagactaagtttatgagtctcactgaatgattccatatacagaaacagtgggcagcattttatttttcaagtttgactcatcagctctcaactttgaattatatttttttagactttatattattattcccattttcaaatgagccagatgctttctaatgaggttttcattttttttttcagttttcagtaattgcattgtagtattcttgatggcagggaatatgtctacctgattcaccattgtaaccccagttcctatcacagagcctggcacttgcaagggactcaaatatttcttacctgattcatttccagtggacaaatgttcaagttccaccatgcacctgttcctcaaatcacaaagtagaaccatgttgcaatgctggagagcccaatgcggtaatataattctaccctctttatttttagtctagcatatacttaatatgtaatgtagtaaatatgttaacacgtaaaaacacatcgagattcagattctatatctaaggggaagctgggaatatgcatatcattgtttctgacctcacagtctagtaattgagggacacacaaacaaacatgaaatctcaatattgtgctataaatgcaattcatggagctactgaacataaaggtgaggtaaaggtgagctataagtatttgtggtcagacagacctgcatttaaactgaacctcagtcatccactaattactttacgttgcaattgtcccttaacctttctttgctccaatttctttatctacaaaaggaagataataagacactcagtatagaactgtcataagcttttcatgacgtaagataggtaagaagcaaatcactatgtgtgacccattatttggactgctattaaccattactccaaaaatcagagaaattttcctaaggaagtgagggttcttttgtatttaccttgttggaaacagcatccaaatgaggggccatagtatggtgaagaatttagatttgtttcataaggagcatcatgtatagcactgacatgttttggctctgtgtctccgctgaaatcttatcttgaattctaatcctcatgtgtcaagggagggaggtgattggatcatgggggttgtttctcccgtgctgttcttgtgataggagtgagttctcatgagatctgatggttttacaagcatctggcatttcccttgctcatgctcttctctctccttctgccatgtgaagaaagtccttgcttccccttcaccttctgccatgattgtaagtttccctgaggcctccccagccatgtggaagtgtgagtcaattaaacctcttccctttataaattacccagtcttagttatttctttatagcagtgtgaaaacagactagtacaaacactaatatgtatatcaattagtatttatcctgcctcgtttcagaaacggtaagagtcaactctggcatctcatgagtgatccatttaaattatatcaggttatttgcatctctccttgagttgtacctaatcttatggtgatttggaatctcctaaatggtgtggcaatattgctgttgcttcttggtaaggacaaaattcatcctaaaagtcttgaaggaaagagactgggaaagatatagtgcagtggtcctcaaccaggactgactgtggtgtgtaagagacatttgacaatgtctgggaacattttgggttgtcacaacttggggcaggggtggaggatgcttctggtatctgttgggtagagatcagagatgctgctgaagatcctacaattcacaggtcagcccctcgcaataaagaattacttggctcattgtatcagtagtggtgtagctaattaaccttggcatagggaaagacaatatggactagtgcttataacaagtctgttatccaatggtttggtgagtagatttcaggaaaagagacatgaaaaaaaccaacccctaagaaagccaagtacaggctagaagacaaagggatcatgggaagtgacagaaattccagccctttagtatttaacattaagagtaaatatgaaaggagtgggaagaagcaccataaatttcattggaattcatttaaacattcgtgaatctgagaaagggggaaggagacttccatctgttaagtgcatgttctctgacaagcttttgacatatctcaggttaattgtcattagaaaaggcttcaggtgagtagtattactgactgttgagaaatttgggttcttaaacatacagctggttaatgacagaatcagaactcaatacagaactttctgaagtgtttctaattcaccatattttctccttagctggttctctgtttcaagccaatggtggaggcagaaacacaacaaaaaaacccaaatcaaaaataataacaacaacaaatctggcctcaggaaaaatgcaaaatggaaggaagcgaagccaaatatgaatgctacgcatgtgtcttgattgcaatttaatgtgatcctaaactaagcaatgccagttctcttggctctggcccaagacacacctcaaaaacctgggtcatactgttttttcttgcacagaaatagctatatcactattcttggggaaggtataatgagggatgggaaaggctatatgaagcagtaggtggagtgtgaggccctgagtttttatgtctgcatagaaggaaagccacagaggattttaatgtctaaataccaaagtttctttggaagaattattttccaaactcactttccacaaagaaaagaagcatcggtggccagaaaccatggaatataaaccaagagctcaaagctaaggtaggaaaagtttagattagccaataagggagatgctgtttagacagagccatcggggagtgagcagggtcccgtgggaaaggctgaaggactcccagtgccaagtttctagtgcatattggataaaataattgcaaaggactcaagtggtcttttctggccccaggagataattggttagctgagcagagctgtctcacccatgggccaatgacaaattatatcaatccattattttttcaagaaggagaaaagagggttttttctttttttttttcctattgctcaaaataaattttgtctgtaaggagcatcagacaaatagaccctagaggccgaagttttttattaacacacatatagtgacttaactgagcaagagtggtgcaaaagtctcctctgtgaattgttccagcacgccacaagactttctgcaagagccttgttcctctgcccactctgcccgctgcccaacactgccacttggtgtgagatgagagttcctcagtactgccaaccactcagcatctagccctctctgctgagccttccaacaagggagctaataaaaatgtgtagggctctgtgctgtagacatgtgcacaataggaagagggttagaaacatatctcagagtgtacaagattacgaattgtttggaatgatttttagctattctgaagatgtgtggacttaacatagccccttggggttggtgggacatgctcgttgattttctcactgttctctgaaatgcttattttcatgatgtttcatgtgtaaaaagtatttttttccaaaataaaatgctaattttgccccaaatatacaggataggcattgacagtctttctacaaccaactacaacacactcaaccatttactacccagttgcaatccccaaaagtcaactcgtactatgaataagtcctaatcagtttgtgacagacccaatagaagcagggaaaaccaaaacagtctacaacactacagttagagctctgtaacagcacaaactccagaaaatactaatggggtctatgctgatttcaggggctctttccccagagactttttcctgccaagaattgatcagtgctcaaggcccagcatattcatactttggcctcactgtttggaggcttgctggggattggagactggaaggaaggaagggtgggaggcctccagaacacaaagacatattccagaaacttggagccagctcttcctccagggacaatacattgtcatgcatttgggattctatgattcagatgatgaggacatagacatactatagatcaatggggtcaagatggaaactggaatgatctccaccacttcagactgactctgccagatcaatcttaagcagattgagagggtgcaaaactctgattaagcagaggaaatatgacctgggagagaaaaattagggagaaattacttaaaaagtggctgagcagaactgaaactcccaaaagaagtatcaaacagttaatgccatatgaaatatgtgttctgggcctggaaatctcaggagatggacctcatattagtttcacattccatgatgatgtggtagttcaagacaaggacttcggaggaactggctgtgtccaaattctggttctaacactgactagttatgtgaacttaagcaagcttcttaacctctctatgccttcccttcctaatctgtaaaatgggagaaataatactatctcagagggttgttatgaaggtaaattgaattaatttatgtataaaagcactcataagagtgctgctacttataaagtaatataaaagttctcattattattttatattaattatatacataatgcatataatatataatgatgcttacttgtacactatataaatattataattaataactattttatcttttacatctattatattctattgtactgtgttatatacaatacgtgatataccacgtatcatacggtacatatatattattctttattggtgactacatctgcattgcagaactgaatctaatttatattttatatctacctttttttccttaaaacttgtaactgctttctagatttcctgaggaacattccaaataatctggctcaaaactagctctaacatatactaattgtggaactgtgacaaacctccctaagtccaagttagttgatcttgaacataggggtgggtaaagatctaaataagatagaacagagctgctcagccaatgtgccatgcattcgttacaagcaagccaaatagtgagcactttagccttgcaaatagacagccagggtctgggttaattggggctcttacctggtcatctctgaccataactgtccatttactgtgacctacaaatattatttttgtgggttcataataacctgttggagagaactgtaagagacatcacgttggaagcattgagcaccaaatgtggaacatagtaggagcaccaaaaatatttgcttttgtggttgctgatgacaacagtggtagcgcaaggaagacgagacagaaaagaactttttttttttgctgtcattgttctgtttcttagcaaaagtggaattggaacctgttttaatattactactttaagtagagaggccatgcagcctataggtatggtctgtgtaccttggaagtcctgggtgttgtggaaagtgtgttgaccttggagccatgaaaagtagggtgaccagctggcccagtttcctaagaatgaggtggtttctaggtaatgggagtttttgtacttggaagtgaatcctcactctgaatatatgacttggcctctctgaattatattttcctattgtcaaatagggaaaacaaatcctgacttgtagcacttttgttatcaaataaaaaattgtacctacagtatgtgagagataattgaagtaaaacaagtgttatagctgctatgttccacccattccaccctccagttagaggcatcagagtgtgaatataagcttcacacttggtagttgcataaacatgggcaagctgtggaacatttcagagcttctattttatcatctgtaaagtaagactcataataccaaccttgatgagttagaggaggattaaattaaaagagaaaattactccataggagcaattattagatgtgatttccctcctgtttctccctttattttttcttctaataaattttcaatccataaatcttatacagaatgacctttctgagaaataaagcttttaaactgtggttgacccctggtattctccatgcgtctcagttgagagaattttagaagtggtgcttctccatgctacccgtgcctttcctgtagagaagatggtgttctctatgttgcatttgcacaaacttcagaaaacagctttcagaaacacctgaggagctgaccaagatttcactagcatgtcattgagttgacatagcaaataagttcttgtatccacatctcattagttttccctcatctttcataatgtcccatagaaactgaatgagagatataaaaatggctataaacctcttccacatctgctaagatgaaaaactgatttttactcagttttataaattttctctcctctttatctttccttcctcccctttccttccttcctcccctttccttccttccttctttccttccttccctttctttcctccttccttttctttccttccttccctttctttcctccttccttttctttccttcctttttccttcctccttccttccttcttcccttttctttctttcctccctcccttctttccttccttctctcctttccattatttctttagttccttccattctcatctggatcatggtttctttaactgcttgcaattcttcttgacttcaattttagttgtctctctgctttccttatcattggcaattatggatggattttctctttttttctgaataatttattcaattacatactcaataactatttgttagcactcctgatagataatgtgtgagatactgatgaatggaaaaaggcataaccctatggtttctttcgtaaagtactattctttagcaaaacaatttttatgaatatctaaaaaaaggagaggcttgctatgtacattgtttcattcaatttccaacaatgtaaggattagaaaaatataacagacttgcctaaagtcaccggctagacagtgacagattcataattcaatccaagatctgtttcactgaggcacagtgattcattctaatttgaatgtgcagtgaaataatttctgtagctcttctcgtttttctacttttataactggttacttaaaagcttttactaccaaagtcttccccagacaaatatgaggttaggaaagtcttactttgatgactccttctaccctcaaaagcccctgtccttaaaagttaacatctcaaaaagccatttccactcctctcacatatatatatgctgagctattccataaccaggattctttttatcctatcaaactgtgtctggtatttgtcccattcctttatatctgtgtcctttgaaacacacgatttgctatactagccctgtatcctaacttgtgagcagccattagtgttagtactacttcattggctggaacattctggtggcattgccttaattcaggaaggtagtggttgagaaatgcaggcagtccttggaattaagggaagaatgtgtcaagttggggaacttccaatcatattgggtcattttctagagatatgtagctctatttgacttaaatgaacaacatttaagaacccattcatctatattattttggtagatcacacgttttcaatgtaaggttgaaattcaggccatccaggaaagattgaaaaatttctgaggagataagcagctctggacctggctttgggctttcttgatgtgagttttatatgtcgtttggccaataaaagctctgctggatcattagctttttaataggataaataattacctctaacacaaaatatttggaatggaaacatttggttccagatttttaaaaaaatctcattaaaacatcacattaattcagccctgggttcactacaacttaaagtgagagatttggcagccttggtcagtatgcctcaaataagttcaaacttgggaaggttttgtaaaaacaaacagcaacaataaaaaccacatcagtcttcctttcctcgggactaagtagattcttagttctgctgcaatgtgagagagagggaaagacaagaacacagtccctggaatataaccttcttgggggtttggctcaaagctattccttttgagtgagtagaggttttctgatctgtcatttagctacaacgtgaccaaatattttcttgcctgtctgcaacacccagtctatagggagaatgaccctttcaccttctaggtccaaagacatgaaattgcccatcactctctcttcctctgctccttggcatgcagttttcttcttgccatttttctctaaaccctattaatcagcacctctgaaaggccccattactgagaatatttaaagtatgacaggataatacactaggaaatatactgtggggaatattatagtcctggcaggactaaatgacctaaagttgtctcagtctccagtgtttctttgattaattaaccccatttctcagaattcttgagttcagagttctctctgtactgaagcttgtgtgtggccagtgcagaggaaaattttttttccatctctggtgtgctttctttgccttaggtttgtccttactcttaaatttcagcttttgtctctaaaacatccataagctcaacaaggatgactgcatttctggtattgactagacacagttcgtggtactggtgagaacaaaatggagcaagattcaggccacacctcaagcagctctaagctctggaggggaaattgttcactaggaggccttatggacacacagaggaggaagtgcttcactttgccaacagtcccagaggaagcaacacatgagcaaagtctcaagagattggttattgtttgcgaagcagatggatcaaggaaggttattagagaaagagagaagatgatgtacaaatatgtggatcattcttgccccatttattggagctaaaggtattcagtgtatctagagtgtgagagtcaagtgaagtggtagaaaagaatgaacatcaagaccagctaaataaagaaatgtcatttacaataggccaaggaactcagtcttcttcctattggtagtggtgaaccatcagaaatgttttagcagagctgagtttttgaaatatcactctggtaaaataaaaggatagaactcggaggaggatgaaagatgggagaacagtcagaaggctactggaaaagttcagatatgagataactggagtagtaagatctgggtctatggatgtgaccgtggttctttttggagatacagctctcttccctggccttataacttgctcttttaattaaaagtaaaaacaattctctaagatggacaaatatattcccaatgttccaacaggctttcttttctcttcctggccctgtgtaaagagctctcccaactcccctctgttttatttcattgcagttgaatatttaagactgtgatacttctatcaatcagcaatcatggaataatcttagtttcctaggattttagagggctcagtcccaaacagtttggaactcaaacagtcccaagatgtttgaaataccactgtaaatacaaaaagaaagttacagtttgatataagatgtgacaagtgttatgagtgagtcttcttaaactgacacagtaacacctgtcaataaatttggaaggagttataaaaaaacacacaagtcaacttttgggtttagaacccacttcatatctaccaggtacattaattcattttaactggctacagccattttcaaagtgcattctaaggctcagtttcttcaactctgaaaagcatagaaaaatgcctatctcactcacttttcagatcaatcaacatataagaacgcactttgtaaactttaaaatactgtcagattaaatggtttgggttgtaatgtgtaagagtaagtaactgattagtgacagagccaagacaaaaggtctcctgatacccatcctagcctagtatgacaatgtgtgcgcttactttttatttttcatattttcctgtatacactttacttagtttcaaaaagaattaagcctgaataccttcttttcctgtagcaaactaagtcatgtgtatgggtgtgtataaaacattatactgtctccctaattctgacaccccaatatggtgtttagaatgattcagtcaagctatggactacaatttactttagaagaatttacaaagaatacaaaaggggttgaacaacttgcttccttaaaatgactaatagaattctcaactttgctttggtattaaattcacctatggagttcttaaattaaaatgaaacaaaacagaaaaacagttttgatgctcgagctccaccacaagcctcttgaatcaggatatcctgtatttcccttaatgattgaaccccaagacatgaaattagctaaatggacagtggtgatcctggtacgtgcttaagtggatagttggcccccacaacctctgacatgtaagttcatagagcacagtagatctgcaatgcacacagatccccctgccttgcctcccaccgcacagccatgcctccatgcactgctggaaatgcacagcatgcagacccatttggactcacaatcaccacccatgttatattgcactatgctagataaaaacatgaatgaacacaattgctgcttacaaggcattctaaaggtatgcgtggcaggtaaagaagtaaacctaatgtgagtataatatttgcagttatatatatatgccaaagtccatgttaaaggagagatttttttttttcactggaagggagcaggaaagaaaaggctttacaggtgaggaaatttctgggcagaatttaaagaatgagtgagaattgtccaagaggaagaaagtgggtcaagccagtggaaatggagagcaggtagctgttgggagatgaaagaaggaaggaagatattctgggaagatgagggagtgcgtacaaggagtcatgaaacagcctcgaacacatgggaccttcaggctgatgggagtaatgatgggtcacacctttgagggttgggggggcctcaggggatgtggagggagaggttagtaggggtcagtccaaagggccttgagtgcaatgctatggagctccgctgtgctattcccagtacacagcatgtctctccattctcgttttcccaatgatttttcaaaaatacacatctaatctcaagtaaagaaatattcttaataacatttctgagccagaagggaccttctgacaaaaagtgcctctatcacattctcttctgccttccttttataagaagagtcatatatgatttctggagcattcttttcctgtcttccaaagcagaaaactctgtcctttctttgctgtcttccaaagaggatagcactgaaagctgtcatcctaaggccctttggcccttcatctctctcaggccaacagacagatcctctggagtcctcacctggctctcatttctcgtgggtggcagcattattgttctaagacctgttaacattgaaacaagctcagagtcagttatagaacagggaataacaatccagagagagggtttgtaacaaacagtcagaggattcagggctattcaaactacatagcattcaagaatgagctccagttttggagataactaataatcttactagagatatgaacatcatcagtgcaaatcccatgaactttgcacctgctgtaagagctagggagaaacattacttctttttccacatagaattgaccctgaaccctgactagaagtgagtagataccaggtttaggactgtgaaactgagtctagatccctgtctcatctgccaactgctctggtctgccttggctcatggcctgggaagccggatgctttagaccggggttcccaacccctacgctgtggactggtaccagtctggtccatggcctattaggaagcaggccccagagcaggagatgagctgcaagtgagcgagcattaccgcctgagctctgcctcttgtcaaatcagcggcagcactggagtcttgtaggagcacgagacctgttgtgaattgtgcatatgaaggatctaggttgagcactccttatgataatctaactaatgcctgatgatctgaggtggaacaatttcatcccaaagccattccctccactctaccatctgtggaaacatcatcttccatgaaaccagtccctggtgccaaaaaggttggggactgctctttagatggatgggtaggaattcggtggccaggcagagactgaacctacataggatggtcacaatgaacctcgactattaatgtgttacagatttacataaaagcttgcccacagaagcatctaggtcacagaaacacattctctggatctcaaaagggatagtctccatattccatcaggtagagaggagtggaagagaataaagtgttacttagagtaagagttgggactctgaagtctgcattatctggttcaaatgattctattatcatggttaatgctctggagctgccatatcaggccaacatccagggaaaggtctaggtttattttagtcctcgaggtagcccaacactcaccaaagaaaacagtcaatttttgatttcttaaacaagttaattctttgggacttttattgcctttgcctcattttcctcctctgtaaagtagaggttaaaaatacctactatgttcttgtggaaattgcctgacgaaatgcattaaagtttctaacagagttcctgccttcttagtagaaatgtacgaataaatgttggtttacttctctcctttagtttcttgtgtccctgtgtaatttacatggagtagtcagataactgttttgtttttttttaatatggcagttgaccaccaatgtaaatctgaggaaagaattatgggaaagcataatataatattttgtgtacctgtaaataagtgacatttatttgtgaggtaattgactgaggaactggcttatgctttaatctctccacagtaatgacttaagtactttgtgctcagcagaggttccaaaaatttttatgtattagatgatttaggagatattttgaacttttactcatttaattttaaaattgggggatatttaatgtaaataggttgccagaattagatgagttgggtcacatcagtgcacagaaatttatagggtccaccaccaatttctagtgtggtgttggtgttctgctctgcaaaacattctaagacattcccacttactgcaaggagtgggggtaaaaacgtgtgtaagagagattaaagagaccaatcatttttggcaaaatgttcatatttagaaagttatgaaaacttaagaagttggtcaggatcaccacattgatgaaaactgcacattatcaggagttattgaagtagcacactgcatttttaagattaattggagcaaagaggaaagacaagcacccaggagataagtagtacggttctgggtttggtggattcagtttgtggactgggaggagatgaggggtctccaatctttctgatatatttagagagaagcaaaatcccaaccccagctctaagtaacactctatccccgtcctctcctcttctacctcccagaatatggagactatgaatcaccttcaaagtgtttgaaggtgattccagaattttgaaacaaacaaacaaaataaacagaacatttatagcaaaggagattttcataaaggatgctttggggaaggaaacggtggggaagcataaagtaagttcgttgttcatgctttagacctgttgagtctgaggtggtagtaagtgtaacaagcatatatttcaagtcctggtgagtaatttgtgttttcagccagaaatatgggataaggacacagtaagaagataaggcaggaagatggataagacgtgtcagttaaaaccgtaaaaagaatgatgtcttccagaggaattaaagagaggacacattataaaagcctgagaacttgggaacacccacctttaggacagaggacaaaatgtatagtagcaaatagaatggcgaggtcttattcacaaaggtaaaaggaccaagagagccttctgtcatatcagagaagtcaagataaagagaaagtgaagaaggcaggtggccagctgtgatacaccgcagaatagtgaggaggcctggaggccaagaaaagacacatttgcacccggctatttcctttcagtgccaagattctttaatgccattgtgactttcaaaaaggcagttcagttgacaggtgacatcgacaccaaagaaatatcaggaggataggttaaaaggaaatagaagcatagttgtagaacattcatctggaagtttcgctgttaagagaaggtgacaggtaaaaatagtgagtagggtcatttaaaaatcatttcaggatgagaaaaaataccttatttgaaagcaattcagttgaggggaaaaatctggagagattaaaatagaaagatgtagtaaaaaaaacacaaaaacaaaaatccctcaggaggcagagagaagacttggcacaactgggaaactggccccctctctgaggtcagtgaccagaagaggtaagtgggtgtaaatgacaatcatgtcatcttatctttgaaaatactccctagcttacaagactataaatgcagttttttatctaaatattttttttccttaggtcattaaaccttcacagtcactgtgtaagaaaggcattattacattaatcttacattgtataattgaggtctcagagcaggttaggaaataattcaagattccataaacagggagtagctgagttaggacaagatcccagacctcttaagcctaaaacaaggcatggcgctttgggaagctgaggtgggtagatcacctgaggtcaggagttcgagaccagcatgaccaacatgatgaaactccatctctactataaaatacaaaaaaaattagccaggcgtggtggtcaggtggctgtaatcccagctactcaggaggctgaggcagcagaattgcttgatctcagaaggcggaggttgcagtgacccaagatagtgcgattgtactctagcctgggatacaagaacaaaactccatctggaaaaaaaaaaaaaaaaaccaccaaacttaaggcatgggccaagccttctaaatgctcatcacatttgtctacaccaatgttagaatatgaccaaagaagatgacagcgatgttgtgggttgtggcctcaagctattaaataaggcaagtgtgtgtgtgtctctgagagatacacacacacacacacacacacacacacagaggagagagagagagaaagagacaggcatacacacacacacacacacacacagacacacagaggagagagagaaagagacagacacacacacacacacacagaggagagagagagagaaaaagagacaggcatacacacacacacacacacacagacacacacacacacacacagaaagagacaggagagagagtgctgggagagggtatgggttgaattgtggtcctccaaaagatacattgaagccctgattcccactctcaatgaatgtgtgtttatttgcaaacagggtctttgcagacgtaattaagatgttactcaagatcttagttaagatgaggtcatactggaataaaagtaggcccttgatctaatataactgacatccttagaagagaagagacagagacaaacacatagaaagaagacagtcatgtgacgatggaggcagagattagagtgatggatctgtaagcaaagcaatgctaaggattgccagtaaacatcaaagaggcaaggaaggattctatcctacagtttctagaaggagcatggccctgctaccacctcaagctattaaataaggcaagtttgtgtgtgcgtgtgcgtgtatgtgacacacacacacacacatgcgcgtgagagagagtgttgggagatggtatgggttgccttctggcctccagagctataagataacacatttaacacatttctgttgttttaagccacctaatttgtgatatttgttacggcagctctagagcagaactgttctgtggcctgttaggaaccaggccacacaacaggaggtgagcagtgggccagtgagcatgaccagctgaactccacctcctgtcagataagcggcagcattagattctcataggagtgcaaaccctattgtgaactgcacatgcaaggaatccaggttgcatgctcctgaggagaatctaatgcctaatgcctaatgatctgaggtggaacagtttcattcagaaaccactcccccaaaccccaactgtggtccctggaaaattgtcaaattgttttccacaaagcaggtcctgatgccaaaaggttggggactgctgctctagagaactaatatgggagcatatcacctagatggatttggtgaaaacttgtccaggaaagagaaggtgtgaatgaccaaagtggatggtgatagtgggagttgacaaaggggaaaatgcatttctggaataaatacttgcaggccagtagtacaacatcgtggctcagcatagtaattttggaaccagacaccaatgggttcaaattgttattctgcctcttttaggctgggagacactgataatgttatttaacatttctaaggctttgtttacttatttgcaaaatggatataataattcctactccatggtattatgatgaggattaaatggcatgaaacatgtaaagtgcttgccacagtgccttttagtgctcaataaagtgaggtgagttcctagtagttataatagttacagttgttgtttatgcctttaccattatatgcctttttctaacagcatttttgtctggaagtctttccagacaaaatatttccaaagtatagccagcatttttgtccacagggagcagaaaaagaaagtgatgggggcaaaaatctaacactgaagggtatttgtttgtatgaaaagggcaccatgatgctgaggtcggtagtgatactaatagtagtggcagtagtactagtagtaggttggtagtagtactaatagtaggagcagtaatagaaggaggtacacaaagataaggagaaaaagggacagtggttctattaagtgattactatgttccagatacttctcacatgctttgcatatattaataagaaaaccccattgtctcagcccaaaacctccttaagctaatgagcaacttcagcaaagtctcaggatacaaaattaatgtgcaaaaatcacaagcattcctatataccaataatagaaaaatggagagtgagttcactcaaatgagtgaactcccattcacagttgctacaaagagaataaaatacctaggaatacaacttacaagggatgtgaaggacctcttcaaggagaactacaaaccactgctcaaggaaataagagaggacacaaacacatggaaaaacattccatgctcatggagaggcagaatctacattatgaaaatggctatactgcccaaagtaatttatagattcaatgctatccccatcaactaccattaactttcttcacagaattagaaacaactactttaaatttcatatggaatcaaaaaagagcccatatagccaagacaatcctaagcaaaaagaacaaagctagaggcatcacgctacctgacttcaaactatactacaaggctacggtaaccaaaacagcatggtactggtaccaaaacagatatatagaccaatggaacagaacagaggcctcagaaataatgtcacgtatctacaaccatctgatctttgacaaacctgacaaaaacaagcaatggggaaaggattccttatttaataaatggtgttgggaaaactggctagccatatgcagaaaactgaaactgaaccccttccttacaccttatacaaaaattaactcaagatggatataagacttaaacataagacttaaaactataaagcttctggaagaaaacctaggtaataccattcaggacataggcatgggcaaagacttcatgactaaaacaccaaaagcaatggcaacaaaagccaaaattgacaaatgggaaccaattaaactaaagagcttctgcacagcaaaagaaactatcaccagagtgaacaggcaacctacagaatgggagaaaattttttcaatctgtccatctgacaaagggctaatacccagaatatacaaggaacttaaacaaatttacatgagaaacaatcccatcaaaaaggaacttaaacaaatttacatgaaaaaacaaccccatccaaaagtgggagaaggatatgaacaaacacttctcaaaggaagacatttttgcggccaagaaacatatgaaaaaaagctcatcaccatgtggacattagagaaatgtaaatcaaaaccacagtgaaataccatctcatgccagttagaatggcgatcattaaaaagtcaggaaacaacagaaactggagaggatgtggagaaataggaacacttttacactgtggtgggagtgtaaattcgttcaaccattgtggaagacagtgtgacaattcctcaaggatctagaatcagaaataccatttgacccagcaatcctattactgggtagatacccaaaggattataaatcattctactttaaagacacatgcacacgtatatttattgcagcactattcacaatagcaaggacttggaaccaaccaaaatgcccattaatgatagactggataaagaaaatgtggcacatgtacaccgtggaatactacggagccaaaaaaagaatgagttcatgtcctttgcagggacatggatgaagcttgaaatcttcgttctcagcaaactaatgggaacagaaaactaaacaccacgttttctcactcataagggagttgaacaaagagaacacatggacacagggaggggaacatcacacactgaggcctgtcaggagattggggggttgggggaggggatagcattaggagaaatacctaatatagatgacgggttgatgagtgcagcaaaccaccatggcacgtgtatacctatgtaacaaacatgcatgttctgcacatgtattccagaacttaaagtataataataaataaaataaacataacaacaaaaaagcatgttaaatatcttagggagaataacattgaatttgaaatctaaggctaagaatacatttattcgatatgaagaacaacattttggtcttcgtgaaaaaactgaaagtaattccagataacagagagggaatggaatacaagaccaagttttaaaaaagataatagataaaaaatataattgttgaaaataaagcattcatgatgactcatttgtgtaacagaacggtatattatgctgatgaatttttgcctttttatgtaatggccatagatgtcaatggatagtgtaaacatgccaataatgtcatcagcataaatgataatagtaatagttgtcatttattgagcatttactgttttcctgtggtagtactgatggtattatgagtcttattttgtataattcttaaatcaatcctctgaggtagtgtttcacacacctttaaggtgctgcttcagatttgctcagcttcacttatctctggaacccctggctacttgttccatcccagttgcctctgcagtaactaactaggcatgggatttaaccaatatcgcatgggcacaacccaacccaccttacctcatacctgtgctggtcacctttcggctcctgtctcagagttttctgacacttcctgagagatacagtgccacagtacctgttcagtgtccatgtgtgcacagtacctgttcagtgtccatgtgtgcacagccctgaagtacagggatttattgccatttgggatgaacttgtgaccaataaaaaatggaagttcgtgagtatatttgcctccttttttgcccctggactaattttcctgtgatgcaatagcttcatgagacttctcagtggagaatctcctaagttagagcaatgggttgttcttgatcacacatgatagccaccacaatgacatacctctattatcccctgttcttctcagtttcattaaccccttctcaaattcctgcttctctgatatttctcttccaaataaattagtatagcaccagcatttgccttttttaagaacccaggctaagacaatggcaccagaactaggctgttttataatgtctgttctgcagtggcatcaccatctctgtgaccttcacctgtgcataattgggatgaggtgaaggtggaacgcagagcatgggatatgcagtggttgtggtgatgaaagaaaatgggcacaatgacaagtataggaattgtggagttgggtggtgttctgtggttagcaggtctatgcgaacctacccctaaaagtccaaggaagctgagaagccaaagaaagaggctgacatatgcagtttttcaggaaagaaggaggtaaacatctaacagggacttacaacagaagccatgtctgtgtcttgggtggtggcaagacaagatagtggattcccacaccattacccctcagacctagctaaactgtagggaaagagatgtggaggataaatactgaagagcaggatttacagtaagtataataacatcagagttgttttgacctaagggcaggatttatggtaagtacatgctcttacacaaggaagagtagatgatatagaaatcttagaggcgttcctaatattggggttaaacagaagtcaacatggcacatgagcagccaagatggagttgctttagtctcaatagatggcttttgttaacaatgctagtagccttgacaatagaaaatgataggctcaggtcaactgctagcttaagtcatgtaatgaaacctggagtcaccttataaaagcttttagtaatacccttatcttctgtaactataaggcatacagtactgaaaatcaggcacagactctattgtaatggagctgctaatggaacctaaatactcacctttaaaaattaaggccttgagagaaagggtgggacatacgacctgagatatggacattggacgaatatgtctgagaatctttaatccccaaattctcttgagttcctcaggccagtagaagtaaccccctctcaatttctgcaggacaacagtctgtcagtgccttgaaatttgcaatatctcacctgaagaaggagccttgcaaaataatgcttatacacttcaagagtctttctcgtatccttcattgcctccaggccaataatcagggttaggtcttagcacagaccaatcaggaaaatacagccttgctctaggaaatatagactacatgcaataataaactaaaataaattgcaagatcttgctaatgtgtttgagtgagaaacaggagaaatctatatgagaatgtatcctaagtaggtaagattgggatagcgagaagcaaatataagactggacagggtagaatttattaacataggagaaatcacctgagaatctgggtttaatgttttatcaaagaccctaaagcaaatttggaaagtctgctggatccaccataacaacaggctaaaggagaaaaatcatactcatagaattattgtggaaaaattaacaaaattcagtaccctttcattaaaacctttcatctcagaaaattagaaatggaggagaattacctcaacaataaaaggcatctacaaaaaaagcatatgaataatattgtatttagttatcaaaggctaaatgttttcccctgatgattgggaacaaggcaaggatgtccactctcaccattactattcaacacaagcctggaagctctagcaagaacaagaaaaaaacaaataaaagaaataaaaggcacatattagaaaggaagaaatcaaatcctccctatttgcacataagattgtctatgtaaaacattccatggaatctatcctacccaataccccccaaaaacttgagaactaagaaatgaggttattaagattgtagaatctaagatcaatacacaaaaaccaatcatttttctatactaaaaatgaacatactgaaactaaaatttaaaatataataccatttataattgcttcaaagaaaatacagcacccacatatacccttaacaaaacatgtacaagaatggtatgattacaattataaaatgctgaagacagaaattgaaaatctaagtaagcagagagacatactatgttcatggattggaaaactctatatagtaaagatgatatttatctccaaattgatctataggcttaataaaattcctatcaaaatcccaggaagtttttttttttcatgaacacagcttattctaaaatttatatgaaaagatacatatcctagagtagctaaaacaattttgaccaaaaaatatagtgagatgaatcactctacctgacacttgagcttaatttatagctatagtaatcaaggcagcatgatattggcaggggaatagacacatatagatcaatagaacagaaaagagaattcagaactaggtctggtatggtgccttacacctaaaatcccagcactttgggaggccgaggcaggtggatcacttgaggtcaggagttcaagagcagcctggccaacatggaaaaacacgatctctactcaaaatacaaaaatagctgggcgtggtggtgcacacctgtaatcccagctacttgggaggctgaggaaggggaatcacatgaagccaggaggtggatgttgcaatgagctgagattgtgccactgcactccagcctaggtgacagagtgagactctgtctcaaaacaaaaacaaacaaacaaaacaaaaaacaaacagaaaaacagaattcagaactcaacctacgcaaatatattcaaaagttgcaaaagcagttgaagggaggaaatcattttaacaaatggtgtagaagcaattggacatccataggaaagaaaatgcaccttgacctacaactcacaccttattcaataattggctgagtctttagtcttgataccaaaagcatgatccataaaaggagaaattgataaactgggtttcatcaatattaaacactttcttttttgtaaaagactcaaaaaggagttgaaaagacaaggtagaaactgtaaaaaaaaaaaaaaaaaaaaaaaaaaaaaaaaaaaaggttgcaagccagatatctgggaaagaacttttatcaataatatactaaataaaaactcttacaactcaacagtaaaagttcaaactgtccacttagaaaatggacaaaatacccaaaaaagagacattttagcaaaggaagtatacagatggcaaagagcacatgaaaaatatgttcagcattattaaccatcaggaaaataaaaaaaggaaggaaggaaagaaaggaagggaagggaaagagggagggaggaaggaagggagagagggagggagggagggagaaagcgagagagggagggagggaggtagggaaagaaagaaagaaaaacaaaccaataatgggatacctatcagaatggctactttttttttaagtgatagcactaaatattgatgagaatgtagagaacctggatcactcattcattcctggtagaaatgtgacagatgatagatggatggatagatagatagatagatagatagatagatagatagatagatagatagacagatgagataaattatagatacacatgcagttgtaagaaataatacagagagattccaggtacctttcattgagttcccttcagcagtaacttcttgcaaaaaaaaaatattacaatcagaatatttcacactgatgtaatccactgattttatcatatttctccagttttgcttgtacttatttgtgtgtgtatgtacgtatagaagaaaagttaaaatcttcagagtagttccttaaagcttctacacatcaaatccctatattaaggagatagagatccctttgcctatgtaggaaatggcaaatatcattgatgttctggagaactaactgttgccagagagtagaagataatctcaatagagatttgaggatgatgcttggtaaagtccgagggatgcagtgtctgccacctgaagaatattgagaatgaagtcagaagagtcggggcaatggaaatattagaattgatttattacacgacatctaaaatttaccatctgataatattttcttagaatttccagaaaacactcctttcactaagtcagtggtccttacacttgaactttagagttcccaggaggagatcaaaatttccagaagggcttgttagatatagatttctgggtcccattcccaaagtctcatttagtagaccctaaaatttcaggttttaaaatttgcatttctaaaacgctcctaggtgctgttaatgttactgttctggggtctacactgagagagaactctgcactaacacagtaagaaatgcactggggataagggagcatcagcattgttgagaagttcagtggtgggtgtcctctgtaggctagatatgaccattggaattcttaacatggaaataatctccctaagacaaatggtgatgatgagattccagagtggttgagactgggtggcagcacttaactatcagacaaggagaatatgcctgacataattattataatgggtaagaacactgtcatagtaatctggatgtctcaacctgtagaagtttgtagcaatgtctgagatcaaggtgacttttgattaaaggcaaaggtctaccccataaggaagagccctacaatgtcattgcaagtacatgtggtaaagatccctctgatttcccccaaagggccctgtgctaggattactatgtatgaggagcaggaaataactagactatttgagggctgttagatagatgttctaagctgacaccaataccaggggacctaaaatgccttcacatttctctagagttggggtataagaaagccagctattaaataggatttggctcaagcatatctcatagtgggcccaatgggtgtgtatgtatatatatatgtatatatatatatacacacacatatatatatatatgtgtatatatatatatatatatatgtgtgtgtatatatatatatacacatatatatatacatatatatatgtgtatatatatatatatatacacatatatatatgtgtgtgtatatatatatatatatatacatatatatatatatgtgtgtatatatatatatatatatatatatatatatagcctgtggttatttggttattttcctgggttctgaatgtatgatggacatagatttacttaatagccagccatgttgattatctgatgtgtagagcaatggctgttacagtgagaatggctaagttgaagcccccatgtcctctccctttcagctaagatacacatcagaggcaatatttgtcttctttgaggaaactctgagaccactaccaccaccaaagatgtgcaattatgtaggagtagtggtcctcttcctttctcccatcaatatgtctagatcctgcaaaagccaggtggattgtggtggattatggtggctaccataagataaaagatggtagccctatctgtgccttcctgctgggtgtgttatttttacatacaattaacatagtctctggcacttgatgtagggcttttttttttttttttttttgagacagtatcttgttttgtcacccgggctggagtgcagttgtgtgatcatagtcactgcaaccttaaactcctaggcacaagaattcctcctgcttcagcctcctgaataagcatgactacaaatacatgccaccttgcccaactaattctaaaaaattgtttgtagagacgggggtctcactttgttgcctaggctggtctcaaaatcctgggctcaagagatcctcctgcctcggcttcccaaagttctgagattacagccatgagccactgtgctcagcctgtcgtacgacttttttatggcaaatgatttcttgatcattctggcaggctgaataataacccccaaatatgtccatgtcacaatctcagaaatctataaattttaatgtacatggaaaaaagggactttgcaaatgtgattaagtgtagaatctcgagatgggaagattatcctgaattatcccagtgggctggatgtaatcatacatgtccttataaataggattagaagggccagagtcagaagaaagcactgtggtgacaggaggagagactgtagagatgcactttgaagatagaggaaggggctacaagctgaataacaccaggggtctctagaagtagaaagtagaagatctagaaaaggcaaagaaacgagttttcctctaaaaccccagaagggaccagcgcttctgacaccttgcctttagcccagtgaaattagttacagacatcttgtcttcagaaatataacagaatacatttgtattgttttaagaaaccaaatttgtggtaatttgttgcaatagccataagaaaggaatatgccattagtatcagcaaaaaggattaacacagtgcaaattactcactgcctgcaccaaggctgtgataaagtttaaaattacatatacagtcatatataattcatatggtcataaagttcaaaagtatatatatatatatatatatatatatactgtgtatttatatggtataataaatattatatatatagtatgtatataattgaatatattattgtccttaaattgatgacatgatgttgactggacctagtgagtaggaaatggcaaatattattgatgtcctggttattacatgttgccagagagtagaagataatctcaacagagcctcgtggggtgatgcattggtgaagttcagagggatgcagtctctaccatgtgctgggactgtctaaagttaaggataagttgttagaatttgcactttctaccactaggtaagaggcacaactcttagtgggcttcttagaattttagaagaaacatatgccacatatgagaatactgctccaacttggaaaaccgcaagggtcaagtgggctctgataaagagaagcctctgcaacaggctcagaatgcaatgcaggctgcccttccactcatgccatatgaccctgtaaatctgatggtgtcagatgttgctgtggtaaagaatgatgatgtgttgtttctctgacaagccctaattagagagtcacagttcacatgccagatttctgaagcaatatcaggccttctatggaagagaaccacttgccatttgaaaaaaaacatcagtagaactatttggtcatttcaaatggaaagaaaagtaatctgagataaggacacacaggcttctgggctttgaggaatggctgagcttgttgcataggattctggaagaaattaaacctgaagatcagagaccagcagatttgagggagagatatagtcacagacctgtaggaatggtcccaaagcatacagttattttattttttaaaaattataatatttattaaattttgttactatttataacatagatttattgacttttggttgggaaaactagttgcgtgcatttgttcagttcattgcagaatctttagcaccctggcctaaggattaaacgcccatagtataccacttttattgcaatagccaagaatgctgctacacattttcacacacccccaggagggtatttagttctcattctacttgagaatgatttaataccgtaaaacttaccaccaggtatgattcttagaataattttatatgtttccaatttttagagttagatgtatttagattatctcaaatatattattaatgtatttttaaatctttttttgaggtataacgcatatactctactctcagaattaagttttaaagaatacaatttgatgaattttttttacctacacattatacccatgcaatcaccatccaggttaagatgctgaatatttttaggacttcagaaatctttatgacccttttcaatcaacctctgagaggttaacttctaatctaacttctatcaccatgtattagttttgcctgtttttgaaccttattttttttaaaaaaaacaatcatagtaaagcattcagatctctgtctttaatccttccagaaagcatctaccaccaaggaggcttcagtcaccaggtggacagaatgactcatccaggcatgtgaactagtctctgactagtttatccctgtgttggtgcaatcagtccatgaccatgtggtcatggtggtaaagatgaaggctacacaaaaactcaacagcataagttctccctgatctagctactgtcagggcctagtgtctatcctgtcagcaacatacactgggccctccacgtagctccatttatttaaaaggccagccattaatagcagacaggccaattattctgaacgtcttttatcctggaagggtattaatttgtccttactggacttaataggtactccaggctatgatttcctcttttttgtcagcaaggactccacccataccactaagagtacttataaaatgcttgcatggcatctcatataacaatgcttcagattaagacacacattgtattagtcttttctcatgctgctgataaagacatacccaagactgggtaatatataaaggaaagaggtttaatggactcacagttccacatggctggggaggccccacaattatggcagaaggcaaaggaagagcaaagtcatgtcttaggtggctacaggcaagagagagcatgtgcaggagacctcttctatgtaacaccatcagatctcctgagacttattcactaccatgagaacagcatgggaaaaacctgcccgcatgattcaattacctccccctgggttcctcccatgacacatgaggattatgggagctaaaattcaagataagatttgggtgcagacagagccaaaccatatcattaaacccctgtaccctcccaaatctcatatcctcacatttcaaaaccaatgatgccttctcaacagttcctcaaagtcttaacttattttagcattaactcaaaagtccatagtccaaagtctcatctgagacaagacaagtcccttctgcctatgaacctgtaaaatcaaaagcaagttagttacttcctagatacaatgtgtgtacaggtattgggtaaatacacccaaatgggagaaattggctaaaacaaaggggctacatgcaattctgaaatccggaaggccagtcaaattttaaagctccagaatgttctcctttgaccccatgtctcacatccaggtcatgctgatgcaagaggtgggttcccatggtcttgggcagctctgcccctgtggctttgcagaatatagcctccctcctggctgctttcatggactggcattgagtgactgcagattttccaggcacatggtacaagctgtcaatggatctacctttctggggtctggagggtggtggcctgcttctcatacctccactaggcagtgccccagtggggaaatctgtgtgggggcttgcaccccacatctcccttttgcactaccctagcagaggttctccatgaggattccacccctgtagcacccctctgcctggatatccaggtgtttccatacgtcttctgaaatctaggcaaatgttgtcaaacctcaattcttgacttctgtgtccctgcaggcccaacaccacatgtaagctgccaaggcttggggcttgcaccctctgaagcaacggcctgagctctatgtcggccccttttaaccatggctgggatgcagagcactaagtccgagactgcacaaagcagcagggcactgggccaggcccatgaaaccatattttcctcctaggcccccaggtctgtgatggaaagggctgctgtaaagacctctcagatgccctggagacatttttccattgttttggtgattaacatttggctcttcgttacttatgcaaatttctgcagccggcttgaatttcttctcagaaaatgggtttttcttttctactccatcatcaggctgcaaattttctgaacttttatattttttgcttcccttttaacataagttccaattccaaccatcatagctttgtgaatacataaaactgaatactattaacagtaccctagtcacctcttgaatgctttgctgcttagaaatttcttccaccagatgccctaaatcatctctctcaagttcaaagtttgacagatttctaggacaggggcaaaatgtcaccagtctctttgccaaaacatagaaagagtcacacttttgcttcagtttccaaaaagttcctcatctccatctgagaccacctcagcctggactttgttgcccatatcactgtcagcattttggtcaaagccattcaacaaaggtctaggaagtttcaaactttcccacatcttcctgccttcttctgagtccttcagactgttccaacctctgcctgttacccagttccaaagtcacttccacatttttaggtatctttatagcagcacctcactctactggtaccaatttactgtattagtctgttctcatgctgctaataaagacataccatagactgggtaatttataaaggaaagaggtttaatggactcacatttccacatggttggggagtccttacaatcatcatggaaggcaaacgaggaacaaagtcatgtcttacaaggcagcaggcaagggagagcatttgcaggggaactcccctttataaaaccatcacatctcgtgagacttaatcacagcatggaaaagacccgcccccatgattcaattgcttcgcattgggttcctctcatgactcatgggcattatgggagctacaattcaagatgagatttgggtgggacccagccaaaccatatcacccatttaatggcaaaaagagtatgtccttgggcacatgcccatgagattcacaaatcatgtaatgtacttaatatggtttggctgtgtccccacccaaatctcaacttgaattgtacctcccagaattcccacgtgttgtgggagggacctagcgggaggtaattgaatcatgggggctggtttttcccatgctattctcctgatggtgagtaagtctcagaagatctgacgggtttatcaggggtttctgcttttgcttcttcctcactcttctcttgttgctgccatgcaaaacttgccttttgcctccagtcatgattctgaggccttcccagccatatggaactgtaggtccaattaaacttccttttcttcccagtttcaggtatgtctttatcagcaacatgaaaacgaactaatacagtactccatcaccacatttcagaccaaaagaatgctggaatagcctgctaaagctcaaatagagcagcatctcagaacaacatcacgaacagctgggacactattttctttgattgagaacatgcccagaatcaacaagagtacatagtgctatgtccccagtacttaagatacatgggtccagaaatcagtgtgcaaaaatagaatttacacatctcagcctcactcctgtcaactcaatttctattttgtttttcacccttgaaaactcagcctcttcctaattaaagaccctcagtttcccaaaaaagaagtctggtgccaggggacacatttagtttcctgcagaactgaaagctacaactctcataagcccatattaggcttatgagccagcaaacaagaaaagagctactctgctggaggtgggtgcttgactttgatcactatgaggcattatagtttctcctacacaatggagacaaggaagccctatgtcgggataccagaggattcaatggggcatctgtttgtgcttctgtaccccaaaacaaaggtaaaaacaagtgtttgcagcaaccacggtatcccaataatagatgcaaggtaactaagagttcagtccctatagggataaagttctgagtcactccatcaggcaagcaacccagaccagctcagtgtgcaagaaatcaaaaaagggaagtagagaagggagatcatgaatgtcatggtctcagaatcagctctatggcaccagggaatttaacctgtttcataaacactcttgccttaatccttctcagaaatcatagctgccaccagctaaagagagctccatgaataatttacaggccctcttagggataaattaggatctgctcataaaaatagaagtacctctgtattgtgagaggctggaatagtaagagggcatgtgtggatctgagtgctgctaggggaacactgtatcaggcacctccttatgtaccctctctgatccttttgaccttatgtgtctctaggctgcgtgttttgcccagttaccactagggagccaactcggcatggactttgacccacttcacatggatacaacccaatagaacttgtccatgccaggccactgtcaccttcgactctggagcttctccgttgacactaaagcgtgagatgctatgagacctacatggcatgcacaagccagaggtgtggggaagttaatttcctttggggaaaacctatgaaacgtgggatccagaggataaattcttcttctttcctttcctatggactgtcttgaggagcagtacttcttaagactactctaaaggcaatcccacgatatttagcaattgtgttcacttgctaccatgcagtgaacagtttagtaaggtacctacatatggactctcttgtctgagtcacttcccttttccaggctcttgcttccctagtattacatttaagggttaactagtggcctcaggctcttttttctgggtagtccaggctaagacaggtgtatactatttgatccccattttatagatgagaaactgaggcaaaaagaagtgaagcaactcgctgggatcatatatctaggtctttcacacctagatcagcctggcttaaaatctagatcttaattaatgtatttaatagaagacatgatctagttgctgaaaacagttgggatggtaaaaatcaatcctgtagattaagcagtaatggtttgaatggggtggtgtttaacggagtcctgaactataaatgatcaggagaggtgatttgataattactcagtgagagtaagtaaaaggctgttgccttctagcgtggcatagaccagtgtagggacactgttctgccatttggaaataccgtagaaaaagcattctataagagatgtctatggtgtttctggtaagcaggttcaaaaaaagggaggagagagagagaggaagaagtagaaggaaaaaaattaagacctggtcacagggtgagggaatttccctaacaagttagtaggtgaaatatatggctagggtaaaagtgatgaatagttagggtctgagctgaaagtttacaaggattgggatataaacgactatagtaggagacctgggcagggaacaaagggtgcagggcattagctgggaaggaggtaggtgtggagcagatatcagaagctggacctgccatcatgcacagaaatatgtgtatgatccatgtatgtacgatccattggctcctatcaagaaaagtccatcttctttcattcacacaggtctatgggccagatcacacacacaaagtgaaggaaaaacagtttcttatctttcatcaagtctgctattgaacaagaacatgctgcttctagcttatcccttgactaaactatatttatttatattctgcagtcttagaaagaaaacctctcctacccttgcaaacatgagaggcagaagttcatttttatacagctaaacagagattgcctgtttaaagaaaaatctggaaattggtactggatgaaaagaatattcactgactttaaaatattggagattatgctctgaagtccaatagcttatttgttcaataggccccatgggtagccctgaaaatagaacctgatgaaatcaaggcggggaagtagagaaggtcagtgacttaagagttaagataacaaagaaccagctctcagatcttcgtcctttcagtagaagcaattttttcagaggtattagcgtaccaatttacactatctcaactctaaattaattaacacagtgtaatggatgaaagaaatactccagacacaccgacatcaggcaatagtatcctaacttacctttcagattctactttttctcaggtcctccaacagtctgttctcaccccaagacaagctctcctttaaggagtctagttatattatcttctccttcaagccatacaatacctcccctttgcattagtaataaaattcaaaatttttatcctggtcccagtgacctagctctagcctgcctctctcacctcatatgggtaccctccccctcaccttcaccacatgttccagtcatactagtgtttgttctcttgtttagtgccttaatctttttacaggaggtttctaatcattagggttcagctgaaagaatccatctcagagggaccttctgcaacttcccagatagtagtagccattcctgctatgtcttgtccctgtaacatcactcttttgtttcctttatgctaattttcattatctgaaactatcttgcttatatatttatctgttcattatctgcttcctcatactacatataatcttcaaaagagcaagaactaattttgcagtgctcacagttacacctctagcacctagaaaagggcttggaagacagccacacacactcctttccccaaataaaaattgatgagtgagtaaatgaatgaatgcatgaaactaaatattcttagcgcatttcacagtctatacaacttcaggatccctgcatatacatccccaagattaccacttttattacaggctgttccagaagacttcctgactatcaaaaaaaaaaaaaaatgccatttagtacaaaatgactactaagccttccaagaaaccaaggacgttctagtaccaattgaatactattgcatgctggtcatttattttatttgtttatttgccttacaaattctgagttattgttgtgtatatgaagcaagggtcaccaaattacagcctccaggccaaatttggctcaccccctatttttataaatacattttaatgggaaaacagccacagccttttgtttacatatttttatggcttctcttgtgtcaaaaaggcagagctgaggagctgcgacagagatggtataacccccaaagctgaaaatatttgctgtctgaccctttacagaaaaagtttactgattcttgatatacagcaatatgtactcaaaaatagaaactgtgtgagaaaaagagctgcaaaatgtcagggggagaaatgagagcattgactggtgttttctttgggtaaaatccaggaaatttgatagtgaccaaattagaagtgtatcctcaaaatggttttggattagagcgtgagagagaagactacatttcagtggttagctcagaaatcagaagtttactggctgaagaccaacctttctttcaggctagttctgtattctcttgctaagagacacttagttcccttccatttcacactgggccccctcttcctacctttgtttgcatctgttctctgtgcaatccggaatgtagggaacactgccatcttcatgatgaatcgtttcctccattgaattgcaattacaggttttaatcagttcattatttcacctagtttttgggtcctgacagttatgctatggaaactaattgaattggctttacctcaaggcattcccacaagaagatttttaccttgccatttgggaattttttggctgtttgaccaaattagccctaattgctctgtaacctaaaaaaaaaaaaatcttatgtttatatttttcctttgaaagattttacattctattcctgctctgaacacagtgctctttatataaaaagacaaatcactggcctgtaagttagtgtgttatataccaagcttcttatagaagaggctatagagtgtttgtataatatacccttattctttttcatagccctcctttagaataatttttttaaagtgtggaaaggctggacattagattacattttttcaaccatttcgtatttctgctgctgcaagttctagtctatggaaaatatatggcccaggaataacgtttgactgtctgtccgtggtgacattatcttagcaagttcaccatgatctaaggctgggttctcagattttggggtgcctcactggcttacatcaaattgacaaagtttcatctgataaagaaatcaaaatgtcagttgataatatcatgatgagaatacagcagccaggcatggtagctcatgcctgtaatcccagcactttgagaggccgaggcagaaagactgcttgagcccgggagtttgagaccagccagggcaacatagtgagacctcatccctacaaaaaaaaatttaaaaaaatagttggacatggtggtgcatgcctgtggtcccagctactcgggaggctgaggtgggagcattgcttggaccctggagttcaagtgttcaatgagctagagctatggccactgcactccaccccgggcaacagaatgagatcctgtaaaaaaaaaaaaaaaaaaaaaaaaagaaagaaatgtagcagcagaggagactagaatgatttaatctccttggtcagcacgttctcttcttccaggagaacctacacatatgagaagccatattataatccaaaggttgtttggtgagtgtagaatgcaagcagagagaggagaaatactggttagaagattacattgttgacagtaaatgaacacccagctgcattcatctctcatttaggagttgcaacatcaaaagacaagaaaaccaaattctgggacagagcaacttgttctctgaaaagccatgaatgaggacttccaatattggcctctactctgctgattttctacatacattctagtgaaaaagtcttgctttagtaatcgtcagacaagcaactatttcatcaaatcctattcttactgctctctgccataggggccctcatcctctgaaggtgatgtctgcatatttcttattggatccattgcatgttaaatttatcagtttgattcacaaagctctggagtttctcttgctgtctctatttgctgtccatatgtagcagggtttctcagctttcgcactactgatattttaggtgggataatattctgttattagggattatgtaggatgtttagcagtatccctggcctcttccccttatatgtcagttgcagactccccacccaccatcccttagcagatatgacaactaaatatgacaactaaatattgccaaacgtctcctgagtaccaaaattgcctcctgtcaaggaattctggcatataggatagataggtgaaaagaagagaggattccttctaattcctttcagggatctagggcaaaaaccattcaacccagtcaagctgggttccagcttcatatcatttaactcctctacttttattcctctgagattccccttaccataaccacgatgtttatacaaatcaaatcctaactcagacttctatgaattttttatgcatatctacctttccaggcaagtcacaactttcttatatctgattgggcagaaggtttatagtatctcagtaaataattttcctcagttacatggagcatcatatttttattgggagagaaacatatttcaaaatttgaggtatgcacagtatctgtcaatacccatgactggcttcaattctgaaatctaattaatgtgaattctaaattccttgggttcatcaaatctttgcgtttgtcaacatagggtacagaattttggttgttgttttcttctctctcttaacactttaactagagttaagcagttttcatttcatcaagagggcaagtcacagacaaataaatctctcttcagtggtagaggtaacattttagtaagttgagagatggagtattcttattgctccaagatgacactgtgtggaaattggaccaagcttaagctcccaaaagatgcaacccaggatgctctgtccaaatgcatgttctattctttttattttactttattttatttggagacagagtctcactctgttgcccagactggagtgcaatggcatgatctcgactcactgcaacctccgcctccgtggttcaagcgatttctcctgcctcacctcccgagtagctgggattacaggcgtgtactaccatgccaagctaattttgtatttttagtacagacggggtttcaccatgttagccaggctcaaactcccgacctcaggtgatccacccacctcagcctcccaaagtgctgggattacagacgtgagccaccacacccgtcgcaaatgcatgttctattcttagacaggtatattattttattctcatcttctttttatctcttgcttcctcttttcctccaacatgtttgaattaactatgccccagtttttgtgtttccctaggtcatgtcccaaccatgctatttctccagaacttaaacagaaagcttcttcaatggaaggtgcacaatctttctactgcaactcacaaacaacagtcaaaagccctatgccaaaaaaagttatctatgaaaaatgagactacaagattactttttttcagtaataattttgaaatttcttccctaccatcagaaggttctaggacaagcccagcgatgcgtacacttggagagaatagagcagcaaggatgaatgacagtatttttccacactcagcccctacaggcagctcagcatttctttggcagctcccctttaactagaagaaagatggcagttgaccaaacagataaaatacaagtgttgctgagaccacccaggcatgtatcattcattttgaattgactggatcttttccagagggattttgttagcaaagaagagagaggagatggagtataaggggtcaggggcagtgagggaaaatgatgaaataggtgcacaattctatttggaaaaatgtatagacacatgccaaatacaggtaagaattgcagaaaatattttgctgtgatgttagtctcgaaagacctatgaatgttttttaatttattttttaatttacttttaatcaatctgtcttcaaaatttggcattcccaacacacatctcacgatttgagctctagagtcagaaaagttggctgggcgcagtggctcgtgcctataatcccagcacttttggaggccgaggtgggtgaatcatctgaggtcgggagtttgagaccagcctgaccaacatggaaaaaaccctgtctctactaaaaacacaaaaattatctgggtgtggtggtgcatgcccgtaatcccatctacttgggaggctgacgcaggagaatcgcttgaaccagagaggcggaggttgtggtgagccaagatggcaccattgcactccagcctgggcaacaagagtgaaactccatctcaaaaaataaaaataaaaatagagtcagacaaatcagatttaaataccagctctaccacttattaaatatgggacctgaacaagttatttaagaattctcagactacatttcttcatctgtaaagtggaataaaccaattaacagagtctggctcatattagacaatgaagacaaggcacattaaggtggatggatggatgagtatgtgggtggtagaagattctgaaactctggatcttgcagaagaaaaaaatacaatctaaattcttacctagaggaaactgctttgctttgctagttctcattgagagtgtgaaagatttaagtgttcattcttcaggaagggcatgagtcctcagccatcgatattaaaaaaaaaaaaaaagtgcaacttcacctgccttgagtgtttttgcttttaagaactggaaagcttttattgaaatggtggtataggaatcactgaaaacctttatactggactctgagctcctcagatagatcaatttcactctaataaatcaaacctttgaaacctgctctgtgatattgcagtcatctctgcctgagctctgtggcaggcagagtctggcccagccatggggctggtcttccatttctatttcagtgtaattaagagattttctttctttgaattagaaactggctggcaggaaaaatggtatgggaacattccacagggttctctggagaaacaggcaatctaaccattgatgaagaggacatgggctcatgctaatataaagaaatgctcctctctgcagcaggaaagtgaggagtatgcttcatgctggtgggctgattatttggctcattccaattagtactgaatccaaatggaataatgtatttttccttaattctttcaattctccaaatgctctctgggagaacacattctttctctccaactggaagcagaggattcagctctgctatgaggcctggtgattagacctgttggattagtgatgcctgcaattcagtcagaggtatagtcttcctaattgtctttagcggggttacactccctcccctttgcttccttaatgatctcattagacaattcaatctggaaaatgcttgcaactcctccagcctatgtaattgcacccaaggtggggttttagggctccttcaaacaggtcagatatcatactttgggacattcaaggtagatttgggggccgtctaccaagcactttgagtgagtggctctcactcaaaactacagatgggtaaataatgatagcatccttaatgggcaacaacagaaaaagcaagttgcttaaaggtcatgcatctgcatttaccacagcctgatgcttctcacaaggatcttcaaaggatgagcacattggatcagcaagacttcactcagctttgagggccctgctgtagagagagtcatggatgttccagcagcaagaatagtataggtttcatgcaggcaacactgaagccaggactttttttttttcttttttaaaaaataattcacaaatggtgaaaggtctggatgttaaggcaagaagggtaagggtgggtgtatgaaaaagagataggggttggattttaacataacctttggggtaaggctatttaatgagcatttaatactggtaggttaaccaaatcaagaccccgtttttttttgtttgtatgtttggtcctttttatgaagttatccagaaggaggtactgcaaacattgtcccccaggcagggaaataaggcaacgccgaatgatttctcctttcaaccttaattacatgtctgcttgaattaaagacttgtaactgaatttgatggctagaccttgaccttcaagaatcatatactgaagattttttttagctttattgaggtatagttcacatactatataaatttccatccaaggtaagcgtaaggctcaatgatttttagcaaatgtatgtaatgaaatcatcaccagaatccagttttagaatacagtattatcatcatccctattttccttgtgtccgccaggagttaatccttccaccctcctcttagtcccagcccagacaactactaatctttactttcttacagattttcttttctggaagttttatataaatagtgtcatataatatgtagtcttctggcttccttcacatggcataaggttttggagattcatctatcttatagcatttatcagtagctggttcctatttcatggctgaaaagtgttctgttgtatgggtataccatattttgtttatccatgcaccagtttatacaaattgggattgtttacaacttggggatattataaataatgctgccgtgaacactcacatactaatcattgtgtggacatgtttcagttttactagcagtgaaattgttgggttgtatggtaagatacgtttcacttttaagtaactgccaaacgtctttaagtggctgtaccttttacaatctcataagcagtgaatgagggttccagttttcctacatccttgtcaacaattgtcattgtctatctttactatagctattctagtgagttgtatagtggtatcaccttgtggttttcatttgcatttccttaacaactaaagatattgagcatcttttcttatgcctgttagccattcatgtatttctttggtgaaatccctctccgaatatttggcccatttcttaattaggatttttgtctacctattaatgagttgtgagaattctttatatatttggatacaaattttttgtcagatgcataattttcaaatattgtctcccagtctgtggcttgcattttattttctttatggtatttttgaagtacaaacatgtttaattttgatggcatccaaaatgacaattttaatcttatatatcatgcttttggtattgtagttaagaaatttttgcttgcccaaagtaatgaaaattttgtcctatatttccatctgagtttgatagtttttgctcttatgttctatgagtcaatttatatgtatcgtatgaggtaagagtgtaagttaatttttgtttatttattttacatgtggatatctaatggctttagtatcatttattggttagcttttttcccattgaattatacttttgtcaaaaatcagttaagcatatatgtaagaatttattctaatctttgattggtctacacttttatgcagtgcttgctgtcttaattactgtagatttatagtattaaaatcaaagtcctccaaattttttattcataataattttagctattcttggtaattttcatttcaatgtacattttaaaatctatttgtcagcttctacaaaaggtctgttgagattatgatatatatcacttcgaatgtataaatcagtttgaggaaaattgtcatcttaatattgaattttttaatacatgaataagggtggttaattttgttaaatcctttttataggcagtgattgagatgactgtactctctttgtcctttatactatgcactgtacacaatacagtgtacactctattgtttaccgtatgaactgagttgtgaattttaaaccaaccttgcattcttaggataaatctcacttagtcatgatgtacaatcctttttttaatgctttgcccaatttggtttgctaataatatgtgtttatactcatgaaggatattgatctgtattttactttattcttttgatctggcattgttagcacagtgatactggccccatatattgagaaatgtattctccatctcaattatctgaaagagttggtgaaagattagtattatttcatcttttttgatagagcaccagtgaagccatctgcgcccagggttttcttgataaaagaatacctatttactaacttaatttctttacttgttatagatatatttgtattttctatttcttcatgaatccattttggtaaattgtgtttggtaaatctggtaaatatttacccattgttcattctctcaatcctctctcataaatatgtatatcttttctcccaaacctgctaaatatgtatgactctattgtgtgacacagacccagtgaagcataaaagccaacttaccttcttccctcttgaaagaaagagcaccttcgacacatgcctgagactgtctccttcagtttgcaaactgatattgccaataaaactctcttttctatttagccagcctggtagtcttttggatgacaattacacatatacttagattttcttttcctttttgtctcttcatgtggatttttaccatctggtgttatttctcttcaacttaaatgactcttcagtatttcctgtatgacatctcagctagaaaagcactctctcaagctttgattgtctggcaatgtcttgttttcatttttgaaggatagtgttcctggatagttgacagtttttttgtgtgatcgttttgctttcattgctccgagcatgtcatttcactgttttgactgctattgtttctgataagaagtctgccattaattttatattctttttatctgtacataaggagaaattctacttgtgtttggcagtgaacattttggttacaatgtgtctatcttacttagaatttgagttccattgtcttacagattactacttttaatcaaatttgggtagtttttttttgttgttctttgtttgtttgttttgagacggagtctccctctgtcacccaggctggagtgcagtggcgccatcttggctcactgcaacctctgcctcccgggttcaagcagttctcctgattcagcctcctgagtagctgggtccacacgtgtgcgccatcatacctggcaaatttttgtatttttagtagagacgaggtttcactgtgttggccaggctggtctcgaactcctgacctcaagtgatccacccgcctcggcctcccaaagtgctgggattgcaggcgtgagccaccacacccagccaaatttgggtaatttgtatccattactttttcatattctttttctggcctttcttcttcctcctttatctgagtcttctaaaatgtatgtattgacaccctttaagtttccattttttatctgttattactttttattctctgttcttcagattaaataatttctattgatctatctttaaattttctgattatgtcttctaacattttaattctactattgagttcctttaataacattttattttagttattatgttcttccactccagaatttttatgtggttcttttcataatttctattgcttcattgaaattaatcatatttctctttatttaagcatagtgttgtttagtcctttgaacatatttataatggctactttgaagtctttttctgctgagttcaatctataggcccactcaaagacagtttctaatcactgcttgttctttcacttttgaataagggtcatactttcttctttctttgtatcagaattcttactgaaagctggaaaattgtagataatgcattgtgctaaccctgaattctgatatgccttctctgcccaatgatatttggttttgctgcttttgttttgttttttggtaacttgctttgactaagtctttgtcatctgtttccccttcataggtggctgctgttgtttctactcaagttttgaaaatttttgtttttgttttattcatggatttttaaaggccacgcagttatgcatagcttagtaattaaacaatgatgtttgagaggttgcactcaacctctcaatctaacaagtctctaccctctgccaacggatctgtgtatgtgttggggagcacagtcagacccatccatcttttaagctggctccagattttattttttgcacgtcctcttgcacacgtatgcagacttggagtcagacagtgatgtgtggataacttagattatcttaagtctaccttaaatgtgtgcacagctttccagtcagctcaggactggtagaaagcttaccgaggccccttccagctgtcttgcctcccaggtttccttgttcagtttctggctggtctgctgctttattgcttgatcacactaggtcctcacctcaggcttgcagagagactggtcattcattcattccttcgtgacagagatacctataaacacggacaatgctgcttagtgtggggtgtttttttcctgcttgctataaatcaggtcaatcctctttttcagtgaagcttctgtttttcacagactggacccactctgttagaactattatgtcaattgagtgggggacaggaagtgggagctacccacagcaagaatgccagacttcccattttcccaccagaagttcagtattgttttaaataactgctcctcgactttgtgtatgcatttggttgatttccaaagcctgaaaatggtttttattttttagtttttacttttttctaattttgtagctgattttgaaggagagaatttgctgagctaaaaactgtgccatattagaatccctgtttcaataaattattttggaaagaaggaataggtgaaagaattaatgagaatgtaactatcatactttcctcattaattagacatgaaattctctgctcatttctgttatatggtatcacatcccttcatcatcttgatccatatctttggttacttatacccctttataatacatggtcccaagaactaaacataatacttcaagtatggtcgcagtcattcaagcagttgtaacttatctctgtagaatgggttacctaagactatatcatcctttttccaataggcagcaatgagagttgagccttttaatagattttgtttgggctctggctgatgatccatggtagaaaaacagtgagacaaagcattagactaaatttccatggaagaaatttggaattaatagcacaaatatatttatctttaaacttttttatggtagcaatatacataggggaaaaggagattgtgataatatcaataatagccaatatttctcgagtactttccatgctccagatacaattttaggtgctttacaaattaccaccccttttatcttggcaaccctactgatgaggaaactgaaatcaactgtagtaaagcaacctgcctaaaataacagagctattaagtggccaaactggagtttgagcagggatcctctggatccaatgctcagtgttgattgaatatgcagggctactcactgtctagtgaggagagctttctcattgaaagctaatctgagcatgccttgcttatccatcgccagttctgaaggagattgagaaaagattggtgctgtaaacttctaaatgattccaatctacagcacatttcagtgttgcatggtttcagtttatgcagctttctctgctttgcctcagcaaattgcaagtccctcggaagagtccctaagaagcagttcctctggctgctgaagcggccaggctgctatgcacgctgggatcacattcggcatagtaagtagccattccttctactagaagacctgcacacaaatcagcatggggctaaataattcaaatcagaattactagcagctattgaatctgagggcatttgctaagtagaacaaagagctatgaaaataaggtgatggctttctttctttctttctttttttttttttttggctgatcttatgccaatcacaaggaaaatatcagaattgcaaatcatgtgagaataaaattgcccaaatcctgatggaccttattatggataaaagtggaattatatctagaatagagagagtagcagctctggccagtttctttcacaggctccagaagtgacaggcatggcacagattatgccaggcttagtatctgtgctccgcaggggcgattcccattagcttctgtgcccagatcctcatcctaggcagcgtgtgctgggtagcattcaggacagcaaggttctcctgcctcagcaacactgtgcttgctttagaaacagagtgagtaaggcctctgtcgacatcacgctttaattttaatgagaagtcatagaaggagctggtctttttggtcttttacaatttggaaaataagaaaaaaattgttaatctttccattcctatgctgttcagtcattttggcctaggaactttaatgctattgctttgtagtttccattgcataaaggtagtcacctatgtgctggtgtgttgctcaatctccctcaacccaatcgcattcaatggaaatgataagagaactctgttcagctgtttcccatgtgtaaaacacctatttagtggagctgaaatgtactgataactgggctcaaaagggacagtcattttcaaggcttgataagtagcaagatgtcacattcttgctgccttaggctatggacattacttattcatttcttcatccattattttattaaaaagtgtctgtacatggcatggattaaatgttggagaaattaccaatatgcattgctttatttgacttcccagtcttatctctgctcctgcccccttcctgtttttcacacatttcctatagcaccgactacatgccattttataaacagatctttgccaaagaaccaagtacccaatcgtcctcacaccatgggtgccccactgcgcccacattgcctgtctttgttttgtttgctcctgttccagataattctttctgcatcaaaacccatcttcctcccaccctcatttcctctgggctctgccaaacattcttattaacacagagaatcattattgatagggttacctaaattaaccttgaccatttcctttaactataaaatgggagtgataagaatacctgtatgatatattgttgtatggcttaaatgagataatagaaatgctgaaaaaaatacttgtcatatagcaagtatttacttactatgctgcatatcatgtaatcattccaaaagctaaaaaacaaaacaaaacaaaatgaaaagatagtttccttctggtcaacattgatagtaataggtaatatttatattacttagatactgtgtgaagcataatattttattaattattgccatgcccattttattgataaagaaactggagtataggaaatcaataataattttctgccatcacttctataatgcatttggagaggctttttggtcaattattgaagggactggatttataagttgctttagaccttctgattaagggtgagtgatgtcaccaatcacagcaatggaaagatcacttgctcttatcccttctaagtgctttcctgatagcgtcaccctcatctactattttgggaaagagggcaagaagtggaagaaaggagtgctgcatataaagccctgggagaaaattgaaagctggacctatgggttctctgattcctgagactataaatctctaggatttggggcaggaactgattctagctcaaaaccaagtctactagaactggctcactctgcccacctaaccctgtaggagggggctttaaacagttttgatgggggcaaacagtgaggacagaaaggtccatcacctggtcaagaacacagcatcattgctcttccctgggcattgagaacaggaggtctgtttgaaatggtaagatatatatcaaacccattcagtgggcacaactttctgtatccccagaatttcctgaaaacatctttattataagagcaagtttttccaataaaatctgcaaagattagttctatctgactcatgaaacccgcaaattcttccatcctcagagtctctagagtggtaactagcttgataaataaagaatctgggcctaggcatgggcagtagcaggaaagaaaggcagggcattaacttgaacctggatggggaaggcatggggatggtgagcagtggggtccctgagaagtgtgcacacatgaaggatgcaggagatattctccacgagttgctggaatggccaacagagatttgaatttcatatggaaagagggaggtagtgggaagttcagactcattgtggtgaatggttttcctgcagcagtggcaggtttttattttttattttttattgtttagttgtaaaaagacgactgcatctgttttgctcaccattgtcatggcagctactgcaggggaactactacataaacactgttggatggatgaatggatggtccatgtattcatccgtattcacactgctataaatatactacccgacactgagtaatttataaaggaaagaggtttaattggctcacagttccgcatggctggagaggcctcaggaaacttacaatcatggtggaaggggaagcaggcaccttcttcacaaggggcaggagagaaagaagtgcaagcagagaagatgccagacacttataaaaccatcaggtcctgtgagaactcactcactattgtgagaacagcatgggggaaactgctcccacgatccaaacacctccctctctccacacactgagagtacatgtccctccttcgacacatgtggattacaattggagattatatttgggtggggacacagagccaaaccatatcagtccatttcctgagagtctcctaaatcactttacgacatcccctgctatctggaaactctattctgatccacctgcaagcccccagacactatatagattatgtgacttaacactgaagctgatctcccaatgcctctttttgcaaggtacattatcttcatttaaaaatatccttcctacattccttgaggggttctaaatgccccagggcttttttcactgagcaggcctatggctggttaccccaggtcaacatgtaatggagggctcaacaagccatcctgtgaacctctttcctggaagcagggaagaggaatgaggcaggctgctatggagtagatcccttatctcctacctagaaggcatcttgcctattgcaaaggtttgaagcagtggctctcaggcctggttgcatattagaatcaactggggaacttttaaagtgcacagacttcaccctggaccatttaaatcagaatctctgggcacgaggctcaggcttcgttgtttttaaagcttcccaggtgaatcatttgtggtcagagttgaaagccaatgagtttttgttcttcaactctgctgcaattagaatcacatgggaaagttccaaaaaaaatctcaaagcccaggccacaccccatgccaattaaatcacaatatctggggtggggccaaggcatcagaattctgacaactccccagatgaccagtcaagttttagaataagtagtttaggagaaaacaaagatttatttctccttggtatgccaaatcactgttatttgctagttgaatgccaattaaaagcactgatttagacctttgaccaaaacaatcaaaatagtttcacacgtctaatgctcatacaagatccacaaataagcattagcaattaagcaagcagtagagagctaattaccttattttttatatctcgatttctagtcatcagaaataaataaaattagctattattgctttagtgctagatcctcacagcaatcttaggaagtagagaatattattccaattctacagatgaagaaattgatctttaaagaaattaaagaacttacccaatgttgcccagggcagaagagctggaatcaggatctgcactacagaataatgacaccaaagcccgggctctacttactacacttggctgcctttatttttcagagctgtattgaaatacaatttacataccgtaacactcaactttttaaagcatgtaatgatttctaaaaaatttaccgacttgtgcagccatcgctacatctagttttaaaacatttgtcactctcaaaagatcgcttgtgcccatttgactggcttttaaagaacatcggactaaaagtctgaaaacctgggttttactcccaaccctgtcatttacacagtactatgaccttgaagaattccttaaccttactgggtctccgtgtttttttaattagtcacttagagataataatttctgccagatgataaaggtcaaagaaaatattgcatagggaaatgctcgatacccaagagccgtaaaagtggaaaggacagcaatttttttttaaatatgcagaaagtcattttgcaccttccaagtaccttgggtctgaaatggcactgagagagttgcaataacacaaatctagctgtttctccctcctctgcattttccctctctaccaactctgtcatcccattcacggtgtctcacttacactcctttgggaggtcaaaatttgcactagccatcttagttgatgggggtgtacatccctttgtatcactggagtggtaatggacatgtacaggccagcgtaactcagagctctgcttgggttcttaggggcttagctgtccctggcagaagcctgatatgcccatatgctcctgtaatgactagctgtcagggagatgcatggtgtcctttcagcagaagaacacaaacagatgaggtgaactgtggtatttctctggctccttaattagcactctgatgggtgacaggaggcccaactggatgtgttccatcagggctgcaggggagtcaagccaaaggattatgatgttcatctatgtcccaaataaacagtcaatttggagccagtgttacatgcacacaacctgattttatttccattttttcatcctttgcctgagccagttttctaacttttggtagtggagactagaaacattctaagggtgtatcttcttcagccttataatttattctagcaaaggccattgataaatgttcactgaaatataaatagagcttgactcttcatgcaattgcttacctgttcctctttctccatcttgcagtatctgggtcttatctcctgtatagaaattctcagactttccgcctagcagctcaaagaccatcactgatttttgatgattcgcatgaaaaacattacatagttgcaattcgttcccctcaactgccctcgatctccatcactgctttttgatgacttcagtgatatcttatatagttgtgatttgctacacccccccactggtcctagtttagtggcccatctggcatgcagaggagatgagaaacttgtcttctgctcaaaggttaagggcacgcagagacagggaaatatggggaagaaggacctgtgatcttattgtgatgctgttgttactgcatcatttttaccagttttcccaataaagggtcaaggtctaagtcttaaattcaatagcataaattatatatattcagtggaagattccacactgatatttaaagttcgtttccacgatgttattgggcagctattatgtgtgaaacacagggggagggggtagacactgaagaatacacaaatctgataaacaaaaagctcaagtagcttagtataaagccaaggagagccagagcaccatatgtttatgaatataatggcatttctaagagtgcctcttgagttccagggcttgaatgatatgtgtgggtcttcctcatagatttggggttaagcaatccagctatttctcactgtcccagtagatctcttgctgaatcactggaacatggcatccacgtgggagaagtggtgcttcctcctcctatcaggcagatttcagtatccccagccacaataagaagcaggaacagacagctgcacagggaaaggcaatggtgatataaatacatgtttaattgcacatcaattacaattagttactaggctgcatttatttaaatgcagtgtaattagagcaaaaaccttgatttaatcataaccttatcaaacacagatcccgtcatcttcctgtgctcgcagtctgtgtttccctctgctcaattccaaggggaggggagatagcagaatccatttatggtagaggcctttgccaaggattctctcctcatctgggacccctgctcagatctgcagaggggttcatcgtgtcgtcttctctagcagctcctgatgagagggtctgattagctagaatgatttattgaaaatataactcatccctaatggcagcctttaaaacccgggagctcaagattagtaaggacattacatagcttcagcctccagagataaattactccttggaatgtaccctctcacagtccctatatctgatttctcatcagtgtggatgggctctgacttgacatttccgcaaaggggtggacagcaggcaggccgactgtctttcacagttagctccaggctatgtctttgtcctcctccctttctctttcattatctcctggcttctctgtccctgcctccccagaggctgagatgttatctgtgagttttttgaaggagaaagtcctctttctctgagtgtgcttagaagcagggctctattgtacccataacagcacaaatatccccaattgctgggaggtcttttcttcaatgatcttctccatggttactgggagataaaatggaaaaaaaccttatctacattttatggattggaaagtggaggtctagatctaagactaagctagcaaagacagactgacagaaataggcaaatgtctttgtgaagcaattatattgcttatggttccttcacacagttattccctacactttctgccaaacagaaacagatacatttctggaactttggtattgataaataaagtgcattgagcatccactctgcagcaggcactgtgtgtgcattgtccttcacagcaaagcacagtatagccaccattattatttccattccacagatgagaaaactgatgtgcaaaaaagttagttacctagcctgagtaacgcaatgaccactgttgtctgtggaacataagcttagagccagaactgcattacacgcttagatattttgtttcctcttattcttgcaacaaccctatggaccaggcatcactgtactatgctgactttgcaaatgaagcaaatgagctccaagtggtgaagctaatggcagacattttcatgactagagagtggtgaagcctagttttgtcccgaagtcccatgtgctctcttctgtgcctacctggtcttcttccagtggtcctacgtcccagctggtgacaccaccagccacttagctgcacaatccagaaacccagaccccagactgaaaacccctgtcacctgccacattgtttctatgaccaatttctgtacgttttatgtgcttaatccttctccggtttatccatcccccagccagcatgctgtccaggccaccattatctcctagttggattcagctattactgtccaactgggaaccctgtttctactatctattccctacgtgtcaaccacagtgaacttaaaaactgcaaatgtggtcatgtcactcactggctaaacccatccatcagcttcccatccttccagtaaaggccatgatctttctcatggcctgcgtctcttttcagtatgggattctcacccatcccatatctcgagcccacatccatgcctccttgctccagccatgtggccttctttcatctgttttcacatggtctctctcaaaacagaggcttttcccatgtgactccctctgcatagaatgctcttcacttcgccccacctgcctctacctggctaactattccttactttgaatctcaactcaaaagtgacctctttatggaggccttccccgacccttctgaatagatcagaacctcatatcatcacagagagtagtcatttgctgtttttatatactcatgtgactctttcattcagacctggctccgtactaggctctgagatgcaggagggcaaggacggtgtccgtctcatttaccaggacatccctggcccccaggatggcagcctgaacctagaaggtctcaataaatattcactggcatgatgagttaatccactccagtcggcctggaatccattctttcatttatttctctttggtgtcttctgcattccacaagctctttcccacatcccacaactgagtcttttctttcacaaatgttttcttggcactgtagttttgggctcttgcttttatgagcccttaccagaatttttctttctttccagaatagtctttctagtttctcttcttcactctgcccacgtaacaccttatatccactacacacaggctaagctcccctgataccacttttacaaatagtatgtaaggccatgctggggatacaatatctgtagcacagattcaacatacacctcctggagggggacatgttcagtgctataagagggtatcacagaaaagaaggcaaaagcttggaatggaaataaataattgctcagaagaagaagctagagtgaagaaaagtattggaaaattagatataatagggacttctaaaactcagtgtcatggggccttgtggaacatcactgggagtttaccagcccaaagcgttattcctttaacactatgctgggcacaggactaaatactggggccagagaaaaacaggagacagtttctgacttcaagcagttctcagttcacacctttcaggtggtgtgtgtgtgtgtgtgtgtgtgtgtgtgtgtgtaagggagcaggagactggtaactacaacatggtaattatcattcatccattcattcagcaaacattcacggacaacctattatgtccaggagactgttgtaagcactgagacataaatgtaagcaaagaaactaacccccttgctctctaagagcttacatgctcaggagggagttggggtaacagggacaggctcaagaacaaacataagtaaaatctacggaatgttggaaagtgctaactgtcatgaagaatcaggaaacttgggtggggtagggggatggagtgtgtacttgtatgtgaattaaggtggtctagataggtctaaaagactactgcatgtggactccagaccactgtgtctttcttatcaggccttcttctcagttgtattatctttaatccttgaaacaactctaaaagttaaatattattacctccaccttatggagaagaattagaacctcaaaaaaggctacttacctttcctaagctcatataccttccaaatggtaggacaaatgctcaagactaggctcaactgctgcccaagctcagcactagcctgttttgctgtgctgctgttatattagtgaaagcatgctccaaggcatatggaatagggaagagttaaccctaattattgcattggagaatgtttctcagaggaactaatatatgagtctagctgtgataaatccatagatggatgtttccagcacaactgatcaccctggatgccagaaacggctctagcctcaccctgggcaaggcacttcccacaggcagtgatgacctagacattcacatctgtgcaaaggatattcatgggcactaattgagcattagtgtgccaggtgctagggtgtaaacatgaacagggcagggccactgagctaaggtgaaaactcctcttttaataaaagaatgttgtcatcatatagaagtagtgtgaagttgagagtggcctttaaccctcttccccttaaatctatctcccatgaagagtactgtcccataaatccatgctacttgggatgctgtcctttgggttcaaaggttgctactatcaaagcttttagttttggtaaggcattctgctatctggacaaatgccattctgtaagggtgccgagaacacacggcttgtcacgagaggcttgaccagctgcagcaggtctggacgagtcgccttagaaatcatgaaggagagagtacataagaagtgttcatgtgtggtggggagcactcagaggcatgagtgcacatatggaagaagaatactcacacctcaacaccttggtattctagggacaatacatggctttggagtcagacatgcttgcttcctaattccatctctagagtttatcagctgtgtgaccttggacaacttaaagatactgtcgagtttgctatccaaagtgagatgatgagacttcccactgaggattgttagccagaggattaaatctgaagttgaaactagttgaacatgttcaggcatctgatcccaagttttgcctaggtctagtctgattcaataatgtctttttgctatactttaatgattgattttggggcggaatatctcaaagccctacgaacctaacttagtcattcaccgactgtaaaaacggtgaacttagggcaagttaccaagcctctctgagcctcagttttgtatctgtcaagggagggcaatgaagcctcccctgtaccatgttttaggattacaggagatgacgcatgcatggctctgagtttagtgcccagcacatggtgagttctgaatagactagacatagccattatcattattattgactataacaactacatcaagagagccagctccccttcattccttttgtgtcagaaatttgctttttctctttttctcctggaatatatatatatctctttatatataatttcatatatatatatttatatttatatacaatttcttcctctttcctaccagctgagaagtgagaaagagttaactgcagtcataaagcacagaggctgttcattagagcctgacttataaatgttttacactgccatccagacatgttggtactacacgactacaaattatgctttggtgccttgtcccgcagcaggggctgctgttcaacaatcaagcccaaggagcttatttttggtagttcctgccatcagtgatccttcctttcctctgtgagtaagtgtgtgtgtgtgtgtgtgtgtgtgtgcctatgaagatacacatgtgtctggatgagcacatgtttctatgtttctgaaaatgttaacagagccaccacctaccacagggaaatctatattctgcttgcacctatcatgggcagaaagcaataaggaggtgaaagaagttgagggagaggctttttgtttacctaccccttggcttctggctgctcttgtgcctccccagcccaggcagggggcagcagggatgtgggaagctgtgtcagtcttgcacctgccctagatcaatgcagttccaagtgatgggccttcttaaggaggtcgcaggggtctgttgatttcattgggtggatggaagggcactaatgaagttatttcacctttttccaagctcccaggcactcctgaaggtcactgctcccaaattttttctagggaattctgatccccattgaaggtatctattttctcttcagtttcattcaaaggtgtctatgatgcaccaaccataggcaataacatactgtctgggtgctgtggggaaagcaaaagtgaactagatatgatacctgccctcagagagcttgaaatccagcagctacaaatgatgatgttaacctgtattgagctcattcttcaatgtgctatgttctaaggactgtctcaagaacagtttctcatttaattctcaaaatcttttgagttaggttatgttattatccctattctattaatatgttcaatgaagttcaaaaaggtttagtaactattccgactacagggagctagaatatcaacattcagagcctggttttaaacattattatgagtgtgaccttggtaacttaaagttctctgttactcagttttcccgtttttacaattgcataatgatgttatctacttcacagagctgttgtaaggataaaacaatatattaggtatttaatatgtgctggcatatagtgaggacaccaaaaatgttagctgttttttaaaacattgcctcatcaatgtcctcagtatgccacccatactcctgagaagagactgatgtgtttgaaatgtccaaccctaaagtatttatttgtattcatgggttaattgtcaggtttatccacaaagtcaaaccaactatatgtcatcagctatcacaaaaaataaacgcaattctgaagatagcaatagctcatagacatcaggtcaaatctgcaaagatgagcattgtcctaggtgctaaggatactgcaattaagagtctacatggaacttcagatttagaaaaactagggttggaatcttgctccctgttccttctgcttgtgtactcttgtccaagctaccaacctctatagcattgctttctcattttatgaaattggaataacaacagtacctacttcttagaatcatttggggttaagtgacatgaaaaacacaaaccatagtctctacgcagagtaactgcttgaggaatgttacttataggtcattgggaaagtgtattgcacagagaaccagcatttataggcagaacacataaattataacttacttaaaaatctacaacacaacaaaactacaagattagtattactgataagtcctacagataaggctgctcaaattgtttatgatattagcccaagggtgcacacctataagattggatatttaatctgaatttgtatatccttaattcaaagttaatgttcttttcagccaggcatggtggctcatgcctgtaatcccagcactttgggaggccgaggcgggcggatcgcctgaggtcaggagttcgagaccagcctggccaacatggtggaaacccacctctactaataatacaaaaaattagccgggcgtgatgacatatgcctgtagtcccagctactcggagggctgacgcaggagactcacttgacctgggaggcaaaggtcacagtgagctgagatcgcgccattgcactccagcctggttgacagaacgagactccatctccaaacaaaaacaaaaacaaatacgaatacaaaaacaaagttctttttaccattttggccacaagcatttacgtaacagctattggttgtgctgaggatatacatacacgaggacatctatgaaattatcagaagaggaaagcaagaaggtggatgtggaaaatgcactatgtaaggaaaagagtcctacattaattggaccaaacatggtagctagaaacacaggtacttgctgatgaatatgggcaaaaactgtgagaggatggacaaatgatttgccaataggcttgctgagggtagaattagcagtccagggaagcacgtgctaccatgctgcaggaggtaaattactctactcactagttagaggttcgaaaacaattagagagatagattccatgcgtataaatagaaagagcatgtggatatatgggtgctgcatggtgatagataatgccatagataaatactggagctggaaaggcatatagagactccggataaatgattcctataaataagaattgctcatagatatttcagatgcttctctatttatgaacatttgacattcacccctaaggaactgcatatttcctcatcaaagagaaaggcaaccgtgaagccaatgactggatgtctgattagagctttcagcattcacaccgtgtgagcagctgcaactgtgactcaggctctagattcaagcccttgaggcctaatggatgtctcatccacagcatggccaggaagccacagtaatcgctgcctgagaaagctcaccaccagtgcctgttactgggctcagttttctttggaaaaaaaaaaaaaagccctcattttcccttgctgtgataagtaagagaagtcaccatctcttgcttgaggcaaaggatttggtctgggtaggtattgggaagtgttcctattgtttattagatgggactttccctgtgagtagcaagcatttcatattgtaaatgttggaacattctgtatggatcatgggcataacaaagtaataatagcagaaatgtgatcatatctgtgcaacagcttctaaaggaaaacacatgggttctgaagtcagatggaccagaaactgtgtgatactaaagaagttacataattaattgtccttagtcttaaaatggggattataagaaccatttcataggtttgttacgtgaagtagatgttatagtctacacaaactacttagcctagcacctgggggatggtagggtttcaacaaaaggtaattgatacaattattaacaatgaccagaacagcaaagtcccacctgcttgtccccagtgaaggcatacttgtgtgcacagcactttttactacttaggtagcacagctttgcataaaaacagaagccaaaacacctctgaaatagctgccagaggctctttctcttgagttgaatgtaagaaagaaggcatacttgctccctaggtcagcctgacctgcttgaaaacataatccaagcccagagggacaccagagcctatggctgtgagttgtagaaataaatattaaacagcactctgatttctagttatttttccactaacttgcattgactcataggaaaataccttgaagccttgagttttcccatctaccaaaaaatgtattgaaagttcgctttactcaggcacgattgtaagtactttttgcattagttcatatcacactattagtaatcttatgagttaagagaattttaataccttcatgtcatagataagaaaatggatatgcagagttgaagcaacttggctatggtaattggtattagagctgagagtaaatcctgggtcatcttactccagagcttgccttcatactactctactaagctacctccaccaaaatcaagatgttgatctcactgaagctttaagctccatcttaactacaaatgtcatgactctttcatgaatgttttatagcaggaaggcatcaggaaattaagtcactggcatagacttagtggagcattcaacaaacacgtgttcaaagagcctaccaggagctaggcgtcaggagttacgatgcacaatcaacggtgcagcaagtcgccctggatttcataccactgtgctatggatgtctatgaaagcattctgcaatcagtcttattggttggaatatgatgtagcaaaaacaaccctaaactctctccatattttgatttttcagagcacttatcacaataaaaaatcattacgtttgttttcttgcttattgccttctttccctttaccatcctgatgggaatatttgttctccctggagcaggggtcttgttgacttgttcgctgtagaatccctggtacccctaagagtgctgatccatcgtgggagttacataaatagctgttgggtgaacggtgaatgaacacaacaacaataaaccctagtataacactttacatcatttcactgaagtttaggaaatgcttgcagatacaatattcaatttgatattcatcgacagccctgtgggagagctaacttgcattcctcattttatagaagaggaatcagaaaaatcaaagaggttatttgaattatccaaagtcacaagtgtgaaaactgcaaccattttgactcaaagccccacgttttgtattctgcaagtttgcaaatgaaactgtgacaacattttggaggtaccctttgttgaaactgagcacttcagaaacacaggcccttggcataattggaccggaggagtgaatataggcagaaagaatcaacttctgccttctcagttgtatgatagtcctaaagaaaatggacagtataaatagtttaagcggatgacaagtttagataaaccatgtttcattttcttaactcagtataactgagagaaaaatcccatgtctgcagagctaatcgttccattttcttcccaaagcacaaccttagcttcatccactaacacctgatgtcacagcatgttataactcagcagagtgctatacactgtgtcaacctgcgccttcattttttcccagtccctcatctgaagtaaatggagtctatgtttagcctatctgtgttcagatcctagctctccctcttcctttctctgcagctttgggatgagtagctttaactccctgtgcttcaatccttcacaggtttatgagaagattaaatgagttaatgcatatgaagtgtttagttctaggtctggcatataaccaagtgcttggtatcttttagctgttatcattatcattttcattatcattctaacatccagatgaccttgcctcagccatctttcccttccccccaagttgcactgtaagaaacatctttgtcatctactctgccattctttttggctcccttctaaattctcaaaccacaatttcctttcatcataactctgaatataaaaataagatcatttttcttctcataactggattatgactcaaaataaacattccattgaaggaattagaaaagtcatcttgacaaatgaaggacaatgggtattttaatagtgaccattatcattgcctatataccatttcctcaggtactattcttgaattgttggttggacttcagttccattgatggcctgagccatatttacttcatgtcgctatggcattgatcacaccctcaaaggaggtatgcaaactgtgatcttgtttctgtgacaaaaccaggttgggggaatgatggttaatacaacagtcatctacttcttgcataagtctttcagaaaacaattattgagcacctactctttcccaaaggaggcatttttctagatgctggcaaatcaacaataaatagaatactacctctggccgggtgtggtggctcaagcctgtaatcccagcattttggagggctgaggaaggcagatcacttgaggtcagaagttcaagaccagcctggccaacatggtaaaaccccgtctctactaaaaacacaaaaattagctaggcatggtggtacatgcctgtagtcccagctactcagggctgaggcaggagaattgcttgaacctgggaggcagaggttgcagtgagctgaggacagagcaagactccatctcaagcatttgttaaatagaactatgcttagtccactatttgcccatctgacagagactgtagaagtcagaaaagcttcccagagaagagagtatcagtagagcatttgcaagaatggattgaagttaggcaagatgcagaacagaggtcccatttgattaactaatgtctgcaagggcatgagttgagatggtgagacactcctaggagacatctatcatatcagtgtggctgtggcatggagtttgggagtggagtgagtaatgaggaagaagaggggtcatgtcataaacacacttgcatctcatgctgtcaggacttaagctttatccttttcttgggggtgggggaattgtatttcacaatcataaatggtaggtacaattatagaactcattgaaggtttactcagccctcattttttttctttacccacgttggtcacagcataacacttccctcaaaaccacacttgatgtgctggtacttcaattttccttttgccaagagttgacattatgctaactttacattttacaaatcaactcacctactaggtaggagagaataactttctgcgttttgtggtacatgtttccacttactgcttgccccgaggatgagggattctgtatgtggcaggagtgaaaacaacagtttttttaaaaaattaagcattaaattacactggacgtgtttaattttgttttcagtaatgggctttgatgctttggtgaagactcattgtgttatacttgaaatagaaacatgtcatgtgagtgaacctgtgaggcggggagaacaataaaatggcaaaatgcacccggactaggtggggcttatagtgctagatattttaggctcaattttattgttcatggcactgtgcaaaaataaatagacatttaaaagaagtaggatatatgttggtatgaaagcagagggaaatcaattagcagctgtaacttaaagctgaggaaatggataggattgactttaaagatctgaggtactaatttgtctccttaaatgcaaatttctaagtttatccatggccgtccaatatacagatatcccaatgaacccagattattttataatagggaataaaggaaatagcaatcgttacagagaggtgagcccttattttggtgtttcataaatgcctgaatccagatcatatattggggccatgatccaagagatgtcagattgtgtatattttacagtttttcaaaataaggaattatcaatgtggctaatccggtctgtgagaggtcaggatgtaacatcagatgaagttgaacatcggtcatcaggtagagttgaagacacatgaaacgtacatgaaaaaaaacatgaaaaaataggcaagaagcaaaggaacagccatggacgtagagtgaagatgatttggtttaatgggtcacaagaaaagcttcaaaccctgtgaggtcgccagaggactattcatatgtggcactaactgtatagcacaaagcttgcatatagctaaccaagccacacaagactgtaacctcttgggtctttctagatgagaagtcttgtttatatagcaattagaaaatcctttatgacttttagcaccaagctaagggaattctttcaggtttagtgactagaaatcatggaagaaatgtccacttccccacaagggtgttgcacaagggacacattcaactatcacataattctaagtactttcgaatctagtggtttaaaactagaaattaatgctttaaaaacataggcgtgtaaagcattcgtgaagaggatgttgtaacgaaatatgactatctagaacgacattaaactgatttccactcaccctgggaattcattaaagagaaaatcttcattctgtgacttcgcactgtctggtttatatctgggcttatgtccaacaaaactactaaaaagtaaggcctgtgaaccactagtagatattggtggggtgacagaaattaatggaattgtgacatgcaacatgttgaaaaaataaaaagcaatctcaaaattggaaaaaaatagaatagaaacaacgggtatgaattaaactgcctgtgcttttagtagaagataatgaaagaaagtggcacgtccaccttggcttacagctaggacattcccaattcaaggcctttaaatcaacagcttcaaggaccaagcaaaggcatcattttgaaagaatttttagggcatttatatactagctgtcaactgccttggtggcagggtgataaatgcttctgaatttgagttaagcagactaaactctatgaaactgtgcttgcacaactgataaactgtctaatggtcaattctccaaaattcccactgggtaagacagagaggtgtgtcaggggaaaagctagcatggaggtgggagatagagacacaagtatgcaaaagccaccccccaccgtgtcttcccagtggtccacgtgatgcccacccctgaatgcacaatggcacagctgctcccacccaccacagagaatccagctgcaggtctctcctcctctctgcctcagagccgctcaacatccttggattaataatcatggtcattttcagggctttggtttccttccttagcaataaacatgtagatgttttaatctaagatatggtaaagctaaatgacacactagtgttcaacttccttagagaagaacttggggcacagtctagaagtcatgaggggcatatttcataggatgtctatttagaccctgtagatccgatatgtggataaagcctagagacagagaagaaagtgttaccaaactttgcttgacttgattctagacaaatgcttcctaataatagtaatgataaaataacaataataattattataaccatccctactaccccaactattacacatgctgacaaggagggccatgtaccaagcccttggctaagtacttcacataccttatcccaagtggcccaagtctaagcttgatcatctcttgagatcctttctaccttaagtcattaaattgaattctcattttcctaggaagcttatgaggagacaagcatcattttgttacttgacagtacctggttgcttacctggacttatgtccagcagagctgcaaaataggctaatccattgcccgcaagtttccattttgaaaccattgcatcaaagtcatatctccctccttccttcgactgcatcaccccacttctatttagactgcagggcctttcagaccccctattctaacacacagataaccttgattagaagagattcatgtttataattgaacaacatgaactttctagttaaattgtcttaagatcatctaattggaaaaggaaagaaaagggaactaatttatagccactaatacttaatgctttatatagactaagagaaatactttatctctatttttcatcctcagtttacaagggagaaatctgaggctttgagaatttaagtcacatcttgaaggtcaaataatgagtaagtggcaaagtcaggatttaagcttttccatttcctctttctgcctcagaaataacatttaaaagagaatccatagcctgcatccaactgtggcaagaaaaaagtaaagcatactgcaaaaaaaaaaaaaaaaaaaaaaaaaaaaaaaaaaaaaaaaaagaagaaacaaacacagcaaaagccctttccctttggcatttaaacattgcttgtgtgaaaacatgaggatgaaaattgtacacatgcttacatgagcaaaaatattcctgggagccttgagatttatttcagacatatttcaaatagatatatggaaagcaagaaaggagcagagaaaaaaaaggcatctgatgaataaatgagtgggagaaatcatgaggaaaagagatgcagtgtaatcatggccctgatttctttcaggataaacgggcttgctggtgctgtctatactataggggatacatcatatgtactgagattactatttcatcaaagatgatattggatctgatctttcagtttggccagttggctacagaaacaacattggaattttccaaacaaaattttagctcaagggaatatctaaagtacagattccttagtcgacttgacagagagattgggctagcttgcctttggtgcccagcaactaactgcttagggatagtaactcttatctgtcgctcactatctccctcaacccacatgatgccttcctgttggaaacattccatgaaattagacaaacttatctgagtgacttagccaggaagccagcttaagaaaccaaatcagaaaagccgttgtcattttgcttcctttcttcctcatgatttgtgggtaggagatgggaacagaaaggaaattgtctccagtatccatgatccctagagacatccatctgtcagatatggggcttgctatttcaaagggagtatctatctgcagagaccctcaaaaggatcaagcttgacctcaacctgtcaacctgacaactgtttcaataggaagcccagataccttcacaaaacaagcctaaatgaactccttgacctgccatgagtcatagttttattagatctctgtagtatcattagatctctatagactaaacacacagaatccccttccctcattctcccttcccacatgctctttggcaaaaggctgccactcctgtggtctggatcctcaggctctctcctccttctaccgacttttctccttcctcactctgttcactaagccttaagatggttaactgcctcattgcctcagacttggggtcccctggcctcttccaatggttggatgctttggttcatcttcaggtttttattctggtattgcatacaccgggactgttgggtcacctctaccttcacgctcttcaaaataacacagctctgacttccttccacacctaccatcttggctccaagaactccggagacctacttgtgccaaaagagtttttgggacaacactactttgtctttctacatcatccctcaaatgaaaataaaatgattggttgaattatttatttgaatgattgtcacttgacacatttagctttaaaatacagttacatttagaaaatactttggtacatatgttcacatctgatactacaaaaaccctgtggtattcatatctccattttctcattcagatgagaaaatgctttaagtgatgctgaaatgaatttcacaaattcctatcgatcaacagaagcatatctagaactcaaacacagagcagattccaatgcagttgtgcagccccacgcacacgtgggagctctgtcaggacagctgtagtagtcagatggctgggacagaagagcttgtcgcataaatcacaagcagtgcctgtgaattctcatcaggtccccttgcattttcctccttaatagattttatgaagtcaaataggcaacatttcattgtttcaggtggagaaaattgagacacaagctgatgaaacaatttgaaaatagaagccctgagtcctgaatcttagaccaagttttcctccttcataaattaatgtattgaattctgccgctaatggtattgcaaacccgcttactattattgcagagaaaaatctaaaaatatagacaagaggccgtgggtgcagtggcccacacctgtaatcccagcactttgggaggctgaggtaggcagaacacaaggtcaggagttcgagaccagcctggccaatgtggtgaaaccctgtctctactaaaaatagaaaaaaattagctgggtatggtagtgtgcacctgtagtcccagctactcaggaggctgaggcaggagaatcgcttgaacctgggaggcagaggttacagtgagctgagatagagccactgcactccagcctgggcgacagagtgagactccgtctataaataaataaataaaaagaaagtactttctatgccagttacaaatccataatgatatgtttagcaatcctgttttttatttatcctttccttctcagaaattcaatagcagacttagttatatatacacagccaatgtgaagacacttattctcaaacatgcaaatgttatacacgtcatcttgcttccctctacctattgtcagccttcagtcacagtgtctaccagacaagtcatttctaattagagaggaatctggcatctgtctttgtgattatactctttcagctccaatttgctgccaaaccccaggtctccacaggtgggaactgaagaaaaaaagcatttttcactggtggtttcttttcaaaggtaaagttttcatctctgcaggagcaattaatttttcctgtttaaaatgacagacaaaagtcttatcttttgcttttcacttgaagagcttggggaaggcagtgtgggagcaaaggcatgttggtttttcctatttccctgctgagccagatgagttgatttctgagcaaattctcggtattatataaaggggttagtaatctggttagataccattgaatgccataagatattaataatgagaataaaaattttaagaatcgacttttgttcagcgctttcaaagatgtttgaaaaatctccactccacaatgataatgtccagttttcttccctgatacaatctgaaagtttttgtccccatgaaagacttacatattgaaattccaggccccaagttgatggtatggagaggtagaacctttggggagtggggccttcatgaatgagattagtgcccgtataacagaggccctagagcaatcctttgcccattccaccatgttaggacacagctagatggtgccatttatgaatcaggatatgagccctcaccaaacaccacatcttatcttggacttttcagcctccagaattgtgagaagtaaatctctgttgtttaataagcaccccaatttatggtattttgctattgctatctgaacagactaagaaactaaatattactacctcttttggtggtagtaatattttttgccttcagcataatagaaactatagaatggaactcaagatacaatagtctttatgatcttaacagtagtagttataatagaaagaacagtggacttggaggcaagacctaggttcaaaacttggctctattacctattaagcctgtgagtcatttactatatcttttctcagtttttaaatctctgtaatggggacaatacttcccataaccacctgacacatatgaggtgagggtcaagtctgattcagctatggaagtgctttgttaatcataaaacctaatataactgcctgcattatttcctataatatcatgaaaaaggcttctatggagagccaaaattatgtcaatattttccaatccattccacagggcatggtaactgtcccaagagttgcttaaataaaagaaaaaaataaaaactatctagacagtcagatttttaagaaaaattatggtgctatgcttctcaacttcaattactttatgtgcaaaatgtagtaaaaggacctgccccaagattgttgtgggtgggacacacacacacacacacacacacacaccctggggccagtaacctatgcataataaatactaaattatgttcgtttctccccattacactgttgagagcctcacccactctggctcccttctagtttgagcaaaggccctggttcttattgaaggagtaccagagtgggtacctgagcccctgccacagcacctgggaaataacagctgctagttgagcaccagatgatccagagttaggaaaatccctctatgtggagtaaggcacaggaggaagaagaaatggggacattctttgttcccctcactgacctgggattaacctttagaacagaatttctcaaatacttttaaatgtaaccccatattatgagtactttttatgcagtggcccagtatatataaagagcacaacacatatgaaccagacatatgctactttctattcctttaatcctattacttttaaaaataggattttaggacacactaattggtagcagtccaacagttcaaaaatgccactgtagaaggtctcccggcatgacctccaacctcataacttttctgggcactccctaaggtgtgcccttagggacctgacaagtgacaaactgactattaattgttttgcagttcagaaaacaaagagatcataaccaggaccatgggtttagaggagctaaaaaatacagaacagaaaaaaatataacttgtttttcttagatgctttgttcatgacccccagagaaaacgtgtcacaatttctcttccctgtaaatgctaagaatcttttaataacaataaaagggtgaaatccatcttaggccccccacaccctgctcagggcaggcacttcatcatgctctgccactgtcaccataaataagatctaggtcttacaaatgtgtctgctacctgggacaagcccagagccagatcacatcttactatccagaacgtggttgacaaatgtaccagtttcccttagacacacagcatattccttgctgcagtgtaattggattttttttaaaaaactttttactagaagattccatagaagaggaacagatgagtgagcggttgggatcagcgttgagcctcataactttctcttcagtgtctgacttgcatctgttcaagtaggtctgttttattaatgcttactggcctacagctatagccataatattaaagatacaatgttagcacagcactgacacatagattgttttccataggaaagaaattaatgtttgcataggatattgaacccctggctttcctccaactttctggcctccatgttcaaaggctggattaaagatacagattacaaaggggctcctattaccattgagaatggggtagagatcaatgaaagttaaccattacgaatggggtagagatctgtgaaaattaaccattaagaatgggatagagatcaatgaaagctagactaggggtctaaggctgagataccacctcacctcaatgtgagaccagacttcctctgcattgatcaatcctcaagcatcaggtaatccatatggactagcaggtacttggtaaagaaggaaacaaagtgatcccttgactcataaaacatccaaacagctttgtcaggcaggtggcagaatttcatttgtcataaatgctggggtccttttgtcactaagaataagagaatgtagccacctcaagtttgatcgaggccaacatttatgctcaaaatattgtagggtggaacatttaaattcagtttctacatagctgccatcctgtataccaaggactctgaaaccccagcccaggaggcccttctaagcagatgagaacaatgagagtctcaaacacaagggaaggcgggggttgaatgggaaggtcacaacccagtaacctggtctgtgcttcggggcaggactccagacagatgaatagagagggccttagaaaccagaggccaggtggagggaaagctgcaccgatggagggcattcagaattgggagccaggggactggaggtgatactgctgctgactccccgagatgttcagactagatgctgctgataaaagaaaactgactcctcaggaactccctctcctgcgggaacaagttcctcttgggattggttgccatgagttctgggtcagagggagattagtctgtggctgaccagcctgattatggttttcttctggagctgggcttggcaaagttattctgcaaagagtagtaagtatttttagctttgtaggccataggctctgtcttgctatcattcaactctgcccttgtagcacaaaagcagccacagacaatacatgaacactgggtatggctgcattccaaaacaagaaaatatatatttacaaaaacaggcagtgggccagatttgccttgcagaatgtagttggctgagcacgtgtactttgggctccctaagtcctggtttcctcatttctaaaatggaataatgatacctatctctagggttgttgaaaggtttgaatgaatggatgcatgctaatcctgcagcattatgcgtggcacaataataaaaataacaatagcaatacaatccgtattgtcattattattattttcccattcctggtctaggaaaaagcattcagagatcaattctgcccactcatctcactcactgcacttaatgagctctcttctcagatccatataagatagggtatatgggtcaattatcaaattccaacctttctctgttcaaatgcataaaagccccataaccaatccctgcccactcttcctgtgctcactgagatcttgtctagctcattcttctgcaggcatcctggctgccactcaacaatggacttactaagaaaacctgagtcatagtaccccaacctggatggaaagagtatgacaggtgcccagccctgccccattttctaagtggatagcaccaaactgaagggattgctaaacagtgtgtcactagtcttggccggcatgctcttccatgcagaagagattgggcagataaccatctcttctggaggatattaagttgtgttcttggagatgagaggatgaactcagttgacctcttaggacagactttcttgtcaaaggatacttggaatctctccttcctgttaccgctggggaagggataagtagaaggtaatgaagcatgagcctcccctacaggaaggaaacacactaggcatctccaagtccagttagaactttgccatccactgtaagcaggctcaccctctgaccctgggagacaatgagatttatctatatcttgtaaccatcagtgattagaaacacatccagacaaagaagcccaagggacacttactgctccataatttaacagcttctctccggacactcctttggattatttaaattgcatttttttccaagataccgtgacctccccatctcatgaagtgtgtttaccaaccttcttctctcttctcacattcttctttctccctaaggtcaaagctaaaaatggtgacatttctaatgacacatgtctgtgttttaaaacggagttacccccatcatggataacccagcctccacatccacctcatgttgatgttgaggaaaaacaaagaacactggaaagtgtaaactgcgtctgttctggaacagaaaatacctccaagagggactgatttccacatggagtttagtagctcagcgatgccacccacaaaagcagatcctgtgtttgcttttgtgtcatgagactctggagacagaatgaagacatgcttttatgcatgcagtatgattttgtgattagggttttgttcctgggctgggcttgacaaagttcttctgcaaagagtagtaaatattttaatctttgcaagtcatagggtctgtcttgctatcattcaactctgcccttgtagcacaaaggcagccacagacaatacaatgggcatggctgcattccaaaacaaaacctttgtttacaaaaacaggcagtgggccagatttatgttgcagaatgtagttggctgacacctgttctggagaaaaatactcttttctccacaaggccatccctcctatccatcaagcttcttgttcatggcccagtgcgggtgctcctcggtacttctattttcctcctttctccttcgcttttctttctctgctcctttctttgtttctctcttctatatcttcaatctctttctgtttttcttgtaaagcacttgcccaccacattgtaatgtaatcatctgcacccagatctgtcctctactggacttccttaaggctctgtttctgagagtttgtagttttctgcaatgctttataggcagtaggtgctcgttcaatgttagctaatcagcctgctcaactgggacattttactccttttcctgaatgcctggtcttcctcccataacctccacagcagctgtgtttcaggagcagctcctcctctctgtttggagctctcagtgttggaggaacagccactgggatgggattctctgagtccaggaaccttcagcagctggtccccgcctgaagagagagctgctgttccagttcacagcacacctggttgtgacaggagaacaaaggagccctggcaggagcatgagtcagaccaagagggggcgaaagccttttggtgaaggtcccagaaggcagaagtcttttcatagggctcgggtcagaggtgttccacccaagaggatgtctggcaggtggcagcttcctttctgcactcttgccccattcatcctctctttggccctcatctcttcaagagaaggactccttcctcctgttttgcaaaatgactaattttcatttatgccaatctagttgacagacccaggtcaacgcagggctaaggtaagtgtctgacttcacaagcccctggggcagcagctcctctgatggttataaagagctgctcaggggatgttgggcctccccacatggtctttttttgggaaagaacttacctgctgagtgtgcatcttagaggcctgctgtgcttttggctccagaaatggtgtcatctggggcttggcctgagtccaggttgctcttggtctccttcagtgagacatttccccctcccactcctccttgccctcttgctagtttcacagatgcaccaacacatccatttttaatctgaccaaatcaattacaaatgttacagattgtaattaccgaaggaactcccaaaaactaattatgtaatatgcaatccccacaataaattacacctttcctttggcttgatgttccagaaaactgttttctgaggaggcagagaaagtgttgctcatctctgccagggatgctcacgaaacggctctttatttagctccgctgcatgtttgtgggtgtttgtcagaggtggccacaggcttcgtgccagggctctgggcagcagccacatcatcttttgccaccataggggatgttgccagaatacccatgggaccatgtcttcttgtcattccaccaccaagagaaacttcagtttccttgggcaaaaatctgggagttctggtaacggaaagcaaatagcagatgcaggagatgcttaaaaaggaaagagaagcaatgtgttaaccttggcctgagactagtggagtcctgttaagtgatggatcactagagcgttcctcagcaacagtgcctgtcagagaagaaatccagagccgacatttacatttttcttttcttgttttcttttcactatcatcagacaatggaatctccgagcttgctgaatctcagctttaggtaccaataaaggctttccttgacctaaatgcatttgaaaatcacactataaaattatgtcagtgataaagtaagaaattcactcatttagaggactcatagcctcagagttgcagacccttcactgggagctgccattcatgtgaaatgctattcataactcttaataaaataatcaggattaaaggggaaacagggagcaaacttgtaaacatctcaggcatggagcaggggatggagaagtttaggaacaattgcttatgtcaggagggccaaggaaggctgacagaaaagaaaacgttctttgagtctcaatagtagtgagagggttcccagtgaggagtgagcttggggtttttcctgtgtgtctatgtatgcacgggggtggtatgtgtatgtggcagtgactatgtgtgcatatacatgtgcacatgcagatgtgaattgtgtgcatgtgtgtatgcatgtgtgtggatgtgagtgggtgtggatgtgagtgtgtacatgtgtgcatttctgcatttgtatatgtgttgctgggtatgggtgtgtgtgcatatgtatgtgggtgtacatgtgtgtatatgcctctgtgtgtgtgtgcacgtgtgtgtgtgtatagggacatcaaaacacacaagataagaaccctttactcttctcctgcagccttggcctttacttccctgttacagcctccgtggttcttactgtagattcccattgaactgaccgcctcctctcctaggagggccaggggagggggcgtctgtgtgttcttcaggtgcacacccagccctgagcctgcctcctggtaagtgctagctcagtgtctgcagagcggtggaactgcaccccacactgatgggatgggggacagttagtgtgcatggcgggcagttctcatctcacctccttcctcaccagacatgctaagttccattttgcaacatggggagtctaggttttgtcacttgttttttgagcatttgtttttaagacagaaatgcaattttttgaattagcatggacccaattctggcatatagaataaagtctatagaaatctgaagaaacttttcttttttcaaaattcttgacatcggaagaaacctcgtggaatgctctcagtgtcttttactgcaaacctccacatcctcctggtgattctcacgttctcgcctctcatgtccacttggtaatctgtcattttagtttggaaatgattcaggaacctactcaatctctctttgtaaagctgcttttatgaaaacagtcattcctccttgcctgtgtcaccacaaaattgctagcttggtttctttttccatttcccttatttcattctgtacaccttgccgaggttactgtattactctgtcttgtactggtataaagaaatacctttacatggccaggggaggaggaagatggcagagggggtagtgctatttatttatttatttaagatagggtctcactgtgtcacgcaggctggagtgcagtggggtgctctcagctcactgcaacctccgcctcccgggttttaagcaattctcctgcctcagcctcccaagtagctgggattacagctgtgtgccaccacgcccgactaatttttgtatttttagtagagatggagttttgccatgtgggctaggcttacatacttttaaataaacagatctcatgagaactcactcactaggtagtaccaaaaggggatggtggtaaaccatgagaaactgtccccacgatccaatcgcctcccaccagcgcccacctccaacactggggattataactgaacatgagatttggtggggacacaaatgcaaaccatatcggttacctttcagtaagaagatctacttgcattaaatgggaaactatgaaattgcccgtatccaacctctcttgacctgcaaaaattcgcggtctaacacaggtcaccatgacacggctacctagttctcgagtctgtgttggcctctcatgacaatggttttttgagaagaacttgctgtactttgtttcctaatcacttcctcagaattaaataagtggggtggtatccaaaatctcacgtcccatcgatgtcatttgctgggtaaccaacagtgaagatcagatatttacctctgaaatgcgatgttcaaatcaaataataaaacatctctatgtacacattttatgcctctttgtaatatcaattgaattctatcctttctgaagtcactacaccatttctcccagtaaaaaattgtctgccaaatctgagttggttctgacactactaattttgagttgagtgaccttagataaatcactcacctttttaagcttcactgtttttcatataaaatttagatatattaataatagttaaccaactgggcttgtctgaaaattaaagtaaaagtgcatataaaatggtctgtagggttatttgcacctactaagttctccatggagttgagttggcattatttttctggatcaattcaaggccaactctgtttggatcagtcttgtctggaccctttctgatactctgtaactaaacgacaactcactggaggcattttctctaaatcctcctaagtctgagaggagagagaggtctttattaaaaaaactagacaggaacctaatggaaatcttttctctcttttctttttaaaaacatatttccaatgaaaatagtactagaattttcttacacttacataagtttatgtggagaaatttcaaacagatttttaaaatatgagtgattcttgccagagatgtgaattgtgaaatgaatttagaggagttgcagagttgcttggtagttagtattcttcactttactttatgagaaaatattggtattgcattaagtttttaatagcacatctaattatatcctcattaatagatgtcaaatattattatttaaaacattgcttccattaattatgttttttaaattaaacagctaattttgaacaagttatatttaaataattacatctaatgctaataaaatggagtgtgcttcagcatcttctttagaaacacaacataaaatgacctgtaaaattaagtctgattttctttccttggctaaccagctcctcagcttcaggcctccctcttcctagcttcaagtcccaccagaatccacacacagcttacacttccaacaccagcattcgctgtgcacactatggtctcccataatgcaggattttgtgtgtgtgagtcttctccctgtagtgtccattctttgcttctgaacctggagaaaatctcacgtgttcctctttagagacacctttcctgcctccccctgacagagttactgattccatctgctgagctcctagggtgcattgcctgttcctctgctagaacattcaccaaactctaccgtaattgatctccaagcccatctcgccccgactccactcctaggctcttttctattcctgtgcccagtaatatccctagcacatggtaggtaggtggaagaaaggttgcttttctttccttcttccattttttttctaaattaatgaatagataaataaaatttgtagactaatgatatatgtttgttgaatgaatggataaattaaatgaattagtgactgtaagaattttagtgcatttaggatttatatggcctaggcacactgggtaacaaatcagaaccagaatatgtatacagtagtccctcctttccatgagggataagttctacgaccccccagtggatgcctgaaactgcagatagtactgaactctatatatactatgcactaattgtttttcttctgagacccatggatagaatattcatccttaccatagatcttagaaacttcagcatatcttttctttcctcattaagttgagaactttcaccttttgaccttactactactcttggcacatcagaatcaccagcaacactattattgcactttggggccattattaagtccaacaaaggttacttgaacataagtacttcaacataatgacaatggatctggtaaccaggatggctgagtgactaatgggcagaatgggcaggtagtatacacagggtgggttccctggacaaagggaggattcatgttcaggccaggatggagtgggacgacacaagatctcatcacgctacacagacctgtgcactatttaaaacttacgatttgtttattcctggaattttccattcattgtttttggaccgaggttgacctcatgtaactgaaaccctggaaagtgaaactgtagataaaaggagactactgcattttaaaataaaaaagttaaaaacaaactataggctgggtgcagtggctcacggctataataccagcctttgggaggccgaggcaggcagatcacttcagttcaggagttggagaccagcctggacaacatggtgaaacccttcctctaccaaaaataccaaaatcagccagatctggtggtgtgcacctgtaatcccagctactctggaggctgacgtgggagaaccgcttgaacctgggaagcagaggctggagtgagctgagattgcaccactgcactccagcctgggtgatagagccagaccttgtgtcaaaaacaaacaaactataaagcaatgccattgagtaaaatgaggtaatttatttaaagtgtctcacaaaatgcctctcagcgagctctcggatacggaagatgtgctttactgtgcattgtgcttcttctcatggttgctgtgttgttcagtaattagtaaataaaaaagaactacctaatagaacatatgctaccagatgatgctgaaacatctattttacaatgctatttttatttacatttaaaaagcttttgaaataaattataatatataacctagtttaattatatataatgtgtaaaataactttacatacatatactgttctttgttatgattcttataatacaatatcatggttttgttaagtatattaattcactcctttcttataccaagttgctgtaacatattatgcattatcttaaattattttataatattgtatgtggcatatagtaatgaaattactatagaactgaatgtgggataaattcaaatttgtttatcagattggggtaacctccctctgaaggtactgacagctttcgctcacacatcttgtgaaaagacaaggtttttcagcagctgacttgaacaatatgggagtccattctaaatacttcacaactattaaaataccatacgttgattatttacctacttaaaagtaaaaaagagtgacactctctatatcatgttatatttaataaacataaatgcttcattcttatttcacttacacagtgatttctcccaatgatgtttatagtactagcatctatggccatgctacctgactgtaatataatttcattgtcaggaaaaatgtatgtgaaaaaagcaataagatatagataactgtaaatgtgttacttctaactaaaatagaataagacatccacaaaattatggttttactccagagtcaatggtaggtggtagcataacttactccatgctctgagcccaagagccatctggttttcttcctacaactgagactgaaattcattgctctgtaaacttcgaatccctgggtgtttcagaaagcaagcagatttgattttgctcttacaacaaaaaggcctgtgtaaagaattcttttagtctgtaacaatagcaacactaaatccttttatctgaaacctaaaggcctgatagaaacatagaatttgggaaacagttccaagataacaaaatagagtctttaaatagcattgctgattttttggtttttttcatatagcctcttaaacatccaccccatcctgcaagttttggacttctatccatctgtactttctttatcgaaactgtaaacatcctgttctcatacttcatatgaagtaagaagcaaaataaaacacaaagatagaacagacagtaaaatagcatacaaatgtttgtagtttatattagtatatttgcctatggcaagtgtactaaaatcatctataaaattgccaattaacttgaagttatagcaagttattttgggaagaaatggcccacgttagcactatcacttttgcagtttaacagtttaaggtatgaattctcttaaacactcctgccccttccatttctgtgtatggtgtaatgaaagcagcagagatatttggttatccctaatctggaagtggagtgtatatttctcaagtttaaagaagagaattattctgcctttctttaattagcatttgttttgggcatattctatatataagacaaaggataagaaccataaggattatgaattaatagaaatgtgtctctggcttctaagggaccatacggtgaataaatgcattaaaatcaaatgggtaattatttctaatctgcatgatcatggatgtttttatggaggaggtaacattgggtttattttaagctgtggtagagttttcaattagccgtggcaagaaggatggcattccagctagagtcagcttggacccagtcggagaacagcaaggccccaaccgtatttgaggagaggtgagagatcaagttaattctaatgaagggattaggtaggaccatgtagttgaaaactcagacgaagaaataagtaaagacgaggttttggaagctcctttctctcgccaagtgtgtaataccaagtctccaaaacagaagatgacacagatcaaagctctattaacttaaggggcagagaatgcccaaggttagtggaatgctcacagagttcccacagtgagaaggttttgctcataatatgtgtctaagatattaacactcagtaaattccaattagactgtttatgtaaggattctgattcataaacataatttattaaaacaaatagaaataataaggtacatatatgtaaaggtatatgtgtaaagatatatatgtctatcattctgccatctatcctctgtcattccatctatgcatatatctatttatgtatgtatctatctacctacctatctatcatttatctatcaaatcgatctatcttggctgttacttttaaactcttcctattatagacctcaattctaaggataagcatctctttcattaacactcacctgcctaactgctcacatccacctgcctgaactcagacttcactgagctcaacagggcttttgcgcagtttatacctgcacctctagtattgtttaagcatctctctcaagccatattctgctatgctttcattttaagcttttagttcctagcatgtacaggcattatgagttgagtgaggaggaagtgtttgtgaaaatagaaataccatttgaataaaagctacacaagtccttaaaacatagtccctatagagatgagtttctgacattgaactttacaattgtcatttcacttttaattccctgacattgttccatgcacctcaccaagattcttttagccgcagatcatacaattaggaatatgcacctcacagaaggcagtgttataatgtcaaaggacttcgacaattctccaattgaattagtataaatagagaaaaagaaagaaagaaagaaagaaaacatataccccctctggatccttggataagggggtcactacacagaggtatagattcataatgatgtgtataagccccaggaagctttaatttgccttccatttactctaaaccctctggaaaagaatgagaaaaatataacaatgaagaagaggttagagttacaatctctcaccactccggctgcctctacatgccaaagatgagaaaaaggaggtgcatcttgcgggagcatcaaggcttgggaagctggattcttttcgtttgggcccacagagatcaaaaacttcagtccctgggaccagcagggaaacgagaactacatggaccaagaccagtcctgttgccttagtctgaggcaacctcagcaccattcattctaacaagcccggtgatgggtctgattgtatcagaagtgacctggccagcaccactcaccttagggctacctcatagaaagagattaggctgtccagtggaaactaaatattcagaagactggagctctcttcaaaagaaaaaaaaaaaaagaatgcaccaatccacataaactgtagagctacagatgaatcatatacctttattttaaaggtaatattgatgctgaaattcacactgtcgattctttgcgaggtttgttagctagaattatatctaagatgtatgtgtgtcaataatttgaggagaaaatggtaaccaacgaagatctaggtataaaatgaagttttctgaggatgagagggagtggggtggtcctaaagctcagcgtgaggggatttctcagagatctcattggggatatacattgaccttggacattttccatctgttgccttacccttcatttccttaaatgtgcttatggcctcaagctgctttaaaacatagcattcatgtctatgtacctctagcattattatttgcacgtctttcatgagccattatgagtcaaaactgttaatcagaacataaaataatgtcagaaagagaaagctgcagaggagttaaaaatgagcacttttggaaatgagcaaagcgctgaatggcatgctacattcattggctggagcaatagatggcgttaatttctgggacaagactaacaatatataagcacttagtaagagttatataacaagtaaagactggcactaaaggagacatctataaatttaggtcagaaaataaatgcatattatcttttaacttttcaaaggattaaatcctatgtttacttttacaacgtttataatttgttttccgttcactgaaaagtcattcctgacctttcccatgccatagtttatccttatgtggcttagttgacatccagtaacccattttatctctgttgttttgaagcatataagatagaaaagaccttctaatagaaaattagggtggcgataccgcttactatagaaagtttgaccaaaaattaaactgaaatctaagtgctttcggcaaatctatatttctttccagatgctctgatcttcttttctggggggtgggtggggggtatttgtgttttatttttcattgactgttattttaagttctcaagtacatgtgtaggatgtgcaggtttcttacacaggtgaacatgtgctatggtggtttgctgcacagatcgacctatcacctaggtattaagcccaacatccattagctattcttcctgatgctctcccttcccccacctggcccccaacggcaggccccagtgtgtgttattcccctccatgtgtccatgtgttctcattgttcagctcccacttataagtgagaacatgtggtgtttggttttctgttcctgtattagtttgctgaggataacgacttccagctccatccatgtccctgcaaaggacatgatctcattccttttatggctgcatagtattacatggtgtacgtgtaccacattttcttaattccgtctatcattgatgggcatgtaggttgattgcatgactttgctattgcgaatagtgctgcaatgaacatacatatgcatgtatctttgtaatagaatgatttatattcctttgggtatataccctgtaatgggattgctgggtcaaatgatattgctgcctctagatctttgaggaatcacccacactgtcttccacaatggttgaactaatttgtagtcccaccaacagtgtaaaagtgttcctttttctctgcagtcttgccagcatctgttgttactggactttttaatagtcaccattctgattggcttgagatagtatcacactgtggttttgatttgtatttctctaatgatcagtgatgttgagctttttttgcacatgtttgttggctgcatgaatgtcttcttttgagaagtgtctgttcatatcctttgcccactttttaatgttttttttcttgtaaaattgtttaagttccttgtagactctgtgtattagacatttgtcagatggatagattgcaaaaattgtctcccattctgtaggttgttttttcactctgattgataattgtttcttttgccatgcagaagctcattagtttaattagactccatttgtcaacttttgcttttgttgcagttgtttttggtgtttttcttataaaatctttgcctgtgcctgtgtcctgaatggtactgcctatattttcttctagggtttttatagttttgggatttacatttaagtctttagcccatcttaatttctgtgtaaggtataaggaagaggtccagtttcaattttctgcacatggctagccagtttttccagaaccattgattaaatagggaattctttccctattgcttatttttgtcaagtttgttgaagatcagatggttgtaggtgtgtggtcttgtttctgagttctttattctattccattggtctatgtgtctgttttggtaccagtaccatgctgttgtggttactgtagccttgtagtatagtttgaagtcaggtagcataatgcctccacctttgttctttttgcttaggattatctttgctatgcaggctcttttttagtttcatatgaattttaaaatagtttttcctaattctgtgaagatgtgaagaatgtcagtggtagtttaatggaaatagcattgaatctataaattattttggacagtatggccattttcactatattaattcttcctatccatgaacatgaaatgttttttcatttgtttgtgtcctttctgatttccttgagcagtagttgaagaagtccttcacttccactgttagctgtattcctaggtattttattctttttgtagtaattgtgaatgggagttcgttcatgatttggttctctgcttgcctgttgttggtgtataggaatgctagcaatttttgtacgttgatgttgtatcctgagactttgctgaaatttcttatcagcttaagaagcttttgggctggatgctttgatttcttttcagacaatgagaaaatgttcctctgtaagttttagaatgacattgatgagttttacagcagtgtagttgagtgagatggtcccatctccctgtaaagtgttttccttgattcattagatctgacattgcaccatgtgtcccactgcttgagggaatgtattataccaaatggtaaaatatcttagccatacctgattacactgtctcattttagcaatgacccacagatatccagtagaatgtgtctgacaccattcaacaagaaataatgaggaaaaaaaaaaaaacaagcaagggagtgggtatcttttgaatgctgaaacaatagtagcttgagcaacagcaccatcattcattggtaaagtgaaaaactgggttgcccacaagcaccttctctactcaagtgacatgggtcattatgaccttgattttgatacctatacgaatttgttaacttctcctggtcccttagctacacattacagccaaccatgcacaccaaagcccagctgtattttaacactgaataagtttctaaacagaaggaatgagcaaatgaatgtggtttggttcagtggagtttcatcaactaattaggtaaatagtttgaattacatgtctgaaacatcaatgggccactcagtactcagaggtcctctcatgtaaatgctaaacttttagctattgaccatactctcagtgaaccagcctcttatatatcttttcctttagaccacttaggtcaacccattttttcataagttatgagaacttaagagaaaagcacttgctgatgaattgattcagcaagtttgactaaacaggtcaaacaccgtctctcctttccctctcttttgctttcattcttttcctcattaacccactctctcccacttccttcctgttttattctacattcccattttcataaagagtttggactgcatctccccacactatgtagggtacacttgttcaataagaaataggacatttatttccattactttttatgtgggaatgactggatttttttctagagctctagatcatgtaacagagttcatgacttcgattggggctgaatgaatacctcattccagttcttcctcaggcagagtagaccttatctataaatatttgttgattgaatcaagggatataggaacccttggtcttatctaattatcacacattttctatgccatgtgcagctttaagatattgggaaaattatctaaacttctaaatctctttttccaattgttaagtaggattgataagatctaccccatagatttgtttatttgcttatattttaagagagaacaatggccaagcacctggcacacagtaggtgattggcaatgtttattcttattcttttctcaacagtgcctagtgctcttctctatacatagaaaatgctccattactggagttaagaaaaaaaaaccggagagtaataaattatgtccttcctcttaaatgtgttaactcagggacacactttgtgatggtgtgaagtacctgacaaacacaaaaccctagggaaccatgctaactgtcccgggtgatgatggtgagacattcatggtgagcatactcagtgtgtctgtaagtgtggatgagttgtgtaataggctgctcgtgcctcttagatggagcacagcgttcacacagctctgctcctggagaaaatagatagaaggtcaagggagaatagcagggtgtgggcaatgctgctaaatactgcctcggggactcactcacccagggaattcagagttgctcttttctcgcctgcaaaaactgagatgcagccagagttgcgtttcattagaaggagacattcggtggagctcagctttttcaggagggagatgggtgacaggtagctgggagagtatgctggatgaatctgagtgtctggaattttaagtgttcgcctcttgcttctcagtaggtggctgcctcttgaggtctggcattcacccaagtcttgagcattacctcagcatttaaagagaaaacaagtgataaaaagaatccgcaaaactgcgtttaaatcaccatcaacattaaggaatgccacaggctgggttttgttcaccctgttagcatgcagaattatttttcactataggaagctgtcttttcccaaccaagaaaacaaacaaaacaaaaaaagcagaactaattaagatcgtcatatctcaataaatatgcaaatgaaaaatcaaaacaaagaaactctatcacatcataaagttgcaaattgctgtataggctggcttggaagaatggcaagggatagagtcttcttaatggctttgcttagagattgtctgaaagctgcatttatataggtttatgtttgaggatgaggatggtgaacttgccaggagaaaattattttcatactttgtctccaaactctgtggaaaggaaaggggaataaaaattcagtcgagtgactatgtgtgaggttctatgctatggcatttgtttctaagtgcatcatttcaagaagaagaggttttatgctatggcattcatttctatgtatatcatttcaagaagaaaaacaataagattcccattttacacatgaagacaacaaagctcagagaaggcaaattcctgtttctcacttggtatttggagaagaattcaaacccacaattacttatctgactctaattttatgttttgtttctgatttatattttgcccctacaccatgactctccaataccgcctaaagtgacttcacttttgaatgtgtgtttacaggacatcaaagcttcctagtgaaaggaggaaataaaatcaattttcaggtgttttctccatgtatttcccacatctcaatattaaggcccactctatcagtggaactaccgtttgatttctgcatgatgctataatgctattttctttcatttatatttaacttcagttgcaaatggtgagtatgaattgaattcatcaggtttgaaaaatcaagagggaggagagagagagaatagctaacaccctactattgctgaagttattgtaaccatgccttaacatatgtatttcatcctgagggagctgaatctgagctgcagagagagcaactctgcatgacgttggagctttattttagaagctgctgtctgctctctggcatgtagaatgctgcccttagaagaaggttctcctggacacgggctgtgttgctcttctggaccgctaggctaacttaagtgtgaggctgtttatgagaatggggaattatctggaatgagcaaacagttaataagattggaggtgatttggtatctattaagtattccacactgccctgggcacaaaggcagtacaaggagcagtggtgaaaccagtaggaggccaccacacacagaattgcttcttaccactgccagtcatattaaacaaaatagaagtatctagtcaaagagagtggtccaacaaagtgctcaaacaagttaaagaagggagaggctgatgttctcaaggaagatttcaaagagctgaatgcaagctttaccttcaagatagaaaggttggcaggagtgtcaaggcagttttattgcattttgctagatctgaacaactttgttcaaagggaataagataatggattaagtggtggcaggacacagtgactctgaccacttgccagggacatctaacaacagtgtttcatcttttcatatccatccccttttgttccttctttcttttatcttccctccttccctttcttttatcttccctccttccctttcttttttccttcctttcttccttctactttcttctctttctctttttactcttttcttctttctctttcccccctcttttcttttcccagccttacttttttgtttttagatgtaaaacattatattctttttttctcattaaaatactcattttaagccttgagaaaaatatagaaaatattgatacataaaaaataacctgtaccttatgtcatcttattctcattgtctaagtataaccactgtcagcctacaagagtagactttccagttctttatctgacatgtttagtttttttttttttaattatttttgcatttgcgtgtatttcttgagctccgttttcttcttactaagctatatactatagtagttctttttagcagtggtttctccatgggaagatgtatttactcatgcaaaagaaataaagggattttttgagtatagaattgcagtttggggttcattttccctcagcattgacaagacataattaatttcttttttctgcctcgctttaacatttttatttatttgtttgtttttgcttttgcaaattaagctttaaatttagaataattttatatttatagaaacactgcaaagataccacagaaagttcctttcacctagtttcccttatttaatttgtttttatggaaaatttattgttgatctaaatgtcccttatttaaagataatctgtctttatttctcaagttttctaagatttgccctgctttattgatgtttattatgatgtatttacttatgaacttcatatatttcctatttttttctggtttctagagtatttcttgaagatgatcatctttcaactggtatctttttaaatattatctcttacccatttaccctaaacacgacttttaaaaattccttcttgtttcttatctttgctgaactgtgtctgtgacatttaaccattctattaagctttttgttaaaatgttttttcatttagagaaaaggctgtttaatatttaaatctaccttttttcccaaaaaaatctttttctttcattatgtttcgagaacttattctaatttattaattatttcaaatataaccattctatagtcttttccaaatgggtcataatatttcaagttcgtgagtgtctgcttttgctgcttttcgtatctgctgagtcttgttcaaggtggattatttcctcatttgacttatgatttgttattttgagtgtatcttctgcaggctgtagtcttcaccccctctcaggagagttccatataccctgggtttaaaaaaaaaaaaatacctgcatggtaattttgtatttgtttctgatgggggcctcaagttttcaccaacaagaattacatggtttgtgattcacaatgtaattgtgaactctacatctgtgtaatctatgatttctatattttgtcaacattttcccccttctggtagttaggttttctaactttgttgcgttgctaacattactttcccatatttaaatctctattttttgtttcttttttaaaattagcatattgtctattgacttctgctgtaaaagataaattattccaatatgcattttctttctcatgcatatgttcttatttttattagttatagcatcacctttccattgacaagattgatagcatttatattctcttttgtaaacatcatttccagattatccttagttatatgtttattataacatagttctgtgctcatcaacacttctctgaccatgcactccccatttgtgagatcttcactatatcaatctttggatttcctagactttctcaagtagtgtctccctctacccactacatgcacattcctaaggaaagcaaatagcttttatatttcttgaggtcttgcatgttagacagtgtctttcttttgcaaaacaatttggctttttagaaaattatttagccagattttaattttcttttggccttttctgtcattagggacactgactccacagtagagaacattaaaatcagtctatgtttctcactttagaagacttatttttctacttacatgcttatatacttttttcctttatctttgaatttgaaactgctatagtgccttacatgtttctcagctccaagcaccctctttgacatagagacagtattcagtgttgcaggattgaatggatgattgaataagtaagattatatgttgctgtggatcattcagtctattcttatttctagtgtatatgatgcaccattttgagctacaagtaagtttttctgtatatgagatttttttctattatatctttaaactatatattttcccattacattgatcctttattgttttactttcacatctattatcttctctcctattaacttctttcttatatatttgaattgtaactttctcccctacattggtttttcaatgtttctttcatatttattacatttttcttattccttggatatgttcagtatgttttatgtaaacttcacaactctgattttcttgtcactgattttccccccagtggtttccaccctaattcttgttgcttcaaatgtgattatggtttccataaattttaatcacctttttttttcttgaactatgataatttactcctttcatcttttatctttttttttttttttttttttttgagacagggaatcactctgtcacccaggctgaagcgcagtggcacaaactcagctcactgcagtttcgacctcctgggctcaggtgatcctcccacctcagcctcctgagtatctagctgaactacaggcacgtgccaccatgactagctaatttttgtattttttgtacatgtggggttttgccttattgcccaggctggtcttgaactcctaggcccaagtgatctgcccacccacacctaccgagtgctgggactacaggcatgagccactgcacctggccctgaataaaatatttgataaataaattattaaatgaatgaagaaagatgcacaaaatagcaggaaaaaacttctccagagttttattaaagcaccagaataaatacacatttttgggaaatttagtattttattcttcaactctgatctgctgtctaaaaagtagcttgactgtgtttggtgtctttgtcatgaaatcttttctgattcctgtgtccaggatggtattattgcctaggttgtcttccagagtttttacagttttgagttttacatttaaggttttaatctatcttgagttaatttttgtatatagtgtaaagaaggggtccagcttcaatctgctgcatatgactagccagttatctcagcacaatttattgaataggtagtctttttcccattgcttgtttttgcccactttgtcaaagatcctagatgaaggtcttagatgaaacaaaataaaaaatggacaactgggatctaattaaacttaacagcttctgcagagcaaaagaaactatcaacacagtaaacagaaaatctacagaatgagagaaaatatttgcaaactatatatttgacaatagtctaatatccagcatctataaggaacttaaagaggaaaacaaacaaccctattaaaaatgggcaaaggacgtgaacagatacttttcaaaagaagacaaataggtggcaagtaagaatatgaaaaaaaaagctcaacatcactgatcattgaagaaatgcaaatcaaaatgacaatgagataccatctcgcaccagacagaatgggtatcattggaaagtcaaaaaataacatttgctagcatggtggtggagaaaagtgaacacatatactgttggtgggagtgtaaattagttcaaccattgaggaaaatacagtggtgattcctcaaagagctaaaagcagaactaccattcaacccagcaattccattcctgggtatatacccagaggaatacaaatcattctaccgcaaagacacatgcacacgaatgtttattgcagcacgatacacaatagcaaagacatggattcaatttaaatgcccatcgatgatagactgggtaaagaaaatgtacatatacaccatggaatactatgcagccgtaaaaaagaatgagatcatgtcttttgtgggaacgtggatggagctgaaggccattatcctcagcaaactaaagcaagagcagaaaaccaaataccacgtgttatcacttataagtgggagctaaatgatgagaacttttaaacccaaaaaggaaacaacagacactagaatctttgagggtagaggtggggaggagggagaggagcagaaaagagaactattgggtactggcttaatagctgagtgatgaaataatttgtacaacgaacccccatgacacaagtttacctatgtaacaagccttcacaagtacccctgaacctaaaataaatgttaaaaaagtagcttgaaattctttatttcaaaatcttaaaattctttaaaatttatatttgataatacttatatatatttattgggtatatcaagtcttgatttgttcttcattttacctcacatgaagacaattcatctgaattagttgtgcatatcatggaaaaatgatcctggcctgacctcccttcagtcctagccaggcacactgtgctttggtgatacattgcagcctgatgcatattgtgatgcatattgtgagtgttaacttgattggattgaaggatgcgacatattattcctggatgtgtctgtgcgggtgttgccaaaggagattaacatttgagtcagtggactgggagaggcagacccaccctcaatctgggtgggcaccatctaatcagctgcctgaacagctagaataaagcaggcagaagaacatggaaggactagactggctgagtcttctggccttcatctttctcccgtgctggatgcttcctgcccttgaacattggactctaagttcttcaacttttggactcttgggcttacagcagtgatttgccaggagctctcgggccttcagccacagactgaaggcggcactgttgtcttccctacttttgaggttttggggactcagactggctttctggctcctcagcttgtggatggcctattgtgggacttcaccttgtgatcatgtgagtcaattctccaaataaactccccttcatatatccatctatcctattagttctgtccctttagagaaccctgactaatacacgtatgtttcttacttttcctagtttcatcccaggaatctaagattcctcagagagatttttggttgatcttatcagaatgcttagtaattttcagaaaactcctcagcctgcttgacaaatgggaaaataatttatccattcttagttctttcttttaattttccaaacttgagtatatttagcacatatttttcatagtctatagattgaggttaaggccaatttctaacttcagtgtaattgatttttttggacttttattttttgagagttcagaaaagataatcgagtatcttatatcgactatcttatatcagaatttttttttttttgcttgtgtattcttccttctataaacaatgctagaatgaacttcctggtatacaaaataaatatctctgcccaacctttttactgataagatgttgaatatctgggtgaaagattgtgtcttctttaaagcttttgatacttcttgcagattactttctggaaagactgtgctacccttcagcacttgcaaagctatcagtttacctggaccctctctaatgcaacacttaacaatcttctcacatatttagtgtcaattttatacatgaacagtgacatcccattatattagctattcttattttacttagtgtaaacctcactttttaatgttttcctcattttttaatccccatattcttcatttataagttttctcttcatacccctgatcattttccagtggtgaggattttgtttgagtccaggttataagaattctttaaatagtccagataatgaccattcgatggttttccacattgcaagacttttctggttttttatatggctttcaaatatgttgactaggttttagatttctgtttcatttctaaaagatttttttaaagagttcaattgcctttggtgtcaaatttagaaagaattccatcataagttttagaaaacattaattgtgttttcttttgatattttcataatgtattttcttaatattttcaagccatttagaattacatttttatcatggtgtgagatagggttataacttgatttcatgccaaaattgttgcaggtgctctatttgaaaaaaaccctcttatagtgtaatagtttgtatacataatggtgtcttcatttccaactttcttttctattgcactatatttttatttcttcagctttactatattttgttagaccaacttataaagagtcctaagacaaatagagcaagtaaccccacattaccctttctttaaataattttttctttgaacccaattccatgtttttgttggtgatttggtcttctagttacatttcaaacaatttcaaaaatttttaataattgaataaaatatttacttcaaaatagtttataattttctttgtatgcatttaggtgtcactttatgacccacactgaaatttggtacttttttcatgtaaacctacatagtttttattgcttttatgactaagcattttatatatgttttttctgttgtggatgaattttttttagttgttacattaaagttttagctggttaatgttcaaacagcaaaactattaatatcaatattaataataatacatttattcttgtggctgagtcgtttttcctggtatgcaggtcccacagttcattcaccattcacctatttttggacattttgatgtttccaggtttgggctattacaaatcaagctgctgtgaactatcatgtgcaggtttcagtgtggacataagtttttatatacctgggtgtaatgtccaagagtgtaattgtggcatcgttttacaaagtatgctttgagtttctaaagaaactaacaaactacattccagaacagctgtacactcataccaggaatgtattaaagatctggctcatctatctcctctccagcatttggtataatgactattttaaaattgtatttctttttataggtgggcagtgatatctcattatagtcttaatttgcatttccctcacagttagtgttgttgaacatcttaaatatttatataatatagtaaaaaacaccacacaattttataaattttaattcagctgtcaaacatcatcttaaaaacttaggaaaagaaaaatctatgtatttgctcatatttttactcttttgttgcttttttctgcctgcttgtgttaaaaatttctttttattatttatgtttagagagtttcctttaaccattcttttagggtagatctgttaccaaaaaattatcaaaaatttacttcccatgagaatgttttaagtttcccttcattctggaaggatatctttgctagttttagagtgttaggttgtcagttctttgctttcaacacttgaaaaatggtgtgccattttcttctggcctctatggtttctgatgagaactttgctgccattctaattgcttttccctatggcattgttcccctaaagtttctcccacagctttcaagattttaagtttgtctttagttgaagaagattagctatcatctgtctttgccttgatttctttggctttatctgtttgggggtttttctaagtttcttgtatctgtaggtttatgtcctttgcatagtttaggacattttcagacattatttctttggataccttcacagcctctcttcttttgggacaatggtgaaatgaagattagatcttttgttatagtcctacaggatcttaatgttctctttatttttttttaaagtctattttcacgtttttgttcagactgggttttttctatttttctactttcaggtttactgattctttcctctgccttctcctttctgctgttgagtccctctactgagtttcctttatctagcttttgatattttttcattctaaaattttcatttcatttttctttatagcttccatttctttgctgagactttttgttttttactgagttctataattctgttattggatttctcaactctccagtttccatttattcttctttattttccctacctttttttctgggatgttctatttctttcctgagacattttatttttttcatttgtttcatgtgtgtccataattacttatggcaacacttatatgctttaaaatccttgtcagataattttaacagctgtatcatcttgctgttggcatgtcttgattatcctgattcttggtatgatgagtgattttctgttgaaacttgggcattttgagtattatcctatgaggctatggatcttatttaaatcttctgtttgagctgatttctctgacaccattcacacaacagaaaaagggagcttgttactgtcaggtgttgggtggaagtctaggttccccactaggcctccaggggcacccagtgtggggaggggctccttgctactgctgggccatggtgggaattccagctccccaccaggactttgctgatccctttctggccagaagaagcagcagttcctccttactgctctccagtggtaggggacagtcttgttaccaacaattgcctgtagaggtccaggttccccacacaacctccactgatattgaaggggaggaagccacattattacccagtggggataaaagtcttggctcccgcatgagggagatgggggtctggtgagagtagaagcctaggctccctgcttttgttggtggggatgggggtgggactgctggcttttctgtggtgtttgcctggagtagaacaaacttttctttcttgataagctgcccccttcctcatcgtgtggctagaggaaacaagctcttgttggggcttttaatcatctgcacctcttggcatttccagctctcagctgttccagctccaaatctagagtatgtgaggcccaaaggaaacccagagagatcattgccaactccacctgctagtcctgaggccctgatacggtctgcctttttctctccctactccatccacgtttcagtgtcttcttatttttttagtatataatattttaatatataatattgaaggaaattaggaagaggaaaaagtaaaaatacttctccatcttttcagaagtgaaagtccttgaatatgtatcttaattccttattagaatgcttacattgcatttgggcaaataagtgagagataaaattaaatgattttgagactcctaaatttatatatatgtttataacatattatgttacataatgtattatcatatcatatataataagtattatatattctatttgtagtatctattatatttattttgttatgtataataaatgtatgttattatatataaatatattacatgtattttattatatataaatgacaaaaccatatttgttataaaacactaaaattcacagacatgataattgtggtataatccatatataaaaatattttaaaaataaattaaaaagtaattccacaaaagatgattcaaatatggttttttctatatatacccctgttatatgttcaattcagcaactctttattgcatgtctagtatgatctcattacattctaggtgttctatagtataaaataaacataaatctgacagaggcatgggccttattgacaataacactataaccatgttaatgataaaaataaattaatttgtaaagactcatatttagaaaatggaaatttcattaagagatggagttatcaaaatagtcatttcatagaaattaaagtgagctttttaaaaaagctgcatttggttgtatgttgaggggttggcagacggttttaggaaattgtgaaggcttgggaaaatattacatctggtatgtctaaatgatcacaacaagtacgacttgacaacttgatgcgcgggagaactgcaagtttgtgagtgactagagccaactgtgcaggatgcaaggcaggacattatttaagcaagactgaccttgttgtgtcccactggaccctgtaggctctgttcatcaatactcacattgcactaataggcaagggagcatcattgcaagttccacaaaagtggcataataaaaatgatgtttagagaaattattaggagtgccaatttggctggttttgcaacagttattgcagtaacccaggtgtgaagcaacaaatctacatgcatgctcttcttccacaccatgtttcaccatgttcttcagaatcaacagcacagcaatggaattaaaatgtggtgattgcctttatttcacagaatactctgctagacaatatccatgtgttttgtcatttagtattcaatgcaactattgaggtattattattgacattctattagattaagcagtttttccaaagtcccacagccaatatttaaatacaggcttttgacattgcatgacactgacacctccatacctagcatgatggaggtgaggcacaggctcccagggttctcaatgacttgagcctgtgttgcagctggggcagctcttgccttcctttactcagctactttattacccacaagtcagcctgtaaaatatgataacaatttaatgttgtgatgctgtagaaacaagtttcatatttcttccccttcctctccattcaggcaatgtcccaccagaccttcagtttagggtaccgcagcctggagagcacagaagcagctcacatcagtcagcagacaattaagacactggcctttgattcatttcccgatctaacatgtaaccatgctgctgattacccattttcattgtttatggcaaggcaggtggatgaacagctctgcctgatttatgaagtgcttgccttctataaatcacagagcagaaacccagcacgctgctaatcctaattggttaagtcctaagtagggagtgattagaaagtcttcaggaaagaaggtgccttatgcaaatgagggagacatacagctccttgggaggaaactccccctgctcacaatatgctgtaaagtttttgttaatgttcgttcctactgcccccttctatcgcttgctggtcaacccctgttgatcttccatttgttaataaactggagagagggcataagtgggaaagcacaaacactgtagaagcagaatgctgtttgcccacttactctgtcatttgttaatttcaacctggattaattttccagctactataaaccattcatcatgatgaaggagaaccgtgtaatatgactcatagtgctgtttattggagtgggaaacacgagggctttgagttctgtctacctgcattccaatcccactctttcctggaagaaaatgacatggcattctcagacactcagtgatgaccttctctgattgttcacttaaagcctaaactactttgaaaaattctaaacatgtgaggctgtgcacatcttctgattggaaatagggctaagaaatgtatactctgctggcaaaggaagaaagaagcctgcaaattgttacaactttcccccccaagcctcaaggttgaggacacaggggagtgtgcatatgacacatttaaaggagcagtgatctgaggttaaaactcaaagcaggaaacttccactctcctcttccaaccaattgaatgtgttcccttttttggctaatttctctttttcatttctctctcctcttccccatcttcctccttctacttccctttccctttgtacattttccctgtctaccttcctcttcttcctttcttctccatatttcccgggacccaatggcaggtgcagcagcagcagtggcagcgtcccttcggaactggaggatgaacctgcctgcttggaggagattgattacagtaccgacaacagctcagaccaggaagggagcttgtctgagctggaccggaggatccaggagtgtgccttcaataagtttgagggagaggaagaagaggaggcaccagggcagggaggagaagccatcccatagccccgaggttcacagcaagttctgtgtctccaaccattggattggactagcagctgtgttgctgcttcttcatcatcagacacacacaatgtatatgtcagtgcaaaaagccagcctgtgtgagctcagcaaccccatttccagattttgttctagtttccctatgcgtagaagctagccactttataacattttatattagagttaggtagcccttggggcctatgcaagctgctattgtacttagaatgggacccaatgggtagcctcaagattaccatggatcctttcaagatttttctgagttattctccattcttgtgcttgaactggagcaagctggaagtagaggagttgggcttcttcttggcttctcagccagaattctaagtggttatttaagttgttccatatacaagtgttatcttccaatgttatctccccaccatagcatttgagcaccccagaacaaaccactgagactctggggatcctggcagggtcttcaggtgctggggcttgaacatgaaaaactgtgcatccaagtaattgcaggtttcatctgtgatcttctcaagcagcatatattttacatatgtggtacaggccagaagctgcactagactcttagaaataagacattgtcactgatcttcacagattttaagatcctatgtattcagatcaccaaacataatgctaggaagtaccagacctactggaaaatttattcatttcagaatctgacagatatggttcatatgctagatctggcagttgcttgttatgacaatttaggcaagtaattaaattttcctaaacttcagttttcttatatataaaatgtggataagtatatctatatcataaaattattgtaggatgaaatgagatgatatataaaagtgtatagcttagcatttggtacacaacaacattggcttatttttcttcataacacaaaagaacattctatataagaattctgacagttaagaaaaaattctcaccagcctggacaacatgatgaaaccctgtctctactaaaccccatctctacaaaaattagccaagtgtggtggcgcacacctgtaatcccagctacttgggaggctgagaaaggagaatcgcttgaacttgggaggtggaggttgccatgagccgagattgcaccactgcattccagcccggcaacagagcaagactctgtctcaaacaacaacaacaacaacgacgacaaacccagaatccagaattctctggagtcacatggtaggaaataggccctcttactggaagggagctgggaaggagattacagaggagcagaatctaggaggctggaatcacttaaaacaggtgaaaatggagcaaggccttttagcattcggaaggaagaggcttagttatttgaataatgaagtgtacgagacctgcgaagaaaggatgagaagggacgacaaaggcagtggtagagtgagagatagaatacgctaggtcaaacttaggctgttttagatgtcatgtgtattagttaggattaggtttagctgcaagagatggacaacttatcatagtagtagctttcataaggcataagtctatttctctttcctgtggaattttacacactggaagaccagtcctagtgtcatggctgcatggtgtcagagacctggcttctgcagttttctggctctactgtgtgtgcttctactcttggtctagaatggctgctgaagcatcagtcactgcatctgcatcccaggcagtagcaagaagaacacaaaaagaaatgcctgttttctatctttccaaaagctctacataatatttcttcttaatcccaccggctgaaaaaaatgggcctatagccacaggaagctgcaagagaggttagaaaacatagtctttatttgaggtgggcccagctaaaatttgaagtttgaagtaaaagtctgaatactaagggaaaagataataatacatattgggagattacatatctgccaaaagacttctcctgatgttccaaacaccaccaagggagttttggatatatcagaataatctcagatgacactcatagcacacacctcttgaccagcagaaagccacagaacaaaacaggattagctccaaggcatagaagaaaggcatctgtgttgtgattttgggagttgataacattattaatagtctcttatttttttaactcttttccaagtttccattttgtagttcagaaattgtatatccattcttcatattaagacatgtatgtttatgtaacatatgcaagaaatttgaagactattagcaaagataatgaaagtgaaacccaaacgctatatagctcttaactcctcccatatttaatctttccactcttaaataaaggctagcataatggtgctgatttctctttgctttgaggattcaagaagataatattgaaatgtaattgctgagagaggtgggaatgatgctagcttatcattaattattatttcagcccaaattagttttgggggttagcttctggtcatgaggcatgtttcttaaaaaacgtgaccatgacagataagtttttatgtggcatgttcagaaaaagccaggaacatgaagtatttgttgatccatctatgtaacaaatgtatatttaacccctaactgtgggtcatgcactttactaagctctacggatgcagataagaaagacctattttgtgccctcagtaaccagacaaagaagaacaataaacattctaagttaatgcagtatggcccatgccattatggaactctgcaaagaatattacaaaaacgcctaatctaatgggggtggcagttgtggtaaaagtctaccaaaagaaggtcataatttgggtgattcttgaagaatatgcaggagttttcaagtataaagggagaaaagacatgcgaaggagtggaaagattttgtgcaaaggccctgtggtagagttagagcttgaaataaaatgttcagtgtgactggtttaaaagatgtgtttgtatgtgaggaaaggaggagagtgacaagagatgaaatggaaaaactagacagcagtcagataaagctgcatttggcattccttgatgaaaaggctgaatttaattctgaatgtaatgggggagacttaaagagctttcagcagaggcatgcccgtgactgatatcagcgccatttttcccttgtttatggctgagggtttggtgctcctgctatgctggttgttcagtagtttgaggagtgccccaggtgtgatactactatatttgaagagcagaacgtttgcattcaggtcaaagataataagtgcagtttggggacatgttaaatgttggtggcctacatgatagcccgttcgaaaggtttcctagaaatcagaggtacctcaggaagcagaaggagaacaaagagaggtgtacctaacacttggtgattttggggacacaggtgaatgtcctgagcacctaagcccaggtgtcagtgagttgggaaggcaattgattggagggaagaggggacttgggagcagacctctctcctttcctgctaggactgaaggctatcttgtgtcaaatctcaccagtcttccatccagagttagagggtacttacttgagagttaactctcaatagttataagagccattcttccagtcaagccaggactttctcttgctggccagaccacttcagtgaattgttgggataaaacgtgttctaccaaattcaaagccaaactaagatgacccaagaattccaaggagttgtaggccataatgggaagcaaatgtggtccaaaatgtgcagaggagagaggagagtccagagaggcgatgttggggcaggccaagtgcatgctgtcctgtaccaactgtcatccggtgctctgcatgcaggactggaactggggctgaggggctgtgggggcctgcagcttcatgggacagcctggtaaaacttctctgatgggcaaaggttgggagctttctgatttcacctttaagatagtcccattgttagaatagaagcccaagacttgccacccacgagccctcaagggtggaaactactgaccccttcgtaacacttccctctggcaagaggctttgtggcttcacatttccttcagaaggaagtctaaatgtctcaacagatccctttatagcctggccccaatctccttgacagcctcaggttctgacattctttgttctctttgatttgccacagaacataccctctttctctctcatcgcacttatgcttgtgagtgtctacacacatatgcacatgcacagtgcaataggggcatggaagggcacttcttaagccacacagctccctaaatgtactttttgatttttctaacattttcacatttttcctctgcctctgataagaatctcccattctctcatttgggaatatcaaaactcagttcaaatatcacctttcttctataaaacttgtcctcatcacccaatgccaagttatatataatctctcttccatgcccctgttgcactgtttatatatctcttttatactatgcttatttttaacttgataaatatgtcttttatacccacacccccattcaccattgaatagtgagctctaaagtgcacaaacctgctattatcttggcatctgtccctatacctatcatacttcttaacacattgcaggtgttcaaaaatgtgtcttcccctcagcttcaaactcagacatccaatgtttcaatgaaatctcacttattttccttaaatccctccgttttccatctcaaagaagagtttgtgttatagacagggaaacacaaagaagagtttgtgttgtagtttcactaaaaggacgtgtagcacaagtgcagcctggcctctcaagctggtggttgccatggaagagttcccagtgcgaggcgagcttaacaaggggcagggtgtccttttccttacctgtgttgtgcaaatgcttagagtggtgataatggaggggtggcatctccaagggttcccaggagctgccacatttacccaggggctctgcctcctatgctccctttggtgagaactgtctgtgcagctccatggatatcatgccaacttggctgcctgggctctccttgcaatcccatcaataagaatcagcatccaagaattccatacattggcttcagtttccttccagaaagaggattcagagccaccaagaatatttgaaattaacctgctccctgagttacaagctcaccttgagggctgccaacacaaggaaggtcatattacaccctttcatttatcagcctggaaaatggtgccgtagagtcgatttcatatgctaagggcagcctctgccctatgccaagagaaggagctcccaggaaatgcctgacataagtcatccttgttagggccacagaagaatgactcgcatggtggatctcagcatttggatttgcattaaaatgatggatttgttttgccttgctggtacagctcaccccagctccccaaactctctagtcttggaaagacatgcatagtagcctggtgcccaccaggagggcttttctgggcaaaaataattcatcagctctggagcctgctgctgtcttcccaacagatgtcctcttttgtttgtgttgcagtttggttcatgctaccaatgcttgataaaaagtgttctttagaaaagaaaaaatagagtggtaaaagggaattttgagataaaaatggattctattacaacctttcagtgcctaataataaaaagatacaattgcatataacttaaaatcatctattacacacacacaattcaacataatggagctgaagctgagtttgagttccccaccacacacacacatacacacacacacacacacacacacacacggcacagggctttaagcataacaatgagtgagggaaggttgatcctcagacacatgacacatgttcatacaggtgaggggcagctggttgatgattttaggctctactgtcacacagatgtcaagatgaaggccttttgggcagaagacgggactcatctctcattagcatgtgacataaactgtacttgaagtgtgtatatattctgggccagttccaatgcaaagtaaaatgggttcagtatcattggtagagaacacagtctatgagagaattaccaaatgagccacatttagttcttatgacaagtagttaaacagaggagagcactgactgtttacaaggctgaagcaggcaaggcgtggtggctcacaactgtaatcccagaattatgggaggccaagctgggaggatcccttgagcccaggagtttgagaccagcctgggcaacatagttagaccctgaatctacaaaaaataaagaaaaaaaatagccaggcgtgatggtgcatgcctgtagtcccagctactagggaggctgaggcaggaggatcacctgagcctggaagtggaaggttgaggctacggtgagtcgtgatcgcacaactgcactcctgcctaggtggcagagtgagaccctgtactctgtctaaaagtaaataaaaaggctgaagcaaagatgattctacatggggggatttcaatgatcttttatagtctctaggctcttatggggttaaaatgatttcttggtatcagacaagtattatgaccagctcctggcaaaataagtaacacttaagcataattatttggagctattcagttaaagtgtctgagtgtagccctggtcttgaagggcagggcaagacatggcattgagttcaattgtctctactggctgtgggacgggacaggaagcagagaagccgacaggtctgccatccaaacatccagggtatgggggttaaatgaatgaatgtcctggggtagaagactatcaaccagaccccacccacacttcattctgaagaggaagttattttgggaggtattagaggaggaaaaatctgcctgtgtttctgctctgctcagacaatcacataagtgactcatttcactctcagtaccagctctgtgggataaatggacattatgattgccattttaaaaatgaagtgcacccatacttaaagagacacgtttagtaaatgatagagctggaatctgttcccggggaaatctgacttcctaactcatgctccctccacttccccagaggaggtgaatatgaaccataacacagttacagctaacgtggtaattagcaacacttagtatctataatagtctaagaccatcgcaggtgtcatcatgtttaagcctaaaacttcagcccaacgagctaaactctgttgttatgctcactttataaatgagggcattaagaatttaagggctagcctaagatgatacaggtagtaagtagcagatcacaaccttaactcaggcaatcggactcttaaacttgctctccaaggaaaaacatctttcttcaaagacccctaagggccctctgagaggttatggagcaagtctccatttctaggaaagtgtgttgttcttgtagatccttgactcaaatacaagtaactcctactggccatttctgcataacttcctgctccttttcaaactcaacaggttcaaagtcaaaatctcctcccaacaaaatctctacctccaaattcctaaacttgattatgccgatagtaaaccggcgttgtttgatttatttgtgtgccagatgcagagctcactgtctggccgaggcaggtactcagatcttcactaaatagatgaatctgcaatgttgttgagtgtgaatcttagctttggttggagtccaaagctaagaatcagactcggtaacactgttctcacctggacttcaagttttcttaccactcttctcacctttggttgtgcttcctttccaaccctttcatccctgtgcagcctgatagtattaggaaggaaaaccggcttctactttcgcagtttataatttgtcagtgacctcccatggtcttaaggataaaatgcagacaggacctagtgcttgagccttttcagatccagccactacgtaattttctggtctcttctcttgacatcagcccctgttaaagtcataaaaacttactttcaattctcagaaagcaccttactcttctgttccctcttcttccatccatgtgcctagatctatccattatgtgcttaaatgtaggctcctccaagaagtctcccatgatctgattctgagttcctactgtcatcttggagaaacccagtcacagcttttgttgtatggcattgcctgtggactttgctgtcccctcttcacctcccccccaccgccccactgcaccaagactgtaatatcttggagaacaaagacaattttgttcactgctacatcctgagagcctagcatcgtgcccaagatgtggtgggacttccataaatatgtgttgaatggttgagatcttaatttctgttagaacggtctcctgagaatgacctcctacccgttgcctcagtaacctcttacgcatggagagcagagctgcaggaaagcaggacacacgtgagtccagccaactcagagcttcaaggaggcgtccaggagaaacctccctcagccccgtttgcggtgcctcctggtcggtaattttccagaagcaatttcttgtttcctccaaatggcctgtagaggtcagaaaagggccttgttttccaatcaccgactgtcctgtctacattagcattcaccccgggtgtctataattaagcaagcctaagctgggcacataggaacggaaatgcattgactttaataaaacagagtgtaaaacaactttagattgactccagccttgtttattcttgcacacttgtaattctggtttggtatattcccagtcaaagagaccattgtcctgggaactgaagcgtgtcccttgcttcattgctgctgcagcctgtccaaggaggcaagccgcaccaggttgctgctaccagctcacagcaatttttttttaaattttttaaagaagaaaaaataacagagaataacctgtgagaacgatgaaaggagttcctattgatgtcctggactttgtgtgtgtgtgtttgtgtgtgtgtgtgtgaatgtaagtacatccagagtccagaaaaaatatgtaaataataaaaatggatcaggcactctggtcttcacctattgtgtaatttaggaaatgatggttttgttctttaagtgattccgtagcatatggaatagaacattataacagaagttgagagtccaaggtttaggctctggctcggttacttcaatatatggctttgggctgaccctttcctctgggtctcagtttctccattggagggtgaagggctggaccacacgaaatctaacctcacttctatttctaatattcatgaacatgaatgctgtgctggcggggcctgcagagaacaccagcaggcccggggctggccaggccggtgaagaggcagcgtgaggtggctcacactagcgttctgtctctgcagggaccgaggccaggcctgcacaatgatctattcagagcacagagcagagcagtgccgttgatatcctgccaatgcccagcagaataaaagcttccgaaatcagggctaaaaataaataataaaacaaaatgacaacataaacaggaagacctaaaggagggggaatgaattgagtcagcaaacttcagctggggtggggcagggaagaatctaatttgttttcatccacatggtttggcctgctaggtgctgcactggtgtttaaagtgctgttggaagggggagtttgatgccaccctgggagaagatagagaagatgggggagaggcgtggctgctctctcaggctcgtttcctccccactgtgcagttggtccacccactcctcactgactctttgttggttgttcagagagagttctttcacagtccctctcctgtccctggcctctgcctgggcctgggccaactgccctcatcgaccttgtctctcagcatttggggcccagcttcctcctaggctctttgcacacactcaggatttcaatcaaaatgactttcaaatctggtcatttaggggaggatgtgtgcaagagggttagggaaagggagctcattattactgagcacactgaatgttccggccactgtacagttacatgcaacatgcaaggagacagacagcagtgacctagcagcagccacagggcaagtaaacatatgcggatcacctctacaaccttgttccaggccttgtcattgcgaagcgtagagattcaaagcagttggagacttcctttagtgaggcggtttcttgaatttggggatatgcaaatgtcggggtgagggatgaaaagctgctctgctgtgcattagatggtaccaaagattcggggagtggggccaggggtgtgcactgggagagaaggagagagagagaagagagaggatgaggacttcccagcatggctcaaggcaggggagcaaagagggcctcagagaagtcctgactcataaaaaagtgatgtccaggattgaattttaagttgttctctgttctgtgggatctcatttcactccatccctagtccctcaaatctctagtaaaagtccattactcccaagcagctgggttctcattatattttgcatagatgaaaggttcagttgttcattttggatgaaaacatgggggaagccaccaaagagaattcagcagaagcaagaaatttgcaaagttcatttctaggaaattacagattccatttatttgggcagttcatgaatatgatggtaatgataataatcaacttaccataaacatgaaccagaccttgggctgaatgtttactattcacaaaacccctttgaggtaaataactattatgatacccattttacagacaaagaaacaaagtctgggagatagttagcagcttgggcaaagtgagtggttagtggagaggctgcatttgggtttgaactgagcttgcatcctcttcccattctccccatggtgtaacacctcggaaaaggaaatgttcctagtggcagtggacatctcctcccttcatttttcccttgaggcaaacttgccttcacactttcttcttcaaattcaattagaaatggatccgtatcatgccgctgcactccagcctgggccacaaagggagacccagtctcaaaaaataaaaaaaaaaaggaaatggatctgtaattttccgagtcttattttcagacttagtcaaggcctgttttctcccccacgtacctattaatttaaattttgctcagcttccttctccacatttccagacaaaaatgctgtgtgaccttttacagaaatcttaccatgggctgatggtggtagttgatgatgtgtatgggaaatacgtgaagcacactataagcttcccctagcaaatgttcagagcaacatttttaaagatgaacaacatgaatttcaaacagtggttaagtaaacatcatagagaaatatgtccccaacaaaatcgggtctggattgggatcagcaggatttcccttaaggtgtctgctctggttcaggaaatgattcttctgggtctctgtctgtcatgtccgtgcgtgttctgaacaatatcatgtgttcccctggtgactctatttttttcagagtactactttgaaggctgtggcatagtaatgctagggataccttgcagacttacgctcagagatctataatgcaccacatcaatatcagctagtttcaagtgatactcagtttactttattaggaaaggatctatactctttaaatcctaaactgttactgttcctcaacttcacttgacttcaacctaaaaattaatgctataagtgagtggccccttcaacaagaccgcttagcaaagagcaacaggagaaacacaccttggtcctctaccttttcctgtctctgttgaaatagattttcctgtagtctgacataagtcagtgatattcccgaaagacagccttacctgagccatgcttctctttttctgaatagtttttttgttgttgttttttgttttgcttttttctcatctttagtggctacaagatgaaaagaccagaaacacatgacattaattaaggtaaggaaaaacagagcccagcaagggagaatgaattgacactgaaatctctagggctcatcaatgactagctgcttagttgcccactccctgttgagacacacacacacacacacacacacacacacacacacacacccgactacctaaggaaaaactcttatatgaatgaagaaaaaaccagagccttcaaggacactaatttggtgcctgttgcagagagcagtttttgtggtaagaggaagattataaatagaagcgactgcggcaagctctctcacgatgttttataattggtgttgtaataccttgtgccagatgatatgagaaagatggtgtggcaggatgtgtccagcctgtaaagcactcacagtgtctggagtcccagtggggctgaaatgggacaagggagaaggagtaggcaggggctgcctggcccactctgccatgggcctcaggagtaaagggcaggctcatgggggagggatatcagtacctgtacctcagttttacattgctgggaaacaaattaccaccaatttagtgctgtcgaacattatctatttactgtcttagggtgagtaagtcagaagcacagggaacctccgtgggttctctgttcaagaggcctcgaaactgaaacccaagcgtcagtcagcctggactcctatctggaagctcagggaaagaatctgcttccaagctcaaactgttgtctgaattcagttccttgtggtagtaggcactgagctccccatttcctagccagctgtcagaggggctgttctcagctcctacagtccgcctccattccttggcctgtgacatctcaaagccaacaaagtggatttaaccaccacccctccctgatgctttgaatctcttttacttctactagccagaaaaactctcttcttttaataggctagtgtgattaggttagacccaccctgatcatctattctttgccttaaaacctagtataatcacaggagtgaaatctcatcatagtcagggcctctatccatgatcaaaagtggggaaggggaaaacacagggcagatttcattgggtttatttttataattttgcttaccacaaacagtaatattatcaagggttatgtaatgctctctccaagtgctaggaacagtttaagcattttatatacattaataacatgaatcttcatgacaatcctataacataggtatattcatcccagtattctgattttacatgtgaggccaaagtattgatgtagtatacacagctagcctgggattgagttgtgatttgaactcgacaagtacagctccaggtttatgccagatttcttggctccatctaaaaatgtactctcttagacatagtttttttccttcattttgcctgagctgggatgtgaacatggtgtttccaaaacaaattagggagctgctcacctgtgcattaaggcaaaacatccactttgaggttttgcaattggagaaaggagggcattcattttcagagtgccaagcaaggagaactgggcagctcacacttagacctgacctccccagcggcttctaggtaagggtctttaaaggaagggaggcagaggttataggcaaagtcatcaataaatacgtggtggttatacattggtttgaccaaaaaagttgggacatttcgaagtaggtcgtaagaggattcaaagatttttctcatctgtgattggttaagcagacgaagctttgtttaatgatttgggggtcaacagaaaggaatggtgagttccagcctgtggatgggacttcctccaggctcctcaagaagaaatttagaacagaaaatggccgtcagagttcagtcctcagtctcctcttgtctgaggtctacgtgccagtgtatccatttggtcggggtccaagtttctgaaaaaacaactcagggacatacgttaagatgtaatttttagtttctatagggaaccaaacatctcatgactctagcttccttggctattgttttgagctactgttaccttcttgcttatcaggttgctcacttacttctcaaggccagctaggtgtctggaatttccctggaagaaactcaatattttcttttatttccatgcttggggagggagaatgaggaggaggcccctaagaggagtccctactccctcttgatgaggtttggagttgcctagtgggacaggaataggatgcagtagaaggcagcacagcatgcatggatcagactgtctgtggccaaggctgtaatgtcaaggcgcctgtggcatgtccacctcttctaatttcaccatcttgtactcagagtcttacttagttataaagagcacacgtttccccagactgtccgctctcccatatatccttcaggagcagttgatctagtaacgacatttgagatgttcaaggtataaagtgaggtcttcatgaaacagatatcccacctccatgtccctgggactctgcttcctgcacaggtctatataaaaaagggacctaacaaaccaatggttactctgtatggacttagtcgtaatttttcagtctttcattgattgggttgcattattttggcttatgtaggaggatgaagatatatccttaaaggtataactagtttataatcataaattagaagaaaaaaggctaataaatatgaaacaaagttgatttcaaaaatagtattttgcagtgccttaatattattagtaatagtattaacagagcaacttcaccaataaaattacattgttgcatatagcaaaaggcataacaaaaatcaaaatccagaaacatgttgttatttttctcagatgaagtctcgctctgtcacccaggctggagtgcaatggcacaatctcagctcactgcaacctccgcctcctgggttcaagaaattctcctctctcagcctcccaagtaggtgggattacaggcatgtgccaccatgcccagctaattctgtgtatttttagtagagacagggtttcaccctgttggccaggctggtcttgaacccctgacctcaggtgatccacctgccttggcctcccaaaatgttggaattacagggtgagccaccatgcccggcccagaaacattttaaaaaactaaacagaaggtagaaaactgacatttcataattatagctataatttaaatgctataaattataccactaaatgacacagaatatcaagtatgatcaagaaataaacataatactatttttcattcattatacataacaaaataaaaagattcataatgaaacaatccaggtggaaaagaggcaatgaagcgatttctagggagcagttaccaatgagaagaattacaagtgcaagctcaagttctgaagcaacggtttagataacgggactggtttaggaaactaggagaaatatgaatcagcttattatcacagctgtggtagaagggcatgatgaccaggaggagatgttcaatctgactgtgagagcatgtgaaaaataaggagacaaaaattgcacaatgatcccacccagggcactgcagcaagaaggagtccaggtatccggcccgagggatggtggtggcagggatgcaatcgctgaagctggatatcactaatgtggtgatgtgtctatctgcgctctcatcccttgtctctctctcttacaccagataactttgaacacatgataaataggcagagtgggtaaacagatctgttgaattatgtgggcttagggcagattaaagtgaattgaaaagactgtctccttcagttgtccatatgatgtatcagcttgacattcaaaagcctctacaatttagctcacctctgcctgccttgccgggcttgtcttcaatacacagggcccaggaccagcttttcaggcagagtggcctattccccatctcctaagtttatcctgcctgttatcacctcctcaccttttcctgctgttcctccctcccttcaaggaccaattcaaatctcagcttacccctgatctgagtatcttttgtaactcctactctctctgtgcttctatccatgaacgcttaaagcatttattatgcaattaactatatcctttcgtgcttggctatttggctgtttatctcttttgttgtggttcaatgcttcacatgtgactgtcatatctctgcaagtacactattccctgaaagcaaggttatgtcttttttatatcattcatcatttagcatcttccaatttcagtttgtttatggatattatctgacaaaatgctccctataaaacttcatgttaaatattattttcctcattatatgaactacctaattgaggattaacaaagtttaaaaacccaccctatgtcatacagctaataagtgacagaatcaagatttaaagccatgtgatttggacgaaaatcctctacttttcccatgaggccatgatatcattacaccttcctggagccattactctagataatacatcaaaataaaatattcatagcatatatacatacaaaagcagtctccataaatacgtgtcaattattttacttcatttgcccacaagttttaagttatgaagcaatctttaaatggaaagcctagataaaatgtctattcatgcatattcacagatgcacatgtatgcatgcacacatacatgtgcacacacacagggatgcatacacacatgctcatacacacaaatgtttgcatcacgatagattggctggtaagtgccacacacaagttctgcctgaaaggacattgtgatcctaatggtacaatgaatggtcttattggcaaggacatagagaatttttaatcccatttagggtagaaaggtgtgtaatcttagcagaatgctttgaggctcaattttattgcaaggatgcccagacctcattgatttggtttatagtcagcaaattactttgaagtacagccgtgttagttgtaatattagctattgaaaagctctatgtcaattcctctgttaatcatgacctggaaagtataatgaatgtggagggtgctcagcaggcatattgtttgtccaggttctcagcttattctctgtttgggagagaaagacgacagctctgaaacctataatctttcagaagtgggaagcagagagggaattgtggtggggaaggtaccacaagattgttcgtaggttcccttcataacttggacatcactttttggcagcggatagtttccatgtgcacgataagaatcattacattttgctactctgtgtctctcaaactttggccacataaaaatcacctgggtgatcaggtgcggtaactcacacctgtaatcccagcactttgggaggctgaggagggtggatcacaaagtcaggagattgagaccatcctggctaacatggtgaaaccccgtctctactaaaaatacaaaaaattaaattaaaaaatttaaaaattaaacttagctgggcatggtggtgggcacctgtagtcccagctaatcgggaggctgagaaaggagaatcgcttgaacccgggaggtggaggttgcagtgagccgagactgcaccactgcactccagcctgtgtgacagagtgagactctgtcaagaagaagaagaagaagaagaagaagaggaagaggaagaggaagaggaggaggaggaggaggaggaggaagaggaagaggaagaggaagaaaagaagaaaagaagaagaaaagaagaagaaagaagaacctgaacctgggtggcttgttaaaacagagagctaagccccaatcctggtgattgattggggaggtatatggtagagtctaataatttgcatctcttagaagttcataaatcatgctgatactgctggtccaaggaacaccctttgagaactgctgtcctaacagacatggtgtgtaattatagggcaaagaagaagcattagtttccttcaagaaaatatgatactgataatcaggaagctttttctattaataacaccagtcctaagtatttttcttctgttccaacgtcagtgctctcctttatatctcagagaatgtagagagcttctatgcattacacagatgctcatattactatctcaagccttgttcttatgtaagcaaagtagctgtccaccaaataggtgctgacaggcttcctctcattgatgggagtttttcttcttttcttcttttctttttttcttttttctttttctttttcttttctttttttttttttttattttttatttttgagacagagtctcactctgtcacccaggctggagtgcagtggcgccatctcggctcactgcaacctccacctcccaggttcaagccattctcctgtcttagcctcccaagtagctgggactacaggcgcccgccaccatgcccggctaattttctgtattcttaatagagacggggtttcactgtgttagttacgatggtctcaatctcctgaccttgtgattcacccgcctcagcctcccaaagtgctgggattataggtgcgaaaaggagagtctggatcagggaaagcaggagaacactaacctataggagaaggaaaacgtcaatatctgcttcatctcctctcctttccttccattaccttttccctccacgttcctttcatgtttctcccctattccttttgcccctgtcattttcttctctttaggtctgtaagcctctgtctatcctctcctttctatctgctgcagatgaaaagaagttattgtggaggattgccaacttccatctccatgactttacttcgtcttacattatcctcactacataaatcttttctgaacaaaatgaatgccattcgttctggtcctagaaacttattgagactttgaaccattcaggccaggcaaggtgctagccagtcacaatgactttccaatagcttagtatacctgccatgtaaacaacctccttttaagagactccatacaaataggtcattttgtttgtgttcaatgatatcatgaccttgaacacgatggatttgacccccaacccaaaagaagcaagtcaatttatagggattccttagatctatgaagtgacttggtgtgaaagctctaataggaatgccatagactggatggagacttaacaagccaattcgatttttctttgttgaagagtttgaatttgagacacatgtagaataattttacaaaagcagtgctaataatagaaatagaggtaaaaaattgccaagtcattcaagccagagtctggaggattggataccacagggcaatcaccagaatttctatgcatcatcagagcaggagttgtacttttagaactattgcattgacctcaataaaatctccactcaggccaggcgcggtagctcatgcctgtaatcccagcactttgggaggccaaggcgggtggatcccatggtcaggagttcgagactaatctggccaacatagtgtaacccgtctctactaaaaatgcaaaacattagcctggtgtggtggtgggcgcctgtaatcctagctgctcaggaggctgaggcaggagaatcgcttgaacccagaaggcagaggttgcagtgagccgagttcatgccattgcactccaccccaggcgacagtgtgagactccatcttaaaaataaataaataaataaataaataataaaataaaataaaataaaatctccactctaggaatcctgcttagtataattgtaaaatgctatttaggataaactgagtatctctgttccttatgcctcaaagtagctcaacttacaaataataaggaaagttattttaggccaggtgtggtggcttgttcctggaagcccagcactttgggaggctgaggtgggaggatcacttgaagccaggagtttgacaccagcctgggcaataaagggagaccccatctttacaaaaaaaaaaaatagccaggtgtggtggcacaggcctataagtcctagctacttgagaggctgaggcaggaggatcactggagcccaggagttccaggctgcagtgagctatgatcatactactgcactccaacctgggtgacagagcaagaccccatctttgaaataaataaataaaattatttttaaaaagttactttaggctaagatctaggcagaaggctataatgaatagaggaagtagcaataatataatccaatattgataatcatgaccagtagtagttattgaaaaaaaattaccatgtgccagcatactagaaatgtcaatcattgtgtctgcttgcctacacagacctctagggcagttgttcctctcaaaaccactgattgaaggacaaacctaggttgcaatattgtgtattacctgacctcacccttccctttaaatatttagaccaaaggtgagcagctacttcaaggacagcaaattcatagttttatatatgcatatatatatataaaatgtgtgtgtatgtatattgtgagcatgtgtgtatatatgtttgagtcttgcacttaaaatgtactttatgtaaggaatgtctgaggaaatagaaataaatgtataaaacaaaaaaggaaggataagctaggccagtcagatccctgtatgggccatttaaactaagaatatcaagataatgacttaattagctcattgaaaggttttgaaaagtcataaggcaattgatggcatgaagaacaatatgcaaactcaagtaaggatgctgagcccttgggctgtcagaatctgtgatgcagagcaaagagagggcagaggaacagaatggaccaaccagggcataggcacagagagaagcaaaggcagagaacacacagctcacggtggaagggaccagggaggacctggcctaagagaggccctgtctgcagaaagattttcaggtcccgtctgagtccaaatcaatcctgacaatgaacccgattttctttgaggctcagtgatgtaaagcccctttcctgaaactggtgagctaatatggactggagcatttatttgagtctagggctggtttgctctttccactgcactatcacgtgctgcagagcttctacaaatgtggaagaacgtatgagtcttaacaacaacgatgctctatcactcatatctatctttttctccaagtaccatgcatgttttctgtatgtgtatgaattatatccttttggtcattttgaatgtgcccctctgcctcttctatcccaatctcttctaactacaatgtttctggcaataaagcatttcatttgaatgaatgaaagtaattaagttgtctctcatattttacctgtttattttacatgtgaggttgctgaatgttaatttaagctgtgttaatttataatttttttcacattttaataatttattttttattgtggtaaaatatgcataacattgaatttaccatttaaccatttaaaatgtacaatttagtgtcatacacattgttttgcaactattatctccagaacttttttttaatcattccatactgaaactctttttttcaaactccctgtctctctgagacagagtcttggttctgtcgacaggctggagtgcagtgtttatttgtagtttcttccactgtctgccatgtcctcctcctcagtccactattcatttacattctttcctatttggttttcatttaccactattcagtctcctcaggtcaggtcttgaaacattctcttaataagaaagaatctgatgtaaatagcaatagtagtgacatctggtctggcttttttaaatggggaaagattgaaggttgagataccttttcaaggtctgccctttgtggctctgaacaaaaagactatcaacatgattatcaaggaaacagttttttaatactctttcctcaacctctggacaatacacaaaatgggatagctacgcctcacaatcccagcaactgatcacattcccctccaatatcaactcagaggcctgaatctacctgtgaattttcaccacctttgcctacatggccaggtagatgcatcttagggaatggcatccaagtaatactaatgctctggaatgaagagattcccagtctagcaagtcacaaaattatgaaagagcagtgcccagaggttcctttcagatacacaattcaacatccagttctcaaaatattaggactgcatggcactatccatcagcctggtgatcttcagaggaatccgggctttccagagagccagcgtgtttcagctttgactataactgaaaaacttccagtaatagctttctttatgatcattgacattcatcactggcatccaactgaagttctatatatcatattcacagatgaacatattcacagatgaatatgatttctaaactgggtaaactagaatatgccacttcatggaggttgcctacctgcctttcctcaattttattccaattctcatttataaatgccctttggctggctaatattttggtaagcacataggtaggtgtgtgtaaattgtctatcatgcattccaacaatccacgcttgcttgccgaaggaaacataccataaatcatggtatttgtcttcccccagatactacttaaaagggcacaaataaatgatgaatattatcgtcaatggctcactccttcccatgccacaaaatataacgaatatcactggaatgggagttaggagacctatatccttgttccagttaactgctgatagggtgacttcaggcaagtcaccaactctgaaaaaccctccagagtgaaaataaaaatcctgtcctactttccacttagggtaactatgaacaggatgaagtgatgcatgtgacaatttatttatcactactatataaatataaggggtcagcgtgaggcagggagggacaggggcgggatagcagttgccagtgataagaggaggtccattctgttgggggcactgcttcgggagatctgtttattctgtaattaacaataagcaagggagacctctgagatgcttacttagaggtcatcatttcaatttgactgctatttaataaatattttctctggttgtagatagctcccttaaaaataaacaattattttcagcatatgagcgaaagaaaatacatttatctgccatgtgctagctgttcgttataggatttaagggtccatgaaaaaaatgataaaaaagaaaatactcagaataattcaacaattattttcaaagtgagatagatcagggatccctcttaggggcctgccagcccctgaaccatagatataaaggaaaatcttgagtttcttcaaggggaattccaggcacataaaagtaaatgagcaacttggcaagcaaaaaggtaatagtggcttaaaacaatagtcaaggaagttagagttgcgagatgtctgattccctatagaaactaaagataacatcttaccataaatcccttagttgtttttcagaaacccagacccccaccaaacagatctgctggcatgtagacctcagataaggaggagctgaggactggactctgactgcctgccgtcttttactccaaatttcttcctcggaggcctggaaggagtcatcctcataagccaaagctagcatccttttctgttgaccccaagtctttagacaatgcttcctttccttaaccaattgcaaatcagaaaatctttgaatctacttatgacatgttacccttcgcttcaagatatttcgcctttataggccaaaccaaaggataacctccatgtgttgatttacaattttgcctgtaacttccgcttccctgaaatttacccctacgtttaacaacccttgtttgtaagctatcagagaggtcaggtcttcagagtgaggtacctgattctccttgcttggcgccttgcagataaacacccacctttctcctgctgcaaaacctgggtaggaatgtttggccttaccatgctgggcaagtggaccccagttcagtttggtaacaataggaatctacataaaaaaaattacattatttcactgaaaaattacagcaacaaaatgaatagtggtgcttttgctgctgctgctgctgctgctgctgctgctgctgctgctgctgctgctggttgttgtattgatcaattccatgctaacaaatctttttcatttgatacgtttctgaaattttaaggtatgtgtgtggtgtgaggtggaggggggaccttgggtagaaatactctgaattctattttcctagagttatttgcttcttaaaacaagccagtgccatcatttataactataaccctgaaggcatcatggttgcctaaatatataagcaaaatgaaatgtacaatttgcagaatctttatttgaatactttaaaattcttgaatggtttaggggaagacatgcaagcagtaaaaaaaaatcaagtgtgatgctatctagcaatgtttattaaatgcctacttgtggttctgtttgatattctgaaggacaaaatgaatgtaattgtggaatcatagagttataaagctggaagggattttaaatttatcttatctagcttgtacagtttactcacggaggaagtgaggctaaaatataattagttcctgaggtcattcaggtaggaaagacaggactcaaacccaggtttcccaagacctaacacaagactccttccaacaccctcccatttgaagagccctgttatatcaactattgctaatgtataatgtaaaattccctaagtgcatataaacaacgaagtaatttctaaacatgatattactgcaaggatagacctgaccattaactttaggctctgtcaacacatttaaaagtggagaaggggtgttcaggcattactcaagtcatttgattaatgccagcagttcagatctttcaggttctaaaatggactgctgtgtggataagctgatttgatagtgtttaggacctgtttcaaagggtgcgtggaaactctttccttcccttcttgctatgtataatagctttgcgtgggtgttgaagccagagaattgtttgaaaagagaattgctgagaataaatcaaatcaccagtcttcagagacaatcagttaggtcacatttagtcaactccgtgaagcaaggacaggggttggtcctgagtcttgtatttttttccaaaatcgctttgcaatgacatcaactatggctgactccccattctcctgcttcactgcttaccatataatggcccattatgaatgttttgctgaaggcagaaattaaccttttatggaagttttgtcccattaagtctagttacttgaatctggactgattttctttctgatgagaagacttttagccaatgttttaagtgcttgaaaaaaatgttctggtcttgactgtctgtgagagccttcctggtggaaacagaattgttagtcagctgtcatctccatggtgattttttaaggctaagtgtaagtcattcttctaaatattgaggcataatttgtgaatatgcagttgaataaataataatagaattttaaacaagatagactgcctttaattctgctgtttgagacttttcatgtgctagtctaatctataactagtcttcaaacatgaccttaacagtttctctgaaaccacctttgcaaagattatggaagtgagagaaatctaacgtggctgactccatcctgcttgtagccttacaggctggctgtccctgttcattcctgggcagaggccaagataaccatgggaggactttagtttttagtttaactttgaagcaaggatgataatagtccctccctacaactgatcccctccttgtttgggggatgaaaccaaaaggccacaaaataagggatatgggaggggtctgaattctgctcaaatgtaggcataatttctatagctcattacagctcaggagtcatgtagccagaggtcgcaagatttgtgacttccccaattgctctcatagatctcatctctattgtagaacctaagattgatcttttgagatcaactccagttatcctgtgtgtctggccttgcatcagttaaactcctttcttgactgcaataccacagtctcagggaattggatttgtctgtgcagcaggcaggaagaacctgctaggtgattacatcccctcctcaatgatcacgttttatctgcctgcctgtgttttatttcactctacccactttccgtgtatccggttccttcaaagaatagctctattctaaccactaagtcttctcttacacccatctctttgtattccccagtgtcttatgcaatgcatataacataggctcccttgccggaggaattgccactttgggaaaaacaactctagtttggatgtcaggagatcttggttgaggttctaacactgcccagtacaagctctgtggccttattaagtttctccatcttcaattcttccgtctaaaaattgaacaagttgggcaagatcatctctaatgttctccgtctgtggattctatgatgaatctcagttatagaaacaaaataataaaatcatcagagagcactggcttcctgcactatacttttaatagagtgttttttcatccattatctcttcaaatttatgctcagaggtcagaattatgataaacagctaaaagctgctgtgagctggggagaggagtaagtgaattcacctctccaaggagacttgttctgcagcttgtgagtgctgttaacccaatgttcccagtggcaaagtaggggcatcaaatgatttattccttattttatctctttaagtgtccagaaagctgttaaagcaagaaaaaggtctaacagctccctattggccaagaataagtctttgggatcatccatttagaacaatagaccagaatgtgtgaatcttcaactatattccctcatctgaaccagagagaggcagaataaacaagccagtatgttctgtgcttacagacttcctccttgctattatcttatttctccatttcaaaccttatataggttaaaaaaaaaaagtaaatagcagaacaaaactgtctcccaaagttcttggagatggctaaaataaatatttattaactgcatactatgttatatttataagttacagggtcaataggatgtcatgattaagattatagcccctggagctggttaatacagtacttcaacagtatctggctcaaagtaagcacacaataaatgttgccttttaatagtgtagttatttattattgtggttacttctgggtaccagatacatggtgaggaaaatagtaagttccctttttccatgggctgccaaaataacctctacatatattgataaatattttttaaacactgattttggggaaattgttggtaggacgataagacatactccagatattctggatccattctcctcctgatatcacaccaaattttccaaccttgtgccataataaatgggacaaatgtagcatttaagttaaaatgtaaaaactataaaataaatttacactgcagctggggtcaccttggtcttgtcctattttgtaatcctccaggctgaaccagatttcttttcattatgggagtgaaaatgaactcagcggattttctccccgattcctctccattttctgttttcagacttctccatcatgttcttgtgcctggtgagtcccgttgtcaggtcttgttgtgaccccagagatcaattagagggtcgttcagtgttttaccatttacttggcaaagaggataatgcgggcactgtgagtcaccacacggagttatggttatacatgtgacattaaaattaattgtacacgtgaatacattggtggtgctctaaggcattggatttgctcagagaaagggatggcttaggagaagacagagaaggtaagaacaaattctaggctaggaggcaagccagctaatgagtgacatttccccatgccaccatagtggtcacagctccttcaggggcaagctggggcacacagccttcttcttttatgctctttccctctctaaaaacactgggagccatatcaccctgagtggaccaacacagtctctaattggaacttatttttcagtttcccatgctctactggtggctctgtgataagagagtttatggaaacataaagagcccacgttagtgtttagccagtgtcaagtctgactaaaaatgaaatcttgttgttgtcatgctgtgggatttgcaaagagagccgcactgaggctggaaaacaggggaactcaaggtgacaattgtatgtgggttttaaagggcagctatgattagaaatgtgcctgtaaaaatggcatttcaatgttccaaatgtattcccctttggtgatttccaggtcaaattcacttagtttacaaataaaaacaaaagattcgcaactgcagctctgggagctcagtgaaagacttgaataaaggagagacttgtcctgtcctcggctgaagagccctgctccagcaggcaaggcagaggccgccactgagcagcagagcggccgaggatgggtctcacaggcgggctgctcggcaggtgcagccctggtgcccaggccctggggttctgcagtgccactaagtgcacaccatctcagccacactcgagagagcccatctttgtcaatgagtgcttttgaatggacaacaaatgcattgccaaattgtaaacagcagtgtgtatgtatgtgtgtgtgtgtgtgtgtgtgtgtgtgacagagagagaaagagagagagaacaacagataaacaagaaaaaaaacaaaagtaaattactcactgtgccaggtattgtgacaggaagtgctagtcatctatattcttgtggaaaactggccattatctggtgtatattgacacttccaaggaatccagactcaacaccaccccaggtgctatgctttgtagataggggaatgttagcaggacattcaagatacgggaatgttatcaggactattaaaatatttcttctctgacaaaaacaagtaatggggaaaagcctccctagtcaataaatggtgcttggataactggctagccatatgtagaagattgaagctggacctcttccttataccataaacaaaaatcaacacaagatgaattaaagacttaattgtaaaacccaaaactgtaaaaaatcctggaagacaacctaggcaataccatgctagacataggaacagacaaagatttcataacaaagacaccaaaagcaatcgcagtaaaagcaaaaattgacaagtgggatataattcaacttaagagcttctgcacagaaaaagaaagtattaacacggtaaacagacaacctacaaaatgggagaaaatattttccaactatgcatctgacaaaggtctcatatccagcatccttaaggaacttatataaatttatgaaaggaaacatacaaccccattaaaaagtgggcaaaggacatgaacagccacctttcaaaagaagacatacatgcagccaacaagcatatgaagaaaagctcaatatcactgatcattagagaaatgcaaatggaaaccacaatgagatatcatctcacacctctaagaatgctattatgaaaaagtctgaaagtaacagatgctagtgaggttgtggagtaacgggaacacttattcactgttagtgggagtgtaaattagttcaacaattgtggaaagcagtatggtgattcctcaaagagctaaaagcagaactaccattaaacccagcaatctcattactgcgcatatatccagaggaatataaatcattttactataaagacataagcacacaaatgttcattgcagcactagtcacaatagcaaagacatggaatcaatctaaatgctcatcagtcgtagactggataagtgtaatacatatactccatggaatactatgcagccatgaaaaggaatgaaataatgtcctttgcaggaacatggatggagctagaggccattatcctcagcaaattaaaataggaacagaaaaccaaatatcacatgttctcacttataagtgggagctaaatgatgagaacttatgcacacaaagaagaaaacaatagacactgagttctacttgaggatggaggatggaaggagggagaggagcagaaaagataactattggatactgggcttaatacctgggtgatgaaataatctgtacaacaaacccccatgacatgagtttacctatgtggcaaactttcacatgtacctccaaaactaaaataaaagttaaaacaaaagtttctttcaacctgtaaaatattacatgctatgtactaccctgttgcacagcctcagcaggctcaatccttctacagcctggacgtaaagcatgcagggacctcaaagtagaattgcaagaggtgagaccatacagctaagggaagcagagtaaggtctgatgtattaaattaaatagaagaaatggccaatacagttggttgcccatcaagtatttagtctcttattgttccttgttttgagacacactacttttttggggtgcagcaacatatccattccaaggcatgattgtgcagagacacttctgataagtgtggtccctaattttccagcttcccttgcttctgtgggaagacttgctgcccatggaagtctgctgggaagtgggtgtgaagagatgagctatgaaaatatttgctttcctgattatagaaaatagaatggcctccaagagccctttccccttttatagtcttcccatcttgcacgggacacagatatgatggcttgagtgtcagtaacctcgctgtgaccaggagaggaaggccacaaaaatggaagaaacttttgacctaatttggtagagctactaaaataatcatagtaattgcctacctccctgatcttttggagaaaaccaaagtgttgttccctaatgcctctgtcatgggattttctaattcaggcagctgaacgtatttccaactaatatggaagaatggcatgggggctgttccatctgcttggagggacactcagccattccaagcacctagtccaggatacctaacaaaattgagactaactcaagccaatatctctctctcaggggttggagaaagcaaggtatgaggttttggagcagcagccgtagttctaaggatgggtggatatcagagttgaagtaccaagaaagccttttgaggatactctgatcctctagttcagggtatgtaaaagcagattctggccccagtagaagtgaacttctcccaaaggagaagactgaatttattcaccgcctgggttttctttttactggagaactgcactaaaacaaaacaaaacaaaaaacatctgtcttccttcaggaccttgcagcatcaatcagtttcatgcaaaggagaagctccagcgttgtcttgccacaaagagccttgggggtgacccacattcactgtcacatccttcacatctttttccatctcgttgttgctttttgccacttctgaaattgttacacattttcttgtttggatccctgcatagcctgtgtgatggttaatattgagtgtcaacttgattggattgaaggtgcaaagtattgttcctgggtgtgtctgtgagggtattgccaaaggagattaacatttgagtcaatggactgggagaggtagacccactctcaatctggatgggcaccgtctaatcagctgccagctcagctagaataaagcaggcagaagaagatagaaagagcagacttgctgagtcttctgaccctcatctttctcctgtgctgcatgcttcctgcccttgaacatcagactccaagttcttcagcttttggactcttggacttacaccaatgatttcccaggggccctcaggccttccgccacaaactgaaggctgcactgttggcttccctactcttgagattttgggactcagactggcttccttgctcctcagcctgcagatagcctattgtgggacttcacctcgtgatcgtgtgggtcaacaccccttaataaactccccttcaaatatacatctatcctgttagtcctgtccctctaaagaatcctaatacagcctaataacttacctctctcctcaaaggctaacgtgatgtttccctgcagatatgccaacttatgtgagtttgggtaagcatttatcctctccatcagtaccactctttctgagcttttgctgatcacctgagtggcaaataagcagaagactggaataaggaagaaagtcagccaaatgcaccagtaattttggcagaatcttgataaccatgggagagaatagagtacgctgtttctttttttattttatatatatatgcttttttttttccagacagggtcttacactggcccaggtggaaccattattgattcaccacagccttgacctcccaggctcaagcaatcctcccacctcagcctccctagtagctggaactacaggcatgtgtcaacaaactcagctaattttggtagtccttttttttttttttttttttttttttttggtagagacggggtttctctgtgttgctcagcctgggctcgaacttctatgctcaagagctccacctgccttggcctctcaaagtgcttacagacatgagcctgtgcccggttgagtgcactgtttctaatggagccctttgatttggtatgtcttgtttgaaacacactttcttttagaaaaacttaacctcttaatttgttgatctgtaaaatggagataataataatatagacctcatagagttgctgtttcagctgagatgatttatcaaactatttagaagattgacagcacatggtaagtgtccaagaaacgtaatctctctgagtgatcaggcactcactcattgaatcacaaatactcattaagtactggttatatgctgaatacctggcatataatgttgaccactaagccatggtccctaccttcagggaacttataagagtgttgaataaaaattatagaaggaaattgttacaaactaagtgcacacacaagggcccaacagaccaaactaaaagtcaaaatggagtcacttatgctgaggctccacatcaccaaaccaaaactgagttatccaacttgagaaatctggagggagagataggcaaatttcccaaacaggccagtttcaattggcgtggtaatgaagttccctctgcctttaactcttaaacaaaaagtaacctgaagtaacttgatgttagccaatcacttttctattgttttgtttctgttttcctaccttacaagaaatataaatttgaaaggaccaatcacttcctgttctttgtttctgctttcttcagccctgctctgcctataaaaccaatgtcctctgctcagctcactggaacttattccattttatgaaatgaagtgttgcccaattctaggacctcaaataaagcaaccttagatctttaaatgtaattcttgtaactttgtcttttggcaaaagcaatcagtagataaaccatactctttggtcctatgcgtgctgtgatatgaagtaaaaaacatggttctaagtaacatggaatctacttgcaaaggagactgtgacatttacaagatgaatggatatatttgaagagcacaaactctttggcttttggttaaatattctgagactcttttcctccacatttgaaatgtattcacacttccccaggaggaaaagctaaagctcaaccctgtcaggacgttgtaatttctgggtcagtcaggagaaaaactacacagtactttaacagttatggtaatataaatattctaatagggaattggagtaatcaggaattaggtcactggaagtcgagaactctaaagaacatagaaatagtaaacatgacgaacagtcacagctatggagcagagacatcacgcccaaggaagagccctctgcagtggccattccccacccaaagctgagatccaacctggctggagaggccattttgtggctcatgatggcagagaagtcactgtatatagagataatatacgtagagaagccatcctggcagatcttgctggaaataggccctttggaatttgctggaaaactgccctccaggaaaacttcaccaggaggcatctttcttactggaggcactctacaacaaagtgctcaaagaagagctgccaggcaaggtgccagccattgagagctgctgactgccatgcaatgcagagcctgatgcaggagaaccatgcacactacaggagcaggcccagggaacatgccagaagcaggaggcaaaattcttctctgccagaatctctctccagtgccttgtagtgaattagtgctagctggtggaagaaaaagagttaagattgcagatttatttcaacaaggcagtaaaaagggtgatattggaactgagaggcaatggatgaatagcacaggcatccaactcgaaccaggcaatatacagtattctctccattaggacagaagagtcaactcttgatccagagagttgagaactaagatgttccttttctccttaactgcctcccctgtaaacctacacacacaaacacacacatacgcaaaacattcagtacacagtggtgtaaccagaataggataactgtagtaaatactcccattttaaaaagggaatgtgagggagacagcaacagtcaccacccatagcaattgtgcttggaggactgtgaagttttcatcccctaaggtggaggaggactcaagaggaagtcatggttctactcctggaagggctcatttgacatttcttctagattccctgactctactgtcgggaagtttcttccgagggttttagaattgtttcagtaaaagatatgtttacattctgaacttgtggcttcttaggttattcattgtctcaaaaagttaatcagattctgactcatggactctcactcagttccaggaaccagcaaccacacctagacatctgaagagacatagattttagagccactttattacttttcattttttccctcacacctctctctctcaacttaattaaaataccttaaaactcaatctgatctttgcctagaatcactttatcttactgagcgtttgtgattcaaagccttttgtaatcccttctcttacagtttgggctttagaaacagtcggcttttctaaccctgcaaggacccaattttctggattctatttcattccagttcatttctacttataaggaggctaatgaattactgagttcttgtctttcttgtaataccttgtcaatccaccaatagttgctaatatctcagtaacaactgccttttaaattttgtattatttccttctaacactgcaggcacattgtacctgttctcacttttcactgtaaaaaatggatcaccatcttcttagcctcactgttaactgctcaactccttattcaatgccacataaattaggtttttgtaacgtcattaccctacttttggaaccaagattcctataagtcaggagagttaacagatttggttacagtgtaaaagctctaaaatctcaggtacttaaaataatttaaggattatttctcagttaacctaagtctcatacaaattaaagagtcctgttctatcttgaaactacctatctggaacacatcacttttaagattagcatgataaggaagaagaaaaatggcaattctactggaaactttgtgtggactttatatcctgacatagaagacatggaaagagattacaacatatccagatgtggaaaaaaataaattcacaaaacagtattcaaaatttctattaattttggaatctgtgatatctctctcctgcagagagacaggagctccccagtaggtcttctggttctgtgacaaaatacacagggttttacagacgaccttgaggatgtggtgtctgatttacatagggcacgagagattggttggaccaggtgcgccattcacacagtgtgtgaagatgctggccaccccaccctaatcttttgttatgcagatgggttctctacccggccggcaccatgttgcctgcttttttactgcacatgtggtgatgaagaaaaaggaagagggaacctccatgttgaatatacctggcttccaggtatcccttttctattggcacagctgctggcatttccctatgcaagttttagcttgcttatctatgcttgcagcttgatttttcaggctgctttttattaaagggaaaccttaccaaggactctcttaccctcgctgtctgcctaaatcatttccttctagctcctgtatcaccagcccattggccaggagcagccaaatggcccaaacctaacttcaaggaagactggagaatgtagctggcacatggagtacttttggaccacgaactttctctgccacagtataacatatgctgtgtcaaaaaagtatgcctaagataaaatgaaatctaagataagacctgaaggaagagtaagagtcaggtgaagaatgaagggtggggcgcggtggctcatcctgtaatcccagcactttgggaggctgaggcgggcggatcacctgaggtcaggagttcgagaccagcctgaccaacatggagaaactctgtctctattaaaaatacaaaattagccaggcatggtggcacatgcctgtagtcccagctacttcagctacttgggaggctgaggcaggaaaatcgcttgaaccagggaggcagaggttacggggagctgagattgtgccactgcactccagcctgggcaaaaagtgaaactccgtctaaataataataataataataatgagggcaggcatgtttcaggatggccgaccagcatgtgcagggaaagcatggcaccattcggggaacatactgagctgagttaggggaccaattcaaagtcagtcctgatgatagagagacagaacattcgactggacatcgctttgctcagaactttagcaatgttgaagtcataagggacgcacagtagaactgaaagaggaagggacaaaaataactgtttaagatagtccaagaatatgtagtacctacataagtaatctgcatatttttaatgccttcattcatgaaatctgcaaatttttaataccttcaattcattttcagaaatgaatatgtatttcacattagaaaacaagtagaattaattatcatcttttactcagcaattccattttcaattttcttaagggcaataagtaagaatctttaagatagagtgacaatacaatttattgaccgaactaggagacttttgcagggaaaagggttttctctaaatacttacagtaggacaacggctgtaaactggctctttcctgagcaaatcagaatgtatggtcatcgtgtatataagtattatgaaatttgtcacatcattgtttacaatgtcacagtaaataaattatagcaataaataggaattataattatcatgtaaaatgatgacatagtaagcagctgataaaacaatgttatgcctgggtgtgctggtgcacactgtagtcctagctacttgggaggctgaggcaggaggatcgcctgaaccaggagttcgaggttgcagtgagttatgatcttaccacgacacccaagtctgggcaacagagcaagaccccatcactaaaaaaaaaaaaaaaaaaaaaaagttataaagaaaatatttgatatcatgaaaagagttcacgatatgtaaagatagagaaaaaaagtttacagatttatttccattcaatgggtggtagtagaaaagatagtaaaaaaccagccgggcacagtggctcacatctgtaaatcccagcagtttggggagccgaggcaggtagacggcttgagcagaggggattgagaacagcctgggcaacctggtgaaaccccgtctctacaaaaaatacaaaaaaaaattagccggttgtggtggcatgcacctgtggtcccagctacttgggaggctgaggtgggaagatcacttgagcctggaaggcagaggttgcagtgagctgagattgtgccactgcacttcagtgtggacaagagagtgagaccccatctcaaaaaagaaaagtaaaaaactgttacaacttattaaaattggttgactcattgaatagtagaatgatatgtgtgtgcatatgtgtgtgcgtgtatgtatgttttctattttgattcattgttattagtcagcagtctggggatacagcactttaaaaagatacttttggacctcaccaaagtttttacaagtagattcagctgaaggacagctcagagtcaaagaataataattcttcccaaatgtatagcactttcacattaaagtgccttcatgtgcgttatctgatttcatctactcaacagaagacaggtattataattctcattttacagttccagaatcagaatttctgaaagattaacttaattgcccgaagtcaaacagatattttaaggtggggtgagaattataactcacatctcccaactctaagttcaaatttctttcaaagacagcaacctaggttcatcccgggtcactaattatgatgcaatattttattacaggcagtgttaaggggctactatttggttggaagaagcctttggaaaagttgttgaagagtcacgtgcacaagtgatgtgctgagcagactggatcttgcctgatggccagaaaattaaaacaacactgaaattaataaaaattcaaactcccattctgctatttgaatacttcactgagcttaaggatataacatttaggattctttttttttgtagtggaatttattccagtgctagtttatatagtatatataatctacttaatttatcctttccatacatgaacacatgagtccataaaccttttattcatttattaatagactcactatgattatttctgttgaagtgtctagtggggaatgctaagaaataccatgaggaggttgggcgcaggggctcaagcctgtaatctcagcactttgggaggccgaggcaggtggatcgcctgaggttgggagttcgagaccagcctgaccaacatggagaaaccccgtctctactaaaaatacaaaattagccaggcatggtggcacatgcctgtaacctcagctactcgggaggctgaggcagaattggttgaacccgggagggggaggttgcagtgagccaaaatcatgccattgcactccagcctgggcaacgagagtgaaactcggtccaaaaaaaaaaaaaaaaaacaaaatagaaaagaaagaaaaagaaatactacagggaggtgagatgggagatgggaattgattcatcccttcgcatgtcccctgcccattactcagaaatctgtgtggcatcttttcatatgggctttaagttcttcaaggaaccttttaaggatgtggcaatactccctgcaagcacacaaacctatccagggactaccgacttaatcagctagaaacacgaagatcatctctgctgcttctctgaaaattaaatgctaaatttgagaagggtggtgggaattctttgctgatcttaatgaataatgaataatgaaagctgcccggctcctgttgactaagtatatgcttggatttgatcagccatttaatttcatattttggtaattgttttgaatgataccagaattgagggacagttactcacatgagcataatttctagtcctgaaacctggcaagcttgtcttattgacctgacctaaatttatattgttggtttttaaaatttagtattccttcaggtatttcataaattgctttaggtagattttatgtcagatatttcatattttatgttgttctatgactcaatcatttgcagataaattatggaactttgaaatgtttgcctgatcatggcttcagggcgaaaacagaaaggattgctgagctaattccagcgaattttttattaatttattttgaaaatatcaaactttgttgtaattttgttatcaaattgtaagtcatatgattgctttacaacactgaaggaagaaaatgtgcacaaaagagtcaaaagatataggcattgagtgagatccagggttcaaatcctagcttcaccgtgtagcagctgaatgactgagggcaagttagccttatatttcttattttattactcattttaaaaataccaaatttgtgaagttgttgtgattagtatataaaataattcatacagattatctgacgttgttttttcctttagattttacattaaaaatatagtattttttctgctatactgctatctgctatactggtgataacggacattaggagaaacattaattatctgctttagctgaagtttttctctacatcatcaaataattttcccccattaacatgatgttaaggttgtcatctacctcaaaagatgaaagagagcctttcaattctgcaattctgtggctatactggtttaacattttacggcatgacagaagcaaaaatagaaccaagagccccatgagttagcatgtgcagtgacactgaggctccctgacttggggggaggaggtggatttagaccaaacaccaccagacagacacccaggcaataagctgcagactgataaagagatgaatgaaatacaccaatgagcacctagaaaacaccaaagcaaacacaaaacaatatgtgtaaatgacagatttaaaaaagaacatattgcatttttaaaaataaaaaatagtcattagaattaaaatgtaaatggacatttaaaataaaaacgtagacacatatggaacaagaattggtaaattagaagataaatataagaatactaatatcgaaggaaaaagaaatgaatctatttaaaaaaggttaaaactcacctaagtggacactagagccactcatttgatttgtctgttttttgactgccataagattacccttcctggtcactttgtacacttagaggattatgcgtggcccatcatatttctagccaacgagtgattgaatgcgtgtgatgagtatgtcttccaaagtaaatatttaattgccagaacattcttttctgtttgagtgccaacaagatgtcttagctagtatccctgaaaaactgcaatgagcagagtgccattgatatatctaaaataaacatgtagcatgaggaagagaaaaataaaataactatttgatatcttggacgagtgagatgtcaagaatgtttaatacactagcataacctagcccaggaattggtaagctaaggcctgtaggccctggataccactttttgtaaataaagtatcctggaatacagccacagacattcattgatgtaacatctctaactgctctcgtgctacaacagtggaactgaatagtagtgacaggaactgtgtggtccatacagcctacataaaatgtctcccgtaatgaagaaatggagacaataaaaactgcagaaaaagtcacgtaaaagttccaacaggagataatttagaagaaaaaaagaaatactgtaaagaataatggcagataattttcttaaatgaaaaaaataaaaaaataatgacccattaagatttttgtttctctttttgatagaacagattgcagcagacccatgttcctattaggaaaaacttacaaaatcaagatgaaatttgaaatctgtttgaagacatcagaaacagtcaggagttttcctagaatcaagtaactaagatcccagaaagaagaaactgtagcgaggtatgcccatgtcctgtaactgctccacccttcagggaattttcaaacttttggagccaattcaggaagaaggccactgttaagacataaataaactagatgaaaaaaatcaaaactcctagaatagagaggataacatagatatttcaggctgtcaaataatcaaaagaaagttgacttaaatatattaataataaagtagactctgagacaaaaaatactgctaaagaaaaagaaaggggttacataataacaaaagggtcaatccacaaaaatcataaaactgctaatgttttatgtgtataataatgctttgatccttctccattctagaacctggaagaaaagagtaaaaaaggttttgaaatatgtaaagtaaaaattaaaaaattaaaatgagaaatagacaaactcgcaattacagtaatttatgagcctttgtatatgaacacatatagaacctcactatacccaatgatagcaaaatagcatattttttcattggacataggacacttatcattaataattatatactgggcctttaagtgagctcaacaaatttctaaggaatgattgtatgtagagtacgttctctgattacagtggaatcaagctataaatcaataacaaaaagtaaattatcagccgtttggaaactaagatatacttgtaaataagacaggggtgaaataaatcaacctggaaattagaaaatattttgaactaaaagaccaaaaaatgccctatcaaaatatatctgttaagcctgtttagaggagaaattacctaaaggaaagataattttaaataaatataacttaaaaaataaattctcaaaaaacagtaacttatgtaaccatctcaagaagctaaggaaagaataatcagttaaccccaaataaagttaaaacaagaaaataataaaaagatagactaatggaataaaaaacaaatgtaaaataaaataatataaataaaatcaaatttacatttgggaaagactaattagattcatagaattcaaccaagagttaaaaaaatactcatatcaggagtagtaaaagagacataatcatagattttacatatacaaaaagaaaataagaaagaagatttcataagtaggacagaaaagcagtaaccaaaaagaaaaaaatatatatatgtatatatatatgcacacacatatatttgtgtgtgtatatttatttataagttaagctctactaaaattaagatattttatttactattagaaaccactggaggatggaatggaaagtcagagtgaaatgtacttgcaatacagaaatccaataaaggattcatgaagaatatatacaaagaatgttaaataagaagaagaaacacagctaatccaattaaaattggacaacagatttgaaaaggcaactcacaaaagaggatgtcaaaatggttaatcaatacattaaaatgttctcaacatcattaatcatcagtgaaatgtaagtaaaaataacaatgcaaaaacactacaatccccttagataaataaaaaaataaaataaaaacactatatgaaacaaggctgagagtagagtgagataaacgaagtgtgtctatggtatagaatttaagaaggcacttactctcaagtttgctcaaatgcagagttctacaaaaacctcaaactgggtgccttcttaaattttgtgtccgagcacctaatttttagagagacaccctcttaagttcatgcaagttatgctaggttcaaaagtcaatgagggtgtgtaccttttaaatttttctaccttcattgcctcacctgcctcattgtactcctggacctaatgttaagtgttggtgaggataagaagctagtggaactatgaactggcacaaccacctgataaatatgttggcatattctactaaatgtgtacccacataccctaagttttcagctgttctactctttgctattatactcaagacaaataaatacttacgttcatcaaaagtcaaatataagaatgctcacgactgcccaattcctaatagcactcacaagaaaacaattcaaatgttgatccaaaaaatatgtaaagacattttagtaaaataattcaaaaaattctatatagtaacaaagtgcagctgtacatgacatcatggttaatctcatataatgttgagtgaaaggagatgcaaaagatcatattaactgatttatattaattttaacaaaggcacttgtctgtgggattagaagtcaggagagtggttatttgagaaaaagagttgctaagatgagacacaaagggaaacttttggaatgccaataatatcatatttattgatctgaaaattgtaaaaatttattgagctccacactcatgatttgggcaatttttatttattgcttttcataagtctatccagttttgcttcttatatattttcaagctctattgttaagtgtacacatgtttaggcctgctatgtcttcttcataaccattttatcattatgaaatgactgtatatatggtaacattgtttccatgaaatcaactttgtctgctgttaatatagtcactcctggctgggcacggtggctcacgcttgtaatcccagcactttgggaggctgaggcgggtggatcacaagatcaggagttccagaccagcctggtcgacatggtgaaaccccgtctctactaaaaatacaaaaattagttgtgtgtggtggcaggtgcctgtaatcccagctactgcagaggctgaggcaggagaatcacttgaaagcagcagacagagtttgcagtgagccgagatcacgctgctgcactccagcctggacaagagcaaaactctgtctcaaaaaaaaaaaaaaatttttttgtcactcttattttcttttagtcagtgttagtagcatacaaattatttcattgtttgattactttacttttcatctatttgcttatttatatttaaaacatgcttcttattggcaatatctagtaaggtcatgatatcttatccaatctaactatctctactttttaattaagtgcttagataattgacacttaatgtgattattgatataactgtaattaaaactggtatcttgctacttgtaaaaaaatttgtatcctttgcccattttttaaatgaggttgtttctttcttgttgatttgtttaaataccttatagattctggatgttcgaactttgtcagatgcatagtttttgaaatattttctcccatcctgtaggttatctatttaccctgttgatagtttcatctgctgagaagttatttaatttaattaggtccaacttgtcaattttttgtattgttgcaattgcttttggggactcagccaaaaattctttgccaagacccatgttaaaaagaatatttcctagatttttaaagaatttttagagtttgaggtctcacatttaaatctttaatctattttcagttaatttttgtatatagtgaaaggtaagggtccagtttcattctgcatatagtcaattatgcaagcataagtcattgaataaggagttctctccccattgtgtgtttttgctggcctttttgaagatcagattgttataggtgtgcagctttatttctgattgttcttttctgttccattggtctatgtgcctgtttttgtgctacaccatgctgttttggttactatagttttatcgtttgaagtggggtagtatgatgcctccagctttgttctttttgtttacaattgctttggctattttggctcttttttggttgcatgtaatttttagatatttttccaattctgtgaaaaatgacattggtagtgtgataggaacagtgttaaatctataaattgctttgggcagtatggccattttaactatattgattcttcctatccacaagcaaggtatattttttccttttatttgtgtagtctctgatttcttttagcagtgttttgtagttcttgtagagatctttcatcttcttggtaagctgtatttggatttttttttttttttttgacagcatctcatgtcaggctggagtgcagtggtgtgatattggctcacggcaacctctgcctcctggtctgaagcaatcctcccacctcagcctcccaagtagccgggactacaggtacatgccactatgcccagctcaattttgtaccttttgtagagacagggtttcaccatgttggccaggctgttctcaaactcctgagctcaagcaatccacccacctcggcctcccaaagaactgggattacaggtgtgagccactgtggctggacaagggttgtgttcttgatttgactttcagcctagacattattggtgtttagaaatgctactgatttttgtacactgattttgtatctggaaactttaccgaagtcgtttattagttctaggagccttttggaagagtctttagggttttctgggtatagaattatataatcagcaaaaagaaatagtttgatttctgctcttcctatttggatgccttttatttctttttcttgctggatcactctggctaaaaaaagaagatggacaagcagccaacaaacatttgaaaaaatgctcctcatcactaattatcaggaaaatgccaatcaatcaaaaaccacaatgagttaccatctcacaccagtctggctattaataaaattcagaatggcttctattaaaaagtcaaaataataataatcagaatagctattattaaaaagtcaaaaaacaacagaatctggtgaggctgcagagaaaagggaacacttataaactgttggtaaggatggaaattagttcaaccactatagaaagcagttgggagatttctcaaagagcttaaaatagaggtaccattcgacttggcaatcccattactgtgtatatatccacaggaaaataaattatcctattctaccaaaaggacactcacacttgtatgttcatcactgtgctattcacaatagcaatgacacggaatcaacctaggtgtccatcagtgattgactgaaggaggaaaatatgatacatatacaccatggaacactgtgcagctatagaaagattgaaatcatgtcctttgcagcagcatagatgcaactggatgccataatcctaagtgaattaatacaggaacaaaagaccaaataccacctgttctcacttttaagtgggagctaaacattgagcacacctggacataaacatgggaacatagacgctgtggactactagaaggggggaaagaagaggagagcatggttagaaaaactacctattgggtcctctgctcactccctgggtgacaagatccattccacaacctcatcatcatgcaatacacccatgtaacaatcatgcccatgaaccctctatatctaacataaacactgaaatttaaaaaaatgttccatctgttattctgcttctctctttctgaattttaattgaatattagtttatggttatatcttttttgacttattagtcatgataacttgtgttattacattagtggttgctttagagttcacgtatctttacttatatatctttaacttgtaagagtgtaagttcaagtggtactacataacttctcatacagtataagaatcctacaaaaacatacttccatttctcccctccagaactttgttctatggctgtcgtacatttcactattgcatattttagaaaccctgcaatttcattatcattttggatttaagatttgtgcaaatttatatgtatatttactccagtacaaatttactaaaaataaaaattttaatatatatctaaagtcaaaataaatgttattaaatattcattgtaatgaaatttttttaaaactcctaagcacaattagcacatacttaaaattgaatcatagaatcacaatgaaaaccctgaaggttaaaatgagtgggttgctaacaaaatagtacttgaaggaaatcagtggccctagctacccttatcagaaaacaaatcagttctgaaacaaaggagccaagaattcaactcaagatggaagaaatagaaatgagtaaatttaaaaaaagaaccagacacaaatgatgaacatgtaatcaaaaatgaacagaatagagaaagaaatcaaaaaatgtaaaaataaaactacagcttggtttacaaagacaagatagacaaacttctgacaagtatgattaagagaaaagaaagattagagtagctataatgataaaatcaacaaaagtttttaaagtcttggaaaggtactatgaaatatacatgattgaatgcatatgacatgaattaatttctgaaaataaattaacaaccggattatgaagaagaaaaatgaaaatcaactagactcgatttttagtatacttaaataggattccaaggctttccctccatagaagaaaggttttaggagatacgactttatatcaaacatgtaaaaatgaaaaattcaataatatatatgttattgtggccatggagaaactcctgctggtgggagtgagacatgaagccagggttttacaaaatagtctagcattttggaatgaaattaagtatacatgtgcatgctgtatcaaatctgggtaaatagagctatacagtttatacgaaacaagttacaaaattatcccaagcaacattgttggtagtagcaagaaattatagactattaatgggtccattaactaggaaaatatataaggaaaaagttataaattctgtattagggttctctagagaaacagaaccggtaggatttagatatagataggtagatagatgattgattagatagatagatagatagatagatagatagatagatagatagattagatagatgatagagatgatggatgatatagatagatatagatataggtagatgatagatagatggatagatagatagatgatagatgaaaagagagtgagagaggcagataaaatgaaagagataaattctaagacattggctcatacagttgtgggagctggcaagtccaaatcccacaggacaaggcagaagctggagattcaagtaagtgttgatcttgcatacttgagtgtaaaaactagattcaagcaaaatttctattgtagacttgaggcagaattccttctttgggaaacatctgtctttgctcttcaacagatcagatgcggtccatccatgtcatggagagtgatctgttttacttaaaaccaaccgatgtgaatgttagtcacacattaaaaaatagttttgcagcaacatcaaggctagtatttgaccaaacaattggtcaccattgtttaaccaagttgacacataaaattaatcatcacatatgccaaagattactatttagcaatgagaagtaaagagctacattttcatagagcaatgtagcagcatttcaaaatgttagtgaaataagaaattgaatggaataacaattaatatttacataagttaaacatgcagcatataacactgaacacatctatgcacataagtgtgtatacagaatgaattaaaacggtatagattgttgaaaataaagtgcatgtctagaaggaacaatacaaaggcaattgggcacaaaaagaaaaaacatgacatgaaacattagaggtgttatacatggtctgatgataagggcaatcaatctagtaattaggaactaagcagtatgattgtctccattctgtgcgtgtgggatctgaaatcaagtctaaaatctgaattcaacacactgaaaaataatctatttttatatattttattcaatattttaataccttgaaattaaaggacattcagtgaatgtggtaaatatatctactaaaatcctacagaaaattttactctttaatgctgagttcagccatttcctctatcatcacattgtagtgaggggcctagccactaatgcagaagaaaaaatttcaataaaatatgtaacatttgggaaaaagttaaaatcttctcgtttttctcagatagaggtatgtcaacaaagtaaaatctcagggaatccataaaaaatatttagatatactgtgagaatttgggaaaaaatgttagattaatatataatggaaaatatcaatatataaaaattaatcacattactatatagcagcagcaaacaatcagaaaaacaatttaatcaattacatataaaacagaagaaagaaatcaggtaatcatcctgtaatatatttaacaaaaatttgaatgatctttcagagtaaaaatatcaaatttaattaaagaagcttttccaatttcaaaacaaatgtagatttatcccttaataaatgagaagaatcaatataatgaatcatcaattcttgtcgtattaatctataagttaaatgttaattcaattaaaatgttgaaagattttgttttcttggattttaagagcttaactctaaaattcgtatggaataataaaaaacctagtacagtcaatataactctgaacaaaaacatgtttgaggccaggcacggtggctcacacctataattcctgcacttttagaggccaaggcagaaggatcactagtggccaggagttcgagaccagcctaagcctcatggcaagacccttgtaacttaaaaataaaaataaaaaattagccgattgtgtgtcatacaactgtagtcccagctacttgggaagctgagacaggagaattgttggagctaaagaattggaggctgcagtaagctatgattgtgccactgcactccagcctgggtgatagagcaagatcttgtttcttaaaaaaaaaaaaaaaaaagaaaagaaaatgaaagatggtagaatgggactctcctttgcattgtattaatggaatattcaacagtgtccctggccactgcccctacaggtgtgatgatcgaaatgtctccagacattgccaaatgccctctggagggtaaaatgtcctccattgagaaccacagagttaaattaattaaaaccatttgattttagcataggtatagacaagaaaaataattataaagaaaaagaaacatgaatcagacctacattcatagaaatttggtgtatatgcaatggtagtaaatttaacaggaaaaagtttagtataaggttctgcaacaattagctgtttatagaaaacaattaatgaaatagatttctgtgctatacacataaatctattgattaaaaaactaaatgtaaagactcagttgaaaagctaaagcaatatataattttttatcagcactttctataaatcgatcttagaaaaatttcacaaatgtattcaaagggatagttcagaagatattcattttggcacagattgtaatagcaaaagcatgaaaacaattttactatccattattaagacaaataaactttatgtttaattcagtgggacactatgtgtctgttaaaatgaattagctagatttaaaaatatcaatatgaataagcctcaaaaatataataccacaagaaggaagcaaatattgcaaagtatacttacagtaaggtaccatatatttgaaatgttaaaacactcagaaacaataatatatactgtttatagttgcctacaaatgtagtaagtacacagaatcctgagagaaaatattccctttctggaaatggagggacaaaaaaggatgatgtgagatttcagttacagatgtacttaagtcgttaataacaaaaaagacttctgaagctaatgtagcaatagtttagtatttattaatctttgttcatcaaacataataatcttattgctctctgtttttatatgtggaagtgtgttcataaaaaaggtattcttgtccaattgattaaaggtattttaatatttagtaaaaaaaattaaatctacttatacaaacacaataaaatgagtagttcaacatccagttctgtacctaagaacccaaatgcatgcctttcatttccatgcttcttctaaaaaatgtccctgcctggaaatgggtgttctctggtttgaccagaagtggtttcacatttctaatatggactgacttgcaatatgcactttccattttctgtttcttacttagaagagtgtttgcttatgagatcatcattacaacacacacaaacacccaaagtcttctttttttctttgatttgttatttgtcaggagagatgaattaaaatttaagctccctatttcagataactggtaaatctactctgtttttctttcctgtttattaatgagcttctgtcactttttctctcctttcttactctttccttctttttctctcctcaacacattcatctctgtgctcatttgcttcaataccctttcacaagacttatctttttcttctaaagccaaaataatgatgcacattattcttatctgagtttctctccacttctctatttccaggtcagatttagcttaacaagtggatcattgattggatgtttacacagccacattggatctttattgctctgttcatttgtcttgttcaggggaaatgggattagctcttctttaattgtgtcatctctaaagatgcccaccaactcttttaaggtttcgggtaaatgtgcagcgcataatatttcaaaatattttttaaataattcaactgaaggccttttgcttctttaacctttctttgttgacttgaaaacaaatgaaaatgtaacaaaaatgcagggtactacttatcttgctttccgcacagtctgactcaacattttcttagttgttaaaaagatgtagacacaggattggagttgatagttgatggctcttagtttttattctattagggagctacttctagatcttatacccattcaagctcttatcactctattttatagcttttctttccttgtacaacttatgctcatatctataaactacaggtaattccatattatttagaaatataaattatctggttgaaatgagccaaatccaccactcttgttttattttcatagggtaaggatcagattcaagtagagcttgacacaagagaaagtcattatcaaaaagtcaaaacattagtgttgtcaaagatgtaaagaaaacaggacccttatatattcggtaaggatgtaaattagtacagtatagagattcaacaaaaaattaaaaatagaactacaaaatcatccagaaatcctaatactggctatatatcccccccaaaaagaaagaaaatgaccatccccaagagatatctgcacccccatgtacactgcagcattattcaaaatagccaagatatgaaaacaatctaagcatccatcaatggacacttagccattactcagccataaaaaaggaatctaccatgtctgaaaacatggatgaacctgaatgacattatgctaagtgaaataagccagacagaaaaacaaacgctgcataatctcacttatatgtagaacctaaaatagtcaaactcataggaacatgggatagaatggttattgccaggtgctggaggttggggcagatggggagtggttggttaagggtctccaaactttcagttataagacgactaagttctagagacttaatgtaaagcatgatgactagagttaataatactctattgtatacttgaaatttgctaaaaaagtagatttcaagtgtccttatccccacactcccacagacaaatggtaactatgtgacataatagacatgttaattagcttgatgtggttatcatttcacaatacgtatgtgttatcaaatcatcatgctgtacatttaaatgtttacaatttttgtcactaatactaaataaagctcaaaaaagggagtcattgctgcaacctctgttaggagtacttataaatctacccaggctttagaaaagaaaaaaaaagccaatgagggtccactctgcagctctactgtaggatttctgaaaaattggtcagtataatgacaaccctatcactgtggagactaagtgctatgccaaacttctaccgacttcagtggggagggcaccagattcaagggtctgaagaagagacccagagccagcaaacgagacctggggcttcattgaggttacacacaggggagagggtccagtggtggtgggatgaacaggagaactgccaccacttggaaaggcatgcaatctatacagtatttttacttagaaccctttccctgaccacctccatttggcaacattcattcaacccaaaactcaggacctcgatcctctgtatctcccatgttctgtgggtcaggccgggggctcagatgtttctcatagacaggaatgaatctctagtttagccactcctggattccctagctctagagcacacattcaggtgcatctgccatacagggccattcttagggtatgcctaagatattgcctctcaggtgcatttaccatcacctaggataatcttgattcagcattcctgaagagggcagtgaaggcagtagaacagccagggctactaaatagaagggcctgaaactgactttatagagtaatgtccgaaaagcctggatgtgaggataaataatcatttctccccacaaaacactaaacaaatctcttgtgatgtattggcgagttcttatttgcagtcatatgatgttactattttctattacaaattgcaaattcaattctcaaattcaattatcctggagacagccaaccaataagtttagcagtgtttgaaaagaaagacaagttgcacccaggtttataaatacacatgtagacacaaaagtgttaaatgtaagcctcagcaaaattgaaaatgggcaatttctagatccagattgggccagaagtgggagagaggatttttggtggagagacataagagactcctggatctgtgtgttttctggaatagcatttccaaatgattctccaggaaggacacattttttattatcattcacaaggcattaacatgtctaagattccaaaaattcttaaagaaacatcttttttttaatcatatgtctttaaaagaaaaaaatctctttttactttgtttactatcatgccacatattcgtttcaccacaaaacactttttttaagaattcttattaataacacttcttggaaattttgcttcataaagctctcctagggagacaatgatgcagagtaaataaatttcaggttatgcaggacataccattgaatataagatttacaccagaagatattttctttccatgaaaagccacaaacatttataaaacatatttcgaggcaggtctatttaggaccttgctattcaaaatatggttcttggaaaaggaaggttagcatcactgtggatcttgttagaaatgtggaaactctggtcccacctcagagctattgaatgagaatcttgcattatctgcaacatccccagctgattcctgtgcacaaaaagtttgagaaagtctattgtagaagactcaaacttctaaagttatgaatatcacacatttctgcatgtaaattagaaaacacaaactagaaacatgtaattaaggttaattgcacttatcttttaaaacgtgacgattaaaacgtgagcattaaccaattgcaaagcataaacaatgatattaaaatatcatgtaagccttgaataggtgaccagtttgaattcatatatatcagcatcagatctggatctaaataactggataagaatatattaggaaataaggagaatgacaaaagccatggacaacctggcataaaaccacaactctcgcttgattaacacaaaacaatttgctagtgagtagagaaagacatttaatggcatgaatgtgccacggctacattgacacgtagtatacagaatcctcagtttacttacactcttctaatagtgccaaatgtcaagtttagaaatattctaatggtttgaaaatatttatttaacatttatttatcactggttaattatatcatttcaaaaatgctttctttggattagtgctgtcctcagatcagttagacataaactttccaatcaaagggaacatcatctagtatactggatgaattataaacaatctaccacgttgaaagcacacatattacaaagttatagcaagaagtttcaggaaacatacatgacaaatattgggtgtcagaatatgattaaggatctggaaaaagctcagtctcattatttatcggtgtatcctcacatcacatcactcggagttagtgtagtctgtaggttagagggtggagtaggagactccctctcttccaaagtctctgtgttagtcctttttgagttactgcctttctcattgaaccactgttcaatgatttttctgaacaatggtcctctgaaggcagtagcttcctagtggacgagtgtctgatttttcccagcactacctagtacagagctgggctcagagttcatacttataaagccagagataagagatcttgaagaaagaattatgagcgattcaagggtaatacattggcataatttaagaatagaaagccagctctgcaagcaatcagactaatggaagatctgagccaggaaactctctctctctctctctctctctgtgtgtgtgtgtgtgtgtgtgtgtttgtgtgtgacttcaaacaatttggaagactcggtgttattatactaattttacttgagtaaagttatacctagagaggttaagttcacagctagtcagtgctggaattagggaccaaacctggttctgcctgactgtaaaactaggactcttcaatcactcttttgcagggtttcttaacctcagtactattggcaattagtgcaggataattctttgttgtggagggtcctgctatgtattgtaggataattctttgttgtggagggttatgctatgtattgtaaaatgtttagaagcatccctgattgctacccactagatgtcagaagcacattacccaccactacccccactgtgataacaaaaaatgtgtccagacatggccaaatgtctcctgggagaaaatcatccctgattggaagctactgatctattaatagtaggtccgtaggatccttaaagtgagcatgttacagtaaatcacctcctgaacatgaaccactgacacaaccttattaatgtagacagcttagtgggcttgcctatggtcacttctgcttctaaaagaaatagaaatcttttttttttttttaaatactttaagttctgggatacatgtgcagaatgtgcaggtttgttacataggtatacacgtgcaatggtgttttgctgcacccatcaacccatcatctaggtatttctcctaatgctatccctcccctaccccccaacccctgacaggccccggtgtgtaacattgccctccctgtgtccatgtgttctcattgttcaactcccacttatgagtgacaacatgcagtgtttggttttctgttcccgtgacagtttgttgagaataatggcttacagcttcatccatgtccctgcaaaggacatgaactcatccttttttacagctgcatagtattccgtggtgtatatgtgccacattttctttatccagtctatcactgttgggcatttgggttgtttccaagtctttgctattgtgaacagtgctgcaataaacatacatgtgcatgtatttttatagaagaatgacttataatcctttgggtacatacccagtaatgggattgctgggtcaaataatatttctggttctagatccttgaggaatcgccacactctcttccacaatggttgaactagtttacagtcccaccaacagtctaaaagcgtttctatttctccacatcctctccagcatctgctgtttcctgactttttaatgattgccattctaactggtgtgagatggtatctcattgtggttttggtttgcatttctccaaaggccagtgatgatgaactttttttttcatgtgtttgttggccgcataaatgtcttcttttgagaagttatctgttcatatcctttgcccactttttgatgggtttgtttttttcttgtaaatttgtttaagttctttatagattctggatattagccctttgtcagatggatagattgaaaaaattttctcccattctgtagattgcctgttcactctgatgatggtttctttccatcaatgatagactggataaagaaaatgtggcacatatacaccgtggaatactatgcagccataaaaaaggatgagttcatgtcctttgcagggacatggatgaagctggaaaaacatcgttctcagcaaactaacataagaacagaaaaccaaacactgcatgttgtcactcataagtgggagttgaacaatgagaacccatggacacagggagggaacatcacacaccggggcctgtcaggggttgagggcctaggggagggatagcattaggagaaatacctaatgtagatgacgggttgatggttgcagcaaactaccatggcatgtgtatacctatgtaacaaacctgtacgttctgcacatgtaccctagaacttaaagcatcatcatcatcataataataataaaggaaataatagacagtttatcttaggtaaattgtttttgaggtcactggcaataagtgaaggcctttaattttgcccatctgggccatgtttcacaaatattactgaaaacgccttttcaaaatagcaataaaggctaaggtatcagggactctgtagtattttttaatataaaacaaaacaaaacaaaaatgtgaaaatagctgtaacagagcttaaggtccagtctgaatttaggtgtgggattgaaccatttctttttttttttttttaacagaaatcctcattctttggcccatatcttttttttttattattatactttaagttttggggtacatgggcacaatatgcaggttagttacatatgtatacatgagccattttggtgtgctgcacccagtaactcgtcatttaacatgaggtatatctcctaatgctatccctccctgctcccaccaccccaccacaggccctagtgtgtgatgttccccttcctgtgtccaagtcttctcattgttcacttcccacctatgagtgagaacatgtggtgtttggttttttgtccttgtgacagtttgctgagaatgatggtttccagcttcatccatgtccctaccaaggtcatgaactcatctttttttatggctgcatagtattgcatggtgtatatgtgccatattttcttaatccagtctatcattgctggacatttggcttggttccaagtctttgctattgtgaataatgccgcaataaacatacctgtgcatgtgtctttatagcagcatgatttatagtcctttgggtatatacccagtaatgggattgctgggccaaatggtatttctagttctagatccccgagaaatcaccacactgacttccacaatggttgaactagtttacagtcccaccaacagtgtaaaagtgttcctatttctccacatcctctccagtacctgttgtttcctgactttttgatgatggccattttaactggtgtgagatggtatgtcgttgtggttttgatttgcatttctctgatggccagtgatgatgaacattttttcatgtgtcttttggctgcataaatgtcttcttttgagaagcgtctgttcatatccttcacccacttgttgatggggttgtttgtttttttcttgtaaatttgtttgagttcattgtagattctggatattagccctttgtcagatgagtaggttgcaaaaatttcctcccattctgtaggttgcctgttcactctgacggtaatttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtccttaatccatcttgattaatttttgtataaggtgtaaggaagggatccagtttcagctttctacatatggctagccagttttcccagcaccatttattaaatagggaatcgtttccccatttcttctttttgtcaggtttgtcaaagatcagatagttgtagatgtgtggtattatttctgagggttctattctgttccattgttctatatctctgttttggtaccaggaccatgctgctttggttactgtagccttgtagtatagtttgaagttacgtagcatgatgcctccagctttgttcttttggcttaggattgacttgacaatgtgggctctttttttgttccatatgaactttaaagtagttttttccaattctgtgaagaaagtcattggtagcttgatggggatggcattgaatgtataaattaccttgggcagtatggccattttcacgatattgattcttcctacccatgagcatagaatgttcttccatttgtttgtatcctctttgatttcattgagcagtggtttgttgttctccttgaagaggtccgggattgaatcatttcaaacaaaatatcaggttctcttttatgttgcagagtggggctagtaatattgcccaacttcaaaggtgaggagagtctcttcctgaacatgcagaaagagggtcacccaaaatcatttggagtagtgacaatgacattggatttggagtcagaaagaaggcctagattacctcctcaaatgattaccatctctttgaccttctaggggccaatagtctctgagtttcatatttgagcctcagatttgtgtaattgcaataatagtctctatctcatagagctaaggtaatgattagatggaatgttcagtggaaaaaaacgacttctaagcacaaatatggcttcaaacattaagctttgattgctccaaaacttacaattaattgcttacatcgcattttgcaatggatagaaatggccagggggattatcgcatagggaaataacacaatgctctttcaaagttttctatcaaattaagactcttggaagcaaaatgatcttaggccccgtgactacaccatgtaactaaatttggtctgattttcatcttaccctggcataaaaatgagggaaagcagactcaatcaactcttcagccacctcccttatcccacaccatgataatggattcaatatctctgtgccttagtctcttcaggctgctataacaaaatggcttagactaggtaatttatacacaaaagtgtttattgctcacagttctagaggctggaaagtccacaatcaggataccaggagattcggtgtctggtaagggcttgttactcacagatggagaccccttgtagctttctcacatcgtggaagaggcaagcaagctcccacaggccttctttataaaggcgctaattctattcatgaggcagatcccttataaccttgtcgccacacaaaggccccaccttttaataccatcactttagggttagatttcaacaaataaattttgaggagaaacatttaaatcatagtactctgcccatggcctcccaaaatttatgtccttctcatatgcaaactatattaattccatcccaatagcatcaaaagtattcacttgttctagcatcaactcaaaatttaaagttcaaagtctcatctaaatcaggtgtgggtgagactcaaggtacaactcattctgagagcaaattctgctccagctgtgggccagtgaaatcaaacaagttatgtgctttccacaacacattgcacaatcattcagacctcaggactggcccaacttaactcaaaaaacagacacgttttccttccaacttgagttgttgcaagatactacctgctctcctttagaaactagtaatcacgggatacaagaaaacgaagcacaggaagtggaacaccttaagtctctgccatgtcccagaccagagtcagtgaggatacatgcatatgtatgtgaatattcacctttatgtatgcacatacgcataggcaagtgtattcatcagtctgcatgtgggtgtttctgcacaagcatatgcatttgtgtgactatttgcgtgggaatgtgtatgtgggcatatgtgcattttagtttgtgtattcatgtgttggtatatgtgggtgtggatataagggtagatgtacatatatatctgcagatatttgttggttgaatttgcatagatttctgaatatgtcatcagggtggaagtgggaagaaggagaaaatggaaatagaatgaaattctctcattgaacctacagtgggaatttaaggaaacagcatgctattaaccaaatcaggagctggtctacagtcacctcactgaggaatgtgggaagaacacagttgaaattatctttaaacatcagcaaaaatagagttacttggactctggatttcatgttgaattttctctagctacatggggcttccttataactataaggaagttgggtggtaggtcgtagctgctttacagggaagagttgtatccagaataagcaaaataagactaaaaggtaaaggcatggggagcccaaaagtctacccaataactctagtagcttattctgtctttcaattgcggaggaagtggagcccaggccaaggcagcattggaaatattgtgttaatcccttccttccagccctcagaacaacccctgaatgagatcccaatatactgggaggcaggaaaaagaaagaaaccccaatttcaatacaggaatattaataatagtagcaaatacttatatggtacttagtatgagcaagcaccatttaaagagttttagaagtcattattgcttattgttgtcatttatgaattgccaattgtatatcaggcactttactatgtgcattaaagatatgattccatttacatttattttcataaccattggttgaagtctatattaataagtcagttttactaaggcagaaactcaggctcaacgacgttgagctatgtgctcaaagtcatagtggtggagcaatgatttgaacgcaggcctattacaaattgtctttattttcagagttagttttctaaactacaatcatggtacctaggtttgatttgataatgcagaagcaatatgtgatagccaatttttctctttatcctagcaagggaaaacattacaaagcaatttacaaaattcagtatgttcctaccacattcagtttccatatgcatattggatggaagttagctgaaactttcccctagatatctgaactgcagaatagtgtacaattggccctccatatctatgggtcctccatctacagattcaacgaactgaggttttaaaatgtttggaaaaaacataataaaacataacaatatacaaataagatcaatacatttaaccactatttgcatgtcacttccactgcattaggtattacaagtaatctagagataatttaaagtatacaggagaatgtgtgtagatgatatgcaaatagtacaccattttatataagagatttgtgcattcgtgaattttggcatctgcagtggttctggaacaaatcctgcaaggatattgagggacaactcgaattcaggacagttcaaaccaaattagaagatcaagtacccaagatgagcatggctcactttacctattagctcttcctgtttgcatgaactgggaaaactgtactgtcatacttggatgtagatgaaacctagaaatgctaggaatcttcaaacctgagagaagtatatttcttatgcccttttttgagtatgtttctattaagagctgtattttgtgacatgtggtgagacattaattgccatctactacgtgtttccttagcaccctgctctaaacagcattctacagtaagggatggcttgttaataaaggttaccagttgatattaatgctaaatattgcctcatttatactattcctactaacccaagtatgtggatatggggagaggggatgtgctttttaattaaatagtcaagaacagaaaacactgagctctatgagaaaggtaaaagaaaaaataggaatagctgctattctagcatctaatatgttactaagtcagtaaaatacatgatttctcctcttatttgcgtaacttaaataactgaggtaatttggtatctggaaacattgcagctccctctcttttcattctttggccagctgaattaactaattgatatggttaggctttgtgtccccaccaaaatctcatcttgaattgtaatccccataatccccataatccccctgtgtcaagggagagaccaagtggaggtaattgaatcatggaggcagtttcgcctatgatgttctcatgatagtgagttctcaggagatctaatggttttataaggggctcttcccactttgcttggcacttccccttcctgctgccttgtgaagaaggggcctgcttccccttcaccttctgccatgattctaagttccctgaggcttccctagtcatgctgaactgtaagtcaattaaacctctttcctttataaattatcctctcaggcagttctttgtagcaatacaaaaacgaactaatacactgatgaatatagttttccatttaccctggataagacctcagaatccatcttaacacagcatgtcagaaagccatgccaaatagatgattaccactctgtgagccctagttgccaactctgtcatagattattgatctgaggagagaaggagaaagaagtttcacagatacaacatttggcattcctgaaataggccttgctatttgcccaacatataactaagacgtgaaattctagtaggtctgaggaaatagtggcacctgttggtgccattccagaccaagacatagacttcattcaggcttggatgataaatggtctattgcagataaagatatgtatttcaaacaaagcgttttttatttactgaaattattaaatttataacttctgatttgaaaataagaatcttatctatcacacttttatcttatgggcattactgtcaagcctatctttatgttacatagatgcactgagcttttggccagataccattaaatgtttgacttctgaaactcacctgcatttctgatttcctgatcaccaaatatttgcatgtttgtttgctcccctttccttacagggggagaatgcactgagcatgcatgctaatgtggccattctgctttacaaaagctttcttttctctttcattgtatgctaatctattgcaagtctgataattttcattcccttaaaacttagtttttcacaatctgacaagtaatttttctgagttttttttctgacaatggtagatccagagtctcaataaacttcacccagaatcaaatttctggagtagccatctgcttctttcattataatcttggtataagcagtatagctcggtggttaagaacaaagaatttggatcagacaaattggatttttgcaactttctggttgtgtgacctttggtgaatctcaaaacctctttaagcctcagttttggcatttgtgtaacagtagtactggtatgtatttgtgatgctgtaagcttgttgtgaagatggtatgaaatgatgaatagatatggtcagtagtcctgtttgttagcaattggtatatattagttgttattattccttgtttaaaactccactgacattaaatagccacatgaagagcatggtgacatgtgaacagtatcatcttcctaatgattttatgctcatgaaacctaaacttacttttgtgacttaaaattgctacaccatcaacagttgaagcttcttgatggtgagaaatctattttatgtagaattacttaaaaggacattttaactatagtagcaatttcaattgacttcctgtcatttccaagtcactcagtgtcagcctacattcctcttcagggaactagttcctcccaagacttctcatgtcaggttggcctagcatgatcggaaaaaaatcacaagttggctgtcaatcatccaaaagcatctcttcagcacctaaaagggcataatgctatgctaactactgtgagaagtacattacacagacatagccatagtaatccagcaacttctattctccaggcagaaagagaaaggatctttgtgcttaataaaaagtggtatgctgtggtgaaaggagcattctcttgtgttaagagaccaggcttccccaggtttgtccttcagcaatgcattttacatttctgaatatatttcttcattgaaaagcagaattataaaatctgcgtacccccagtgttcttaatcctttaaaaaatgtttgcaatgtgccatgaatatatacatatatatattaaatataaacatatttaatatattaaatataaacatatttaatatattaaatataaacatatttaatatattaaatataaacatatttaatatattaaatataaacatatttaatatattaaatataaacatatttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacattttaatatattaaatataaacatattaaatataaacatattttatatattaaatataaacatattttatatattgaatataaacatattttatatattgaatataaacatattttatatattgaatataaatatatataatatatattaaatatataaaaattatataattatataatataaattatatatattaaatatataaaaattatatataattatataatataaattatatatatttatatatttaacttttctgcaaaaaaagatgagaagaaagatcaaaaggaataatagcaagtaaaaaaaacagtgatcagaacagagaggacatgagcaatactagctaattatgactatcagtttttgaatttccactctgagccagatcaaaaacagaatctcaagcaagttagttggggatatggtggaatttactgtatgttggctagaggtaacaatgtagtaaattgacaggagagaaaccacacttctgggtgattattttgaagttcctgagtggagatataaagcagaataatgttgcagggggattattggagcttttttcttggtattagggactttaggcaagggtctaagaggtctctaaaataagtggttttggggaactcctggtattcatttctcattagctctgaggttctggagacaggaccaagtaatcctcccctcaactttctggagcttttttgagaggagcaaagagataaaatgtcccacagtggtttcccattgctctaaggatactgtattagtctgttctcaagctgctaataatgacataccggagactaggtaattaataaaggactgaggtttaattgactcactgttccacatggctggggaggtgtcacaaccatggcagaaggtgaaggaggagcaaaatcacttcttacgtggtggcaggcaagagagcatgtgcagggaaattcccctttatacaaaaatcagatctcatgagacttattcaccatcaccagaagagcacgagaaagagaaagacccatccccatgattcaattacctcccacagggcccctcccacgacacctgggaattatgggagctgcaattcaagatgggaattgggtagggacacagtcaagccatatcaaagacaaagtatttcccttattttacaactaaagaccctgtctccaaaaattcccattgctctccatgctccaacctcatcagcaaatatttgcaatgtttctaaagcacaatgtttcaggctccctcctgacacagtggacttttgcaaatgatgttccttctgtctgagaacttctttccttatttttgcttaaccatcccacactcaacctgtctttcagcttaaatgtcaattttgcaggaaagcatcctctgggtcttcagactaaatatgatcgcagttataaattctcaagaacacctggtcagttcttttcctagatagccaaaatgtttgaaatcatggaatttctgcatgattgtttggcctggctatcccattaggctgcaagccccatgacagcagagcagtttaacttcatacctaataaactgtctgcagctgctcagtaatgatagctgagtatgtgaatgaataactgagtaaataagcaaaaaaatcatatactttaaaattattatgttggttacacatattcattgtagaaagttttaaaattataaaagtatgaataggataaaaaattttagatctatcacataggctaaatcatttattatatttttatttatgattttacttatttatgtattaataaattatattatttaagaaattataatttattctagtaatatatatgcttatatatctgtagtatatatgtatatatatgtgaatatgtatccatgtataattttggatggtagggcatatattgttcataaattttttattacaacttagaaatatatcataaaaaaattttcaagtcattagatgttctttacccatataatttctaattgctaaatagcattgcatttgtttgtttctttctcaagtaccccagtttatttaactaaagcttattgttggcatttggatgattttaaatattttattataaacacgctagaataaacaactgttttgctaacttttgcatgcctttttcttaggatatatttctaaatgtggcattactgagtctaatattttgattcatactgccaaattgtctttaaaaggaaagtaattctaaagctctcttacactagtgagatgtaatacccagctcaacaatattattcctatactccttttaaactcttcaaagttgatagacaaaatttgtagatttttttttaaattcgtatcttttttattacaaaaagagtggaatttatacataaacacagatagatatgctcatatatttattcgtatatacgcatattcaccatttcaaaaacaactttgtttatgtcgtgtatggatctgttgctgtcctcactcaagttgtttgtcttcttagtgatttataaatgtcttcatatatatttcaaagatacttatactacatttgcagcatgttatattttctgaatttgttgatgtcttttaattttgactcactgttttgctgtaaagtgacacattttaatatagtgaaagttacatcttttattgttctcttcaggtattttatgctctgtgtgtgtgtgttttacatcttatataaagatttcatatttctggtgctataagttatgaggtaacattttccatttttttctccaaataaattttcatttgttccatcaaatatcacttatataaaaattcattttttcatgtgccactcataacacatagcaaatcttatatatatttgactttggcattggattttgtatgcagttttagcggtctactaagctaatagaaaactactttattaattttataataaattgtaatgtgtggtaagttccttattgttcctttttctttattaaagtttttttttttactattgtgatacatttatttttatagataaaaagaactcatcaaatatcattggatagtcattgcacattaaaattagagattaatttatgccattattcaaatctttttatatattgaaaaaaagctgtttattttccttaactgcaatataatatttgtcaagtttattcctaagcattacatttctgttattgcaattatagatgagatttatttcttgtcattacatttttctgagttgttattataatgataggaaaattattgggttttatgaatttagtatgtaattaattacttaagtctactagatttcattttcttgcaaatgattatgaatttgcatcctacttttgtatgattatttctgatgttattttctcttcttattgcttacttaaaaacttttagatcgatattgactactgaataaggaaatatgtcttaattttcaaatttaaggggaatgcctctttagcttgtttattaagttgattgtggagccccagaagaatcattctactcctgaattactaaggatatttaaaataagaaatgttaaattttatcaaaattatcttctaagctatcatgtttctaagactatcatgtagtcttttataaataattttttagataaaagcagtattattttaaactaatgcttacttttctaattcagttaaaactgtctataagtaattccatcagccaaattcacagactactacctaaccactattgtctgttaaccttacaagtaagtcaacacacacttaggttgaaattttcatatctgaaatgccatatacagacttgcaacaagactaaaaaaagaatacactaaggttcagagaatgaaagtagatcttcttcctaggttaggggaatagggtcaatggaattgaccagatagcacaaagcgattgtaagtttcagttagggcacatatattagtgatggtcataaatattcaaaagttctaaaagtaggaggcagaccaaatttagcaacgaagatttagacaaatagcttctgggaaatgtctatgagctgcagagcctgacttacaaagctgggggtttaagtactcgtgcagccctacagcaaggtaaaacaagtagtgctccttaacagaaaatgaatgactcagaaaagttactgatgtaggaccaaaatataaaccagctcagaaacctagccccaccaaaggatcccaggtgaaggagtgaacatgtggttactgaagccctcagaatcagatcacgttagcacctctggggtcaggctgtgagctgggcaggagggaagaacttagagataagctctaagtcactgcagttcatgtaaaagaacaaataatattaaggcctctcagactggcaagatatggagcctcttactatgtcttgtcatcagcctattttctccttggaaataaatctgaacttacatagtccagtggatccagtcagggggaacccataagaggtggagaattgaggcagaaaactgacaggaatcatttaatgagttcttgcttttcaaattcacactcaaactgaaggagatattaacatgtctgtattgagcattctggaactggtgaaggcacaggcttcagaaaacctgtatcctattcactggcatgacacagtgtgaggaggtaaatcctacttgtaatgcttggtgatgctttcatctaaactgtcattaaaactgaactatttctacacattttggtcacttgtccttaaattattaaaatgctaaaaatgtgtctatctgagcaattaaaatataaatcatgaagaataagccgctctttaagaaaaatccattatgacaatttgggaaatgcagtgcaatattgaaaatgcaaacaaaaattcgagtgcaccttatttcaaataaaataactatccacaattataatgcacatttgtttcccccaatgtcctaaaatcacagttatcttactatatctaatacatgatacaatttaagagtagattatttgaaaacacacaggtaagtgagccaataattaaaagcaatgtagaggcactttctttttttctttcttttttttggcgggggggagatggtgtctccctctgttgcccaggctggagtgcagtggcgcgatctcggctcactgcaagctccgcctcccgggttcacgccattctcctgcctcagcctccggagtagctgcaactacaggtgcccgccaccacgcccggctaattttttgtttgtttgttttttgtatttttagtagagatagggtttcaccgtgttagccaggatggtctcgatctcctgacctcgtgatctgcccgccttggccttccgaagtgctgggattacaggcgtgagccactgcgcccggccagaggcactttcttgaagaacttgaaaccatattagagtgaaggacccctcttggccccatctcatacacatctcactgtttccctttcccatcccataacaacagagagaaatctaccaagtgatttttactgggatccactaagagactttttaacaggtgagagcaatttctcactttcttttcccttcctctcccctaatgcccttatctccaaatatagcctgagaaattgttgggattgaaatctaggaaggagcttcttaaaaagaaaaaacctttgtcatcttatttgattttaacctcaatcctgaattctttgccctcctagagcagcaactcaactcagtaatcagatcctagttttaaatcagaagtgtagttgaagccattgattttatccaatattctctgaataattggttggtacaagaatttcaccacctgtttatagacggtggccagaagttagagctgcctgctgattgcttttttgtgtgttattgtgattttaaactatatttaatgttctgtttgaatgggagattttgccacctgcgggagcattccaaaaaatagcattggctgctgtgtatatcaatgtcagagtcagattcatactgcaaaggggctgcaaaattcatcagtggaaaatggctcagcgaattctgtgaaagcatcttccctgggaagcctaatcctctgtcaatgatacttaaaaagtaacttccattcctcctctaagaaaatcgtaaacttctctcctaggttgtgggctgcagcagacatattagagagattttttgagaaaatatgcctccttcatttgtctcaaaaatggacaaaaacgtagattccactagtcacacacaatacaatattgacatcatactaaatagagtcttgcatcatgttttttcattaaatattgagttctcattcgtttctcttgctattattttaaaaactcaaattatatattattttaaaaccacttatgattatatgaacataattaatttcatgatcattgaagctttatctactgtctactaaatataaatagtgcttcagaaacatcctttttttttttttttttttgagacagagtcttgctctgtcacccagcctggagtgcagtggtgtgatctcagctcacgactgtctccacctcccaggttcaagcaattctcctgtctcagactcctgagtagctgcgactacaggcgcacgctgccacccctggctaacttttgtattttcagtagagacagggtttcaccatattggtcagacccgtctcaaactcctgacctcaggtgatccacccacctcggcctcccaaagtgctgggattgcaaaaacattcttataagtatacttttgttcacatctcttagtatctcctcagtgaatattctacaatattaattatttaaccagaatgtatgaatattttaaatttattagtatattttaataatgtgctttcagaaagaatttatcaattttcattctcattagttgcatcgtacagtctcagtcttactgcagtctgtgcaacaccatggtcattgtttttcaaactttgcctgtttaatggacagaaaagctaatgtttgtttaatttgaatttcattaattacttataagaaatgtctttatatgtttctcagctcttcgtcactattatatgagtattttgttcatgatctttgtccatgtatctccttggtttctctccttgacttgtaagtgctctttacatagttctagtataaacctttgacatagattttgattgtttttcgtcacagaaatgcagaatacttttgaaacttttaatacagttgcacctttttttgagtttgaaatgatggtccttgcttgatttaaattgttttttctttgaatgcctatgaccaaaatatctccccgttaagccagcttctaggcccagaaaaatgaaagttgccttgggacaaaacaggaaaacaggatccatcaccattctaaaccatcagctttgtaaagacatctgagatgattatggcacaagaggcacagagagtaagtggatcttagtccagcagaatgattcctcctgggaccagaaaattcttctcattcttaattttctttatttgttttgcttcctataattactttaaaaattataatgtaaaatattttcaacagaccaaatatgagtaaggatatcatgaacactcatgttatgaatattctgcttaagaaatgatcatcaaaacgatgaaggccccaggtacctcatgctgatcacattcttcttaatgtcctcccaaactagaaaaagttactgccctcagaaagagtttcttatccctaagaacttctttatatttaatcatatagttatatcatcccaaataataggcagaatggttttaaaattgtcaaatatgcacatttccaatttcattaagcagagaacatatattttcacccataattatgttttgaaactcactcatgttgatacctattttactcttttatagtatacattgtataatgttgatggacatttagcttgtggtacattcttattttcttttatcttgttttttttttgctattataaacatagctgataggaatatttatatacagttgacttgtgaacaatatgaatgtgatctcatttacttatacatggattcttttcaataaagatgaaacagtgtgtctgccttttcttctacctcctccacctcgcctgcctctgtcatccctaagacagcaagaccaacccctcctcttcttcctcctgagcctactcaatgtgaagaaaatgaaaatgaagacctttatgatgattcacttccacttagtaaacagtaaacatattttctctttctggtgatttttttaataacattttcctttctctagcttactttattgtaagaatacagtatataatacgaaataagtgttaactgtttttgctattggtaaggcttctggtcaaagtaggctatgagtagttaagtttctgaggagtcaaaagttatacaaggatttttaaccaaatgggaaaagcggcacccctcatcttcatgctgttcaaggatcagctgtatattcttgagaacctgtgagtttgtctagatcagaatacgccattttttagttgactggaatttgcttttcagggtggttctacaaatttaaatttccatttttcattagaatttactattatcacacctttttttgttttgtttttgttttgtttttgttgtgataattggtgtcttattatggttctaattagtatttccatgattactattgagttgaccttctttttgaatgtatattgatcttcacatttcctcttgttcaaattgcttactaatatatcttgcctaatatttactgtggtgtttatcttttcttattgatttgcaggatcttctattataatcagtatattaatctttgtcacttatatgcatggctactatcatctcccagaccatggctaatctattttttattatgaaatatttcattcgcacaaagaatatatatgatgagtatataaggcttgaaatataataaaacaaaaattcttgtgccaaacacctaccttatgacctggtgatgaaatatcagcaatacccctgaaggtcttttgatgttcttttgtctttcctgactatgttaacccctcttttgaatttttaaaaactcagctttattcagatgtaattatatgcaataaatgcatacattttaagtatatggtttgatatcttttgacaagtatatatacccataatcaagatagagaacacagacttgttacctccaaaaggttcccatgcgttcctttgcaagtagcccctttcctaatctccagcctcaaacaaccagtatcagctgtcaatataggttagtcttcagtgttctagaattttatataaatacaatcgtacattatacaaaagtacttggtgtctctggcttgttttgtgcaatatagtgctttgagatttatccatgttgttgtgtacataggtagttctctttgagttctgagtagtattccactgtatgcaacggtttgcatacccactcttctgttgctggacaattaaggtgtttcttattaatttggatcctaaaatatttatatacaagtataggcatatgctttatgtgggcatatcattttatttctcttggataagtacccaggggagaaatttttgggttgtatggtaagtcctatgtttaactttaaaacattcccaacgtgttagtactcatgttacattcccaccagaaatgtagggaggtttcaggtaatccatattcattaggtaggcttagttcaaagttttgttttaattttagctactattatttaaatggacatttcttgaggactaatgatgttgaatatctttttatgtatttattgatcattcgtagatcttcttggaaatgtgtctattgacatattttgtcaattttttcaaagtagattgttttccatttttttctctctttttttttttttttcctggagacagagtttcactctgtcgcccgggctggagtgcagtggcgtgatctcggctcactgcaacctccgccccgctgggttcgagcaattctcctgcctcagcctctcaagtagctgcggttgcaggcacctgccaccgtatctggctaatttttgtatttttagtagagacagggtttcaccatcttggccaggctcgtcttgaacacctgaccttgtgatccacccgcctcagcctcccaaagtgctggggttacaggcgtgagccaccacgcccggcctgttttctttttatgattgagttaagtgtccttcatatagttgggagacaagacctctctcatatacatataggtgcaatatttttcccagttagtggcttgcttttttattttaacggtgtcattaaaaaaatatccatttacaattcacagtgcaatgagttttgacagacacatacacttgttaaaccaccactacaatatatacaaaatacttccatccctgcctccactcctggctggtcacagacaaccgatgatctgccttctgtcaaaataggttagtttgcattttctaggtttttcgatttataaattgaaacattcagtttttatttttgacttcttttactcagcataatgattcattcatggagatccatctatgtggttgcatgttttagtagtatcctaattttattgcaaaatagtagtacattgtgtagatatgctatattgtgtttttccattctcttaatgatgggaatttggattatatctggtttttgcttattgtgaataaaacctctatggacattcatgtacaatgctttgtgtaggcatctattttcattgctcttgggtaagtatctggtaatgaaatgtctggttcatatggtaggttgtgtttaacttaatcaggaacttcctaatgatttcctcatagttgtatcattttacacccctaccagcaatgtatgagaatttcagttgctttatatctcatcagcatttggcatcgtcagcctttttaattttagtttagtaatgtgtatgcagtgacatcgtattatggttttaatttgctttcccctgatgactaacgctgctaagcagcttttcatatgcttatttgccatccttaaaacttctttggtgatgtgtcaattcaagattttacccatgttatattgggttgtttgcgttctcatttaggatttgtaaaaattttttgttccaattttttttttatcagatttgtgttgtgtcaatattttcttccactctgtggcttaccttctcattgtcccagtggtggtattcaaaggaaaaatggttttaattttaacgaagtccaacgtatcaacattttcttttatggtttatattgttgctgttgtatctaaactgtatttccatatttatttctaagagttttatagttttagcttttacatttagtcccatgttccatttcgagttcgcttttgtatgcaatgtgaattgtcaaagtttatttttttatatggatagcaatctttttttttttttttttttgagacagagtttccctctttcgcctaggctggagtgaagtggcaggatcctggctcactgcaacttctgtcccccggtttcaagccattctcctgtctcagactcccaagtagctgggattataggtgcctgccaccatgcccggctaatttttgtatttttagtagagacggggtttcgccacgttggccaggctggtctcaaactcctggcctcaggtgatccacccgcctcggcctcccaaagtgctaggattacaggcgtgagccacggcgcccggccaggatatcaattgttagagtactatctgtaaagaattaaatttaaaaaagtttatttcttctattgtctaggtaaattttataaaaatcaattgacatgtgggtatttatttctggactcctagcttgttacaactatatacatatatatttacacacacatatacacacacactaccgtactttcttaattactttataatacgttttgaaatcagatagtctttcaacttatttctttttcaaacttgtagtcattgtatagccttttcatataatatacatcttataatcagcttatccatttctacaaaaataatagcaaaaaggaggaggaggaggaggaaaaaggggaggaagatgtagaggagtcatatatctggtgtgctttagactggggttgtgtcgaatctatagatcagtttgagagaaccttactaatattgaatgatcaatagatgaacattgtacatctcttcatttatttgtgtttattttattaatgctggtaatttgcagtgtccaaatcttgtacctgctttgttaaatttatatttaagtgttttctgtttcattgatttcactcgcgtccatgtgaagagaccaccaaacaggctttgtgtgagcaaggctgtttatttcacctgggttcaggcgggctgagtctgaaaagagagtcagccaaaggagatatgggtggggtcgttttataggatttaggtaggtaaaggaaaattacagtcaaaggggggagttgttctcaggcgggcaggagtgggggtcacaaggtgctcagttggggagctttttgagccaggatgagccaggagaaggaatttcacaaggtaatgtcatcagttaaggcaaggaccggccattttcacttcttttgtggtggaatgtcatcagtgaaggcaggaacagaccatttaaatatcccttcttttgtgattcttcagttacttcaggccatctggatgtataggtgcaggtcacaggggatatgatggcttagcttgggctcagaggcctgacagttgacatcattgtcagtggtgtttttgcattacatttacaattgctattgctagtacataaaaagacagttgatttttgtacattgttttgcatacataagtgtatctagtaattctaaaaacttctaaaaaccttttaggtagatgttttagaattttctgtattcatgatttatcaactacaaataagacagtttatttccaaattgtatgccttttatttctttgcttgacttaccgtacaggccaagtcctccttttatattattaaacaaaagtggtgaaatttggctgtttttaattagttttatcaggttgagaaattttcccttccatttcttttactattttgttaatagtttctatcattaataggtattggaatttatcaaaaggtttctccgcatctaatgatataatcgtgtttcctttcctttattcataactacggtaccatacattcctgacaatgatagtcactcttaattttttatcagattcttagaccaccatatattttaccatacattatgtatattttaataagaaatagattataaatatttgtatgtttctgaccttatgttgctggtatcttactatatatatcctattaaagtttgtttttcccactcaataatatgtttttaaaatccatctataataatatgtgacactatggtttattttcaccaatctgtaccactcatttatctgaacattacagattaaaatcatccaatttcctgccaaagcatatttggtttgcttaccacttttttgccattacaaactttttcaagatgaaccttcttctgcatgtctccccgtgagtatgtcagtttcctgattgtacattgcttggggcggggattgctggatgaaataccctgcatgtgactacattgggactggacaaagagaaagtaaatgggtgggccaacaacaaaaaaacaacatacccttcagctttgcaagacaatgccaacttcttttccaaagtggttgcaacgatttacattcacacaaatgaatacgattactggttgttctgtatgcatagaactcagtacttactatctgccagtagatgttgatctcaattggtggatccctttgtggttttgttagtaaatatacaccaaggtttcattggtaaatgtcttgcttgctgttgattcttgtttcttttctttaaaatacctattcatatcattttgaggtacactgcaatgatattacattttatagattaatttgagaagtatatttttataattgtgtggagacctattaaaaaaacaatttaattttacctttcttaatgctattacataaggatttatcactttctctttgtatttctgttgtcagatttatctaaaagttattcagttcttaatattttggcaatgcaaatagtatgttcgaattatactttgtaactgtatattgctagtgtgtaagaactcactttatttcaaattttggtcttatgtttagaaacaaagttatacattttgatgattaattttagtaatttgattatggattcccatgcttcttttacatgaatattaatatcaccccagaattgacagggttttctgtcccatttatgacaagtatttattcattttatttttcttacttgaatggctaggactttgaataaaatattgagtgaaaatgatgattgccaatatacttattcatctctgatttttttccccctgctttttttttttttttttttttaagagtcagagtcttgctctattgcccaggctggagtgcaatggtgtgatcatagctaactgcagctttgatcctcctgcttcaaatgatcctcctgtttcagcctctcaagtagctgggactacaggtgtttgccaccaagtctggctgattttttatttcttgtagagatagggtctcactatgttgcctgggctggtctccagctttggacctcaagttatcatcttaccttggcttcccaaagtgctgggattacaggcatgagccaccacacccagccctcatttgtgatttttaaatcaatgcttctaagcttttactgtaaagtctgatggatttttggtagattatctttattaggttagtagagttttcttctagtctatgtatgataaggattttattattattattaaataattgctaaattttttcaactgcttttttccccttctcttgaagagattataagggtttcccccttttaatctgctaagatgggaaatgattaaaatattttctaaaatgaggccaatattaaatttgttgattaattgcccacttagtgctgggtgttctgttagcatctgagaagtatatagcaatgattaaaggaagaatggtgataaagattttattatttttttaaaactaagcaaataaataatatgacatatgacaatgttttgaataaaaatggaacaagatagagattggtaggtactattttaaagaagatgtttaagaattttctatctgatcaaaatgacatttaggcagggatcagaaggaagtgagaaaatgagctatatggacacatgcaggaagcactttccaggcaatggaattggcaagcgcaaaggccctgtggcagaaagaagttggtcaggatggcgaaggggtggcaagtaacagtgtgagtggggttctataaagtcaaagacacagcagcatatctgacctgacaggttctaaatatcagatgcttcattccagggtcttgggggccatggccagaactttggagttttattctgaagcagataaaactctggagagtgtgacttattttttaataggatcctctggcttatttgtggaagatagaaagcgtataagaaagcaaaatcacaagcaaactaatggttagagggctcttgtgtaactccagatgagagaggataggggcttggtcaaataagaaaggtttggggccggacgccatagctcacatctataatcccagcactttgggaggctgaggcagttggatcacctgaggtcagtagttcaagaccagcctgaccaacaaggtgaaaccctgtctgtactaaaaatacaaaaattagccacgcgtgtggcaggtgcttgtagtcccagctacctgggaggctgagacaggagaattgcttgaacccagggggcagagtttgcagtgagccaagattgtgccactgcactccagcctgggcaacagagcaagactccatctcagaaaaaaaaaagagaaaggtttgggttctggacacatggggaatatccatactgacagcaaatacttttatagcacttactatctaccaggcactcttctaagaatttcataaatatgtactcatttcacagcttcaacaggtagatactattatgaccaccattttatatggagaagctgaggtacagagaggtaaaatacctgcacatgtttaaagagtctcagggagttagcttggaggctggggaacatcaaacaaggtctacctccgaaggtggttcaaggccaccaggagcaaggacagggagggagagtccttggcatatggaaactcagaagggggaggtttataggctgtctggggcctcactttagaatggcatgaatgctttatctggctatgattctagggtatgtttcttaggatagaaatctccactctggctgtggatacaagaggattctgttattgagaatagtgaaggaggggtaggattacataatttattcatttgttgctgttagcattacattttataagagtacctaggctctctgatcctgagacctgcaatgtagttttttataatagacaaaaaagagaaagaagtagagtgtctaggattctcgctgtcttctcccatgatcagtccttaatactggatctgaattttctctggcaaatgatacaaaagtctttttctttttattttttgttcatttgtttgtttgttgaaatgaagctctgtgcattcttagtgtgatggcacagaacaccaacttatttttttcttgcataaaactatcatatgtctctaaaattccctcagcatctgaactgcttacacgtttgcccatttccatcgtttccccaaaagtgaagttctccaggccccttatgtactttttgttcatttcagatttatatttatttatttatttatttatttatttttggtttgcaaaatgcttaggaaaccaaagtatgagagatcaagtcattacaaaccaaagcaatgcaggacaaaatccataaggatgatctaggcaataagataatttcagaggaagggagaatgactcttgactgagggaccatggagggctctgaggaggaactaggatttgagcctggatgtgaatattgtctgttttacacaggtagagagggacagagatgcctgcctgtgagtacttatgtcaattctctctgactttagcccgtagcactgcgtatggtttcctcacacattctggtcaatagaaattccctcagtaatcaccaaggacacccaaaatctcaatctcagctttacttcttccaaggacttggaatcaagcatttcctgaaacaattgtattagttggggatagactaaggctgtcaattttgtctttctctgtatcttccctataccaggtacatagtagatactgttggtctgtttttgtgctgctgtaaaggaatacctgaggctgggtagtttataaggaaaagaggtttaattggctcctaattctacaggctgtacaggaagcatggtgctggcatctgcttggcttctggtgagaggcctcaaggagcttctactcatggcagaaggggaagtgggggaaggcatgtcacatggcaagagtgaacaaggggatgtagcacgtgccacactcttttaaacaaccagatctcatgtgctctcagattgagaactcactcattactgccaggaggacaccaagccattcatgaggaatctgcccccatgacaaaaacgcctcccacccggcctcggctccaacaatggggattacatttcaacatgaggtttggagggaaacatcggaactatgtaagatacttagcaaatatttagttaatgcaaaaatacattcccatttaacttgaaatctttagaattgcacttttcatctctagtaagccacatactttgatctattgcactgaacacagtactagatatattactaaatttatttctcagtgaccagctatttgctggaaccagaatcccttcctaattgcagtcttattggctaggtattggcactgcacttagcggaagtgtcacctccctcatcagggtgcaccgccataaatggacagatggccatgggttcagggctgctgtttccctgggtctgagtgtttcttgccaaccaggattgcaaggaagtctggatttttttttttttttgtaatgattttcacctccatgcctaatgctaagcctgctcaatatcaacaatgcctaaacggctaaatattacacaatggctatctggtgcatactaaaagataagttcagttcctagcttggcttttcaaagccattgttatctagtcatagtttccttacgggtgactgttttaaatggcaggaatgacttgagctatgcaaagagacatgagcatccctaaaatatctccagtgtggtgagtgtgtggaagagaaatttgaattaagcagaggtcctcaatctaactggaataaacacttcccatttatgaccaatatttgtcatttttttattatcctaaaataaaaagtaaagtgatataatatttgacataaatagtttcagagtatcaacattgtgctctaactgtaatataaaaggaaagtataataaactgctacaaattaaatttgtgactgatagacacagttcacttaatatgtactgtcctaagcagctggatccttatttttctccttgtaaccccagtttattcccaaggcattttgtacatcaactcttgttttcttctttgccctttattcaaaacttctattgaataccaactatatattggacactgtgataggcaataatataagaattactatctcccacatggctgatatggaaacccacaagttaacccagttttcctagggtgtattatgaataggcagctgaacaaagtttcaaaagcaaatatacctgttacttctgctgtcacaaacatgagagcagttatgggtggggtagtcactggcagggagtctgagggaggtttctgaggggtggggttggtgttcttctcacgtgggtggttatatgagtatgctgcctttgttgaagttcagtgagtttcacacttatgatttgtgctatgtgaacttttctttatgtatgttgttcttcaataaaagctcactccaaaggcagggagagaagcaaatctatctaaatccaacagtttcctttgcctgaagccagatttcaatgaatctccacttcaaatgtcagatccccttctcagtatgctttttgtcattttattagcgctggcctgctttgcaaggatagctctttagacacttctttactgagagctcttggcagaaaccgggactcctctcgaagggtaggggtaagaggaattagagatattgatccaaacctgagttctacaggagatcctttcccatccatcctgccaaaccccaaagtgacgttttcattcgacgtcacaacgcttcattcagtgtgacacaggttctgtgtcacattcattctgtgacgcaggttctgaagaagaactcaacttcagtcctatggagaccactgaaagaggaagctccccgcagcaaagaaagtaaccaggaactgagttttgatgggaaatttgtctttcaaattcaaagcagtagattggaatgatatggatagcccagccttggaattgagatggccctcagaaatcagagcactgattttcacttgaacaactttgaaaagcctaaacaacaagggaatatctctctctctctatatatatatatcctggcctgtgatctctctacgtcccaggatggggtcggatgggcacagccgggcacagactgtccagagtgttagacgccaactgggtagctattcaattatgaatagttagaaaagagagagagagaaaagagaaaataactaaaagactctctaccataccactctccctcaagccctagaaagaggcaattctgaagtggttggtcgtcttggaaaataggttaatgattttacagatttcccagacaatgaaaaaatgatacatttatttctaggcaagtagatcagtttgcttctttatcataaaagagcttgaagaattcagtgaggttcagagggaaaaaaatgcttaaagaaaagttgctttcaaagttgtatttaaaaatcacatatacccttctatattttataagccattaaaaggctttccaagggcaaatttaaacattccaattagtcatcttacaagctgactttagaacataaagtatatgtaagatttaatttcattttatttctcaaccttataatggtcgaaagaaacagatactgtggggtgaagtaaaatctttgacccatacagtaaaatatgaggctgtaatgaactatttctttaaacctggtatttaccaagcatagagctatgttggtgctgagctgactttatgtttttttggccaggcactatgatggagaccgtgttacattatttcctttaatccattctctagtcctatgtggtagatagtaaattgtgcttttaaaataagggtactgggctgggcacagtggctcacacctgtaatcccagaattttgggaggtcaaggtgggaagatcgcttgagcccaggagtttgagccagcctggacaacctagagagactccatctctacaaaaaatttaaaaattagccgaacttgatggtgcgtgcttgtaatcccaactatcaggaggctgaggtggaaggatcacctgagcccgggaggtcaaggctgtagtgagcctggatggtgccactgtactccagggtgagtgacagagcgagaacctgtctcaaaaataaataagtaaataaacaaacataggggcactaaggtacatagaagttaaccaacctgtccaagttacagagcccacagctctcaatcaaatagatacaattctatgccagtgaaacttctggggcgaaagtcttttaggagacatagaaatgtgtcaaaattcaaaaagccctgaagattatttccagaaggaaggcacagaggagaaaaaagaaaatatttgaaaatacagtggtagaaaattcgcctgacctgaggggcagctttttgccaccaatgtctctgatacattaattattctctgctacattaagattttagtttttaattttaacaatttttcctcctgaatttgaattttctgtgtttgtttggtttgatgctttttctcacaagggtgaattgcctcaaatgtttgggaatttttagtcatcttttcatatttgtaaataagaatctgcattgatcagtctttgcagcaggagtgtattttctccagcctccgggttctaattttatgacaccactgcctatcattctgaaattattcgaaacactaatggaaaaaatcactttttagagatactcttcttcacttggatgagtttgcaattttctcaggttcactgtattttatcattttttaccctgttcccatcagctttgcattttttacaaaccccataaccatcatgtgggctgatgacactcctcccagcctcctagccctgctatggatattttattcatttactcatttgttcatatacccaactttttactgaagtctatacatacagaaaggtgaacatattgtgaggctataacttgattaatttttgaagagtatgcttgtgtaactatctcccagatcaagcagcagattcttcccaggaattccagaaacccatgtcctgcacctttccagatactaagcccccctcccaaggaagtcaactatcctgacctctagcaccatattaaacttgcctgttttgcactttatgtaagcaggattccacagtatatacactttgtgcactgcttctttaatctgtgtttggagattcacccctgttcttgcatgtagccatgctttatttgttctcatgaggtgggaggatagcctgagcctgagaggtcaaagctgtagtgagccaggaaggtgccactgtactccagcctgggcaacagagcaagaccttgtctcaaagcatatacctagcatatacctaagagtagaattgctggctttgattgattctattattacatatttctgtcatttcagtaggctttggaatgaacaaaatataaacacattagatctgtttgccatcttttacctgaaagcctaaagcatggttttgactgataagaatcatttacaattcaatagcaacgctattgctcatactttaaaaatttttatttaaaccaaaatgagaaaactttggagttcatcaccattaaaaacaatgacaaaacttgtggattttgttttgctcccttttaatactccaatatatattttgatttaaaaatttcttaagagaccaccacagaaaatatccattataaaacttatttctagaatcataaccatctttataaagctgcaattgaaaacaaaaaataagaagaaagaaaaaaaagagacatgaatagcctttttttctttcctgttgttttgatctgtatttgtccaagtatgcatctatgaataaacctagtccctcatccactaaccttcttttgaacttaaatgatttgtatgtggtctaatcatatttcctggtcccatggcactctagagtctaactgtgcatgccggtctcttatttccatacattgtatctcagagataaccaaatgcatggccaacttccctaattacagtcaccaggtcctggcggcctcctgcagtgccctctcttccctgcatcctttcacttttgtgttttcattttttccatctctctccctgaagtatactctccttcaaatttcccctggccctaaggagactgcttcaacatttgtttacatgtcaaaaataattgaagactaaattaattctcagcttcagtttatcaagccccttttcaattgtggctttttcccccttcagactttggaatttagcaactaggatagcctttgaaaacagaaaaaagcacaatagatattgatggatcacttgatagactgtatcctctaggcctagagtctatgattttatgattgattgatgtgctaggtttctttttgttttttcctcatgggttcccaacatctgattattaaattacacagagagagccattaagcatgtttgtaaagcccacattcttaatatctctgctccttttttttaaaagagacttaatggaaaacctaatataaacacctgaactgtgcattctttcatgagaggaagacatatttcataactccttatatactaaaaacacaatatattggccaaacatgtggaagacacacacacacacacacacacacacacacacacacacacacacactttgcctatttttgtattttatatatttactttcttatactttacatgttctgtgtaaatgaactagatatgtaacacattgagctatgtatatatagtagattgaatgtctgtgatgtcttaggaacacataggattggggattgtgacaggcagcttctgagatgacctcctaagaatttccacctcctgatatatttgctttgtgtaattccctcccgttgagtatgatctagtctagtgacttgctgttatgtaataaaatatagcaaaagtgataggataccacttcagtgactggatacaaaagactgtaacatttgtatttcaagtagattctctcaattgactctatcctttcatggctttagtaaggcaagttgccatcttgagagactcaagggacaagaaattgagggcagctgctggccagcagccatctagaaattgaggacttcaatccaaccagcccttgaagaactgaattttgccagcagacacatgaattgggagtggatactttcccagctgagacttacatgaggctgcagccctggctgatacctcaattgtagcctcttaaagattctgatatagagaccccagataagtcatgcctagacttagagaaattgaaaataataatcacaccttattttctccaataagtttgttaatttgttatatggcaataaaggccacatttgtggaatgcatgctcagtactcaacaagggaatgggcagctgatatacagaatctcatttggttgtaacaatcattctgcaaagtaaggctttggttgagatataagcatgactgcaaattgcacagatgcagaaaaagacacttctgacaagttagttagctcaacctgcccaaggtgacatggagccaagattttactttattttttcttttatatatatatatattttttattatactttaagttctagggtacatgtgcacaacatgcaggtttgttacatatgtatacatgtgccatgttggtgtgctgcactcattaactcatcatttacattaggtgtatctactaatgctatcccttcccccaccccatagcaggccctggtgtgtgatgttccccttcctgtgtccaagtgtgctcactgttcaattcccacctatgagtgagaacatgcagtgtttgttttttcgtccttcgatagtttgctgagaacgatggtttcaagcttcatccacgtccctacaaaagacatgaactcatcatttttttaatataaaatataaaatttttatatatatattttttattatacttttaagttttagggtacatgtgcacattgtgcaggttagttacatgtgtgtacatgtgccatgctggtgcgctgcacccactaactcgtcatctagcattaggtatatctcccgatgctatccctcccccctgccaccaccccacaacagtccccagagtgtgatattccccttcctgtgtccatgtgatctcactgttcagttcccacctatgagtgagaatatgcggtgtttggttttttgttcttgtgatactttagtttactgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccacaataaacacacgggtgcatgtgtctttacagcagcatgatttatagtcatttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcataaatgtcttctttggagaagtgtctgttcatgtccttcgcccactttttgatggggttgtttggttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggctttggttgccattgcttttggtgttttagacatgaagtccttgcccatgcctatgtcctgaatggtaatgcctaggttttcttctagggtttttatggttttaggtctaacgtttaagtctttaatccatcttcaattgatttttgtataaggtgtaaggaagggatccagtttcagctttctacatatggctagccagttttcccagcaccatttattaaatagggaatgctttccccattgcttgtttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccactttcacgatattgattcttcctacccatgagcatggcatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctcattgccctggccagaacttccaacactatgttgaataggagtggtgagagagggcatccctgtcttgtgccagaactcatcatttttatggctgcaaagtattgcatggtgtatatgtgccatattttcttaatccagtctatcattgttggacatttggcttggatccaagtcttcgctattgtgagtagtgccacaataaatatgtgtgcatgtgtctttatagtagcatgatttgtattcctttgagtatataaccagtaatgggatggctgggacaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgggagatgatatctcattgtgattttgatttgcatttctctgatggccagtgatgataagcattttttcatgtgtctgttggtggcataaatgtcgtcttttgagaagtgtctgttcatatccttggcccactttttgatggggttgtttttttcttgtaaatttgtttgagttctttgtagattctggatgtattagccctttgtcagatgactaggttgcaaaaattttctcccattctgtaggttgcctgttcatgctgatggtagtttcttttgctgtgcagaagctctttagtttaattagatcccatttgtcaattttggctttggttgccattgcttttggtgttttaggcatgaagtccttgcccatgcctatgtcctcaatggtattgcctaggttttcttctagggtttttatggttttaggtctaacatttaagtctttaatccatcttgaattaatttttgtataaggtataaggaagggatccagtttcagctttctacagatggctagccagttttcccagcaccatttattaaatagggaatccttccccatttcttgtttttgtcaggtttgtcaaagatcagatagttgtagatgtgtggtattatttctgagggctctgttctgttccattgttctatatctctgttttggtaccagtaccatgctgttttggttactgtagccttgtagtatagtttgaagtcaggtagtgtgatgcctccagctttgttctttgggcttaggattgacttggcaatgtgggctcttttttggttccatatgaactttaaagtcgttttttccaattctgtgaagaaagtctttggtagcttgatggggatggcactgaatctataaattaccttgggcagtatggccattttcacgatattgattcttcctatccatgagcttggaatgttcttccatttgtttgtgtcctcctttattttgttgagcagtggtttgtagttctccttgaagaggtccttcacatcccttggaagttggattcctaggtattttattctctttgaagcatttgtgaatgagagttcactcatgatttggctctctgtttgtctgttattggtgtataagaatgcttgtgatttttgcacattgattttatatcctgagactttgctgaagttgcttatcagcttaagaagattttgggctgagacaatggggttttctagatatacaatcatgtcatctgcaaacagggacaatttgacttcctcttttcctaattaataccctttatttctttcccctgactgattgccctgggcagaacttccaacactatgttgaataggagtgataagagagggcatccctgtcttgtgccagttttcaaagggaatgcttccagtttttgcccattcagtatgatattggctgtgggtttgtcataaatagctcttattattttcagatacgtcccttcaatacctaatttattgagagtttttagtatgaagggctgttgaattttgtcaaaggccttttctgcatctattgaggtaattctgtggcttttgtctttggttctgtttatatgctggattatgtttcttgatttgcgtatgttgaaccagtcttgcatcccagggatgaagcccacttgatcatggtggataaggtttttgatgtgctgctggatttggtttgccagtattttattgaggatttttgcatcaatgttcatcgggatattggtctaaaattctctttttttgttgtgtctctgccaggctttggtatcgtgatgatgctgtcctcacaaaatgagttagggagaattccctctttttctattaattggaatagtttcagaaggaatggtacccgctcctccttgtacctctagtagaattcagctgtgaatccatctggtcctggactttttttggttggtaagctattaattattgactcaatttcagtgcctgttattggtctattcagagattcaacttcttcctggtttagtcttgggagggtgtatgtgtcaaggaatttatccatttcttctagattttcaagtttatttgcatagagatgtttatagtattctctgatggtagtttgtatttctgtgggatcggtggtgatatccgctttatcattttttattgcatctatttgattattctctattagtcttgctagtggtctatcaatttgttgatcttttcaaaaaaccagctcctggattcattgatttttttgaagggttttttgtgtctctatctccttcagttctgctctgatcttagttatttcttgccttctgctagcttttgaatgtgtttgctcttgattctctagttctttcaattgtgatgttagggtatcaattttagatctttcctgctttctcttgtgggcatttagtgccataaatttccctctacacactgctttaaatatgtcccagagattctggtatgttgtgtctttgttctcactggtttcaaagaacatctttatttctgccttcatttcgttatatacccagtagtcattcaggagcaggttgttcagtttccatgtagctgagtggttttgacagtggggtgttagactcccacacaattatagtgggagagtttaagtctctttctcagtctctaaggactttctttatgaatctgcgttctcctgtagtgggtgcatatatatttaggatagttagctcttcttgttgaattgatccctttaccattatgtaatggccttccttgtctcttttgatctttattggtttaaagtctgttttatcagagactaagattataacccctgcctttttttgttttccatttgcttggtagatcttcctccatccctttattttgagcctatttatgtctctgcacgtgagatgggtctcctgaatacagcacactgatgggtcttgactctttatccaatttgccagtctgtgtctttcaattggagcatttagcccatttacatttaaggttaatattgttatctgtgaatttgatcctgtcattatgatgttagctggttattttactcattaattgatgcagtttcttcctagcattgatggtctttctttacaatttggcatgattttgcagtggctggttccggttgttcctttccacatttagtgcttccttcaggagctcttgtagggcaggagtgttggtgacaaaatctctcatttgcttgtctgtacagtattttatttctcctttacttatgaagcttagtttggctggatatgaaattctgggttgaaaattattttgtttaagaatgttgaatattggcccccactctgttctggcttgtagagtttctgccaagagatccactgttagtctgatgggcttccctttgtgggtaatctgacctttctctctggctgcccttaacattttttccttcatttcaactttggtgaatctgacaattatgtgtcttggagttgctcttctcgaggaatatctttgtggctttctctgtctttcctgaatttgaatgttggcctgccttgctagattggggaagttctcctggataatatcctgcagagtgttttccaacttggtttcattctccctgtcactttcaggtacaccaatcagatgtagatttggtcttttcacatagtcccatatttcttggaggctttgttcttttctttttattcttttttctctaaacttctcttctcacttcgtttcattcatttgatcttcaatcactgataccctttcttccagttgatcgaattggctactgaaccttgtgcattcgtcacatagttctcgtgtcatggttttcagctccatcaggtcctttaaggacttctctgcattagtcaatctgattagccatttgtctaatcttttttcaaggtttttaacttctttgccatgggttcgaacttcctcctctagctcagagaagtttgatcatctgaagccttcttttctctacttgtcaaagtcattctctctctgtccagctttgtttcgttgctggtgaggaggtgcattcctttggaagaggagaggtgctctgatttttagaattttcagtttttctgctctgttttttccccatctttgtggttttatctacctttggtctttgatgatagtgacatacagatggggttttggtgtggatatcttttctgttggttagttttccttttaacactcaggaccctcagctgcaggtctgttggagtttgctggaggtccactccagaccctgtttgcctggatattagcagcagaggctgcagaacagcaaatattgctgaacagcaaaagttgctgtctgatctttcctctggaggttttgtctcagaagagtacccagccgtttgaggtatcagtctgcccctactgttgggtgcctgccagttaggctactcaggggtcagggacccacttgaggaggcagtctgtctgttcttagatctccagctgcatgctgggagaaccactactcttcaaagctgtcagacagggacatttaaatctgcagaggtttctgctgccttttgtttagctatgccctgcccccagaggtggagtctacagaggcaggcaggccttcttgagctgtggtggactccactcagttcaagcttccctgccgctttgtttacctactcaagcctcagcaatggtgggtgcccctccccgagcctcgctgctgccttgcagtttgacctcagactgctgtgctagccatgagtgaggctccgtgggcatggtaccctccgagccaggcacggggtataatctcctggtgtgctgtttgctaagattattggaaaagtgcagtattagggtgagagtgacctgattttccaggtgtcatctgtcacagctttgcttggctatgaaagggaattccctgaccccttgcacttcccgggtgaggcaatgcctcaccctgctttggctcatgctttgtgcactgcacccactgtccaacaagccccagtgagatgaacccagtacttcagttggaaatgcagaaatcacccgtcttctgcgtcactcactctgggagctgtagactggagctgttgctattcagccatcttggaaccccttggagccaagattttaaacctggactacagcctgagaagaatggaatgagagaaaagtaaaggatctgacatgggtcctgtttcatgggtgaggagtgagacagggggttgagctttaagtaggatgggttttgctatccccaaaacatagcagaaagtaaaacaaagcagggaaaaactaagtcatgctctatctgaataatactccagagaaggtacaaaattagtttaaattctcttgtattgggtaaaaatcaagtgaagttatagaaagggttcaaaaaagaatcacagaaattatgcctttttaacaaagccactgaagaaaaattgtttggtattcatttgaaatatacagtacattttttccaggaaagaaatgttttgcatcaagaccaggttcttacgctagctgtatatatatataaccataatgcagctgaaatactacaggtttgtaatgaaactaacagaatactggactcttaaaatgatccatattagatacagcagcaaaataaaccccactaagatagaaaaatacattgcttttagctaaactatttcctcaagaaaatcaattttaatagaaaatttgcaggtactctggactttggtaggaactttaaaattgatatcaccagttcaatattggtatttctgatttctttacaaaacaacatactttttcttgatacaaatatattgctagcattagtcttgttcataatagacatgaataagaacacagacaggatgaggtgttttagttgagagataactatataagaagttgggagggaaaatataaaggataaaggaattaagaaaataactgggcaacaaaaagatataaaatgtttgctggtggaagaatcagctcagttagatatgtaagtgaatccatcacaggagcaaatgggaatgctgactctacagattacctctgtgtatgcttagtcaattcctgggcctcagatttctcatcttaaagctggctctacaatgcttgtttctatattaaatagcctaatgtatatggcaattccttgtaacaacctgccatgatagtggactccgaatgatatttgttgaatctgaaactgaatctctgcagcctttataaggagaaataatggaagtcataaagaagaaaatttggattattcattgctgaagatagatttttctggtgagtgaaggagggaaggtgtgatggttagttttaggtgtcaacttgactggattaagaaatatgcagatagctggtaaggcattatttctaagcacgtctgtgggagtgcttccagaagagattggcatttgaattagtagactgggtaaggaagatctgcttccacctgatattgattggctctctccccacccggatctcatctagaattcccatgtgttgtgggagggacccagtgggaggtgattgaatcatgggggcaggtctttcccacgctgttctcatgacagttaatatgtcttatgagacctgatggttttataagaaggagtttccctgcacaagctctctttaattgccagcatccatgtaagacatgacttgctcctccttgccttccgccatgattgtgaggtctccccagccatgtggaactgtaaatccattaaacctctttttctttccagtctcagggtatgactttatcagcagtatgaaaagggactaatatagtaaattggtaccagtagagtggggcactgctgtagatacctgatatttggaagcaaatttggaacttggtaacaggcaggggttggaacagtttgaagggctcagaagaggacaggaaaatgtggaaaagtttgaaaccccctggagacttgttgaatggctttgaccaaaatgatatggacaatgaaatccaggctgaagtgatctcagatggagaggaggaacttgttgggaactggagcaaaggtgactcttgttatgttttagctaagagattgatggcactttgcccctgccctagagatttgtggaacactgaacttcagagagatgatttagggtatctggcagaagaaatttctaagtagcaaagcattcaagagattacttgggtgctgttaaaagcattcagttttaaaagggaaacagagcataaaagtttggaaaatttgcagcctgacaatgcgatagaaaataaaatcctattttctgaggaaaaattcaagctggctatagaaatttgcataagtaacaaggagctgaatattaatcaccaagacaatgggggaaaatgtctccagggcatatcagagacctctgcagcagcccctcccatcacaggtgcagaggtagtttaggaggaaaaaatggtttcatgggctcagtacagggtccctatgctatgtgcagtcttgggacttggtgccctgcattgcacctactccagccatgactaaaaggggccaatgtacagctcgggctatttcttcagagggtgaaagccccaagccttggcagctttcacatggtgttgagcctgtgagtacacagaagtcaagaattgaggtttgggatcctctgcctagatttcaaataatgtacagaaatgcctggatgcccaggcagaagtttgctgcaggagcagggcctcatggagaacctctgctagggcagtgtggaagagaaatgttggattggagcccccacacagagtccccactggggcactgcccagtggaactgtgagaagaggcccactggcctccagcccccagaacgataaatccactgacagcttgcactatgcacctggaaaagccacagacactcaatgccagcccacaaaagcagctgggagggaggctctaccctgtgaagccacaggggcagagctccccaaggccatgggagcccacttgcatcagagtgacctagatataagacatggcgtcaaaggagatcattttggagctttaagatttgactgccccactggattttggacttgcatggggcctgtagccccttcattttggccaatttctctcatttgaaatggccgtatttacccaatgcctacacccctattttatcaaggaagtaactaacttgcttttgattttacatgctcatatgcagaagggacttgccttgtcttggataagacttgggactgtggactattgagttaatgctgaaatgagttaagattttgggggactgttgggaaggcatgattagttttgaaatgtgaggacatgagatttgggaggggccaggggtggaatgatatggtttggctgtctcaccacccaaatctcatcatgaattcctatgtgttgtgagaggaacccagtgggagacaattgaatcatgggggcaggtatttaccatgctggtctcatgatagtgaataagtctcatgagacctgatggttttataaggagtttccctgcacaaactctcttcacctgccgccctccatgtaagattgacttgctcctccttgccttctgccataattgtcaggccaccccagccatgtggaactgtaaatccgttaaacctctctcttttgtgaatggcccagcctcaggtatgtctttatcagcagggtgaaaatggactaatacaccacccaacatggatgagtgcatccaatcagctaagggctgatgtagaaaaaaaggcaaaggaaaggtgaattcactctttctgctggagctgggacactcttcttctcctgcccttggaccacacaactacaggttctctggcctttgaacttcacaacttgcgccattcccctgctccccatcctggattctcaggccttcagcctcagactgagaattacaccattaccttctctggttctgaggcatttagacttggactaagctatgctacagctgccctggttctctagcttgaaaatagcctatcatgggactcctcaaccttcataatgacaagagcaaatcccctaataaatctcctatctgtcatctatctgtctgcctacatacttacctacccacctacctatctatctgttcatctatctatccacccatcatattgattccatctctggaaaatcctgactaatacatctatctaaagatgaaaagatcaaacagagacaaagcctagaaaatgtagcagagtctggctaaatgctcaccaaacccatttttctcttcttgttaagtgcagataaactaaattttgtgaacttctctcatatatgagtgagaccatgtcagcagttcttgccatagatagtgaatgaaagtgatttgtcacttgcagttcagtgacagaagttacataagaacctgccttgtctttgcactcccttcttcccatctgccagctagatgatgtcaggacaacccctaactgtgtattgaaggagactaccacatgggaggagcctgagtacctgaatggttgcatggagaagaggcccactcccacactatctaaatttgaactagggagtgaatagaaaagaaaccttcactgtgttgatccattgagaacatgaaattgtaatagaagccagcattatttacaagtagaacataaatgggggaaaagggggaatattatgtaacaacagctaaatttatgtatacttaggaagtgaatgtccagatttaaataagagataaattacttggtaattctgtatgtcaccaaaatattccccttgtattcctttcagtggtcagcttctactgtccatttaaaaatattgcattttcagtatgtttgtgggtacagtcattataggaaaaagggatctaccagcatgctacccaaactgactgcactgtaatggattcccaaaggaggtgagatagctctccactggagaggagtttattttgtagtcaacaaagtgcaagagtgtattttctgagatatttgcttaggagctcaaaatttaaacttgcaacattggcttagccacttgtttaagataataaaagttgcacccattggagatattatattcagaatgcccattgtgtatatttttctaattaattggactttaattactttgcagaaaatctataaagagtcatcaaagttttgaagatgagaacaagctggtacatattccgtttactttccatagagctatctcaccatgaaacctaagaaaaaaaaatagccaatttaattttcttctgttgaggtttataaaaggcccaacagaggctactatgtccaatttttaatagagataactatttagaaatataaatgctgagaaggagaataggctcaggtatgctctgctaaatcaaggtgacccttcatgttagtttcttctagtacttttctttgtatatacaaatttatacacacacacacacacacacacacacacacacacacgcttgcatatctgctcattattcagcccaagctaggttaaaaaaaaaatccaacaagaatgtagtaacataaagctaattccttgatttttctcatttccatatttttgggggggtactttcctacattggagggtaaaatacaaaggattatacttgtaaatgtttaaggaaatgtatttaacctcaattactgaatatatggttcgaatatatggttcagtggggaaaagggtgaagatacaatgttaagacataatcattttactagaaggaaattgttcacagtcacctggtaagaggaacttatgtaccactgatggaaacagaatgatggggaattgagtggtaaggaaaggaatactgagtgtgttctgggctgtatcctgccctttcctctattatagtattggtgttaaatggaggaggagccacttttaaatctcaccctaaatatgtccagtgtagtcaatacgaaaaaaattattttttggcatttggagcagtacagcagactagatagggagctagaagctaaataaaaagtgaaacctgaaattaaatacccctcgaaatccatcagttctgtatggctgagatatatccttacctagagggagatgattgcccttgagggcatctcaaaaaattctttccagctctgcactttgatgctctaagtttctgagttgagagataattggctgaatattttgtctttgacttggaatttcaaatcttcaaccttgtcctggatgcggttgcaacaatgcttattttctgaccacggctactgatatctacacttcataatactgttaagtattttcttgtagcctgaattagtttaacatttctgacaatgaattcccaagtaattgcggtggcttcactccatgatatgtctctcagggcactcttggaaattaaatgttacttcttctcaacagttatttgcttacttcatcctcattttattaaataatcataaaaaactttcaaatttaaatatgcctgctctgttatctgaaaggtctggcaagacaggaaggctggatgaaacaaagccagccctggtctctttgttatttttcagtgaattttccattggcattgagtgcatcccaagtctggggctttaaggagctttaaagctgtgtgctcactggggtcctggttgattttcagcaactaaagctgaaattgctgctgtttagaggtggcccaaacattcttaacaatgtttaaaatacctaacctcattagagcaaaataataatctattttttcttttgtttttgaatagtttttttttttttacaagactcctaaagatttattttggttgaataaataagtaggaagggttccaagacccatgcaggtgatcttgtgacaattattagacacttgatctgggtccagttggttacgaggccttgcctctcattttaggcatgctgtcttctagaagacttacatgaggttacccgactgaagaatttggaggggagaatattgtcctcatttaaagaagttcactcaatgagacattagtgacttgtttaaatttaacaaaatggagttagttatgctgaattcccagctcaactattccagagcagcatggggtagcagggaggtcatgggctttgaacatagacacacttgatttgattccaggagctaccctttcctagctgtacatccttctacatcttagtgatctctgagtgtcagatctctaaaaagcaaaatagagtccaacttatagggttaatatgaattatcaaaaaatacctttaatgtacctaaactataatcaataataataaatgatagacacttattatttcttgtattaattccaacacattgcttggtttaaggctgacagttgtgatatgaatcatgatatagcccagaaatgttatttagaaagtcttaagttttatttcctcccttgaccacccaacatgatagtttcttcatcatcacaatatatatgtctaatgttttcacaaagaaggctgtgtgtattagctaacgcaaaagaaagagaaaaattgcattcttatttcaattttccctctcttaattctattgcgtgatcttaggcaagtaagtacaattttgcatttcgttgagaggaagggcagaggactttatctgctatatctgtgtaattatttccaagacacaagtgagagtgactgcaatattgtccctcaagtacttggcattccttagaagaaaacatgatgtaattgggctttaataacttggatgaaaatgtatcctagggccataaaatgtttctctacaacattagatctaggcgagttattatgattacctcttaagaagtgttcagattaacggatatgtgcttataaagtccattacaaaggcagaatcagaaggaagaggtacagaagagtacccggatatttcaatgcattttattcctgaacattttaaatggagaagttcttttatcacttgtactgccaggctcagtgggggaatacctgaacaaggaggcctgctctgaatactatgtctatctccctacttgccctccattagaagattgcttaaagaaactcctttctgtagccatgcttgatgattaatgttaggtgtcgacttcactgaatagagggctgcctagatggctggtgaagcattgtttctcggcgtctctctaagggtgttttaagagaagatttttatgtgagttggtggactgagtggtgaagattgcgctcaatgtgaatggacatgattcaatcagcttggggccctgatggaacaaacaggtggaaaagcatcaattctctctttcttcaggaaagggacactcttcttctcctgcccttggacatcagaaatccaggttcttcaagctttgaactctgaaacctgcacctttagcctcccaggcctctcaagtctttggtcttggattgagaattacaccaccagcttctttagttctcaggcctttggacttattctaagccctgctactggcttctctggttctccagcctgtgataatacttatcagcctccataatcatggaagccaattcccctaataaatcccttatctttctgcctgtctgtctgtctatctatctatctatctagtctgtctatctatctacctatttttctatctgtcctattggctccttctctggaaaaccctgaccgaatatactatgtgtataggtaagggcaatgatatggaagtcaaaccagttcacccttccaagctatgtgattcattgcaacattcattcagtaaacactgagtgccttctgtgctaggagttatatatacaacatgattcttgacttcagttgaaaatggtttagtggagggaaacagatgtgcataaataaatctatttatctcctaaagcattttatggcttatttcccatagttgattattcttagccaattatagtaatttcatccttcattcccccaccccacacccctgctattgatgaattcagggatagagctttaagtctaagctaacttgaaaactaaaacattaggagtaatttttagacacttatgggaaaaatgccctcatgggctaaagaggtcatctaatgcctttaaggtatactaccttagaatgatgttaaatttgccaactgcagagtagagcgtgggaagtttactgtgtcctaggtgatacacataagcagctgttttaagcaatctgaagacttcttgctctgcctgtggacttgatgttatctgagctaataaatgactttattgcttaaccaagtctgaaataaatttttacttacttgcagccagaaccatcctagctgaatgctagtttaatttaatgctttccatatcacgtcatcatgacagtcccctccaattcttgtttaaaacgcaaactctcaagtaacccttaaggagaatctgacccactgatccactaggactgatataaggcccaggaattgggatttttaataactgtcccaggtgatttatgttcagccatatttcagatcattgttctgactgctataatagagacaagaattaagtgcaggcttagcaatggactcagcctggaggagttagagatggtctctcagacaaagggacatttgagctgtgccttgaagaatgagtgggtgcttgctaggctgagaagaggtgcaaagatgttcccaacaaaggaagtctcaacaaaatacttatctctctggcctttattatctcatctataaactgaggacattataaaagaaagtctaggactgggccaagatggccaattaaaagcagctacagtttgcaacactcatggagagaaaagaaaatggcaagtgaattcagcaccttcaactgaaatatccagattctcacattgggattgactaggcaaacatctcgacccacagagaatgaagaaaagcaggatggggtgatggcccacctaggagtggcatagagccaaaggaaccaccacccccagccaagggaagtggtgagtgattgtgtgattccacctgggaaatcatgcttctcccacagatctttgcaaccagcagatcagggatccccttctaagcccataccaccaaggccttgggtctgatacagagagctgtgtgaagtccctgcagagcagccactggggcacacacagagacccaggagttttgcatactgtggccccaggatttctgacaaggtaagagatctgtccctacatcccctaagaggggagctaaatccagggagctgagcagcatcattctgcaggccccacttccacaatacctcacaagttaagacacactggcttggaattccagccagccagtggcaacaggctggagtctgcctgagaaggacaaagttcctggacagaggggtggctgccattctgtgttctggttgactcagcttttccagcctgccaactctggagagtctggacagtccagatgaggaagggtcccccacaacacagcacaattctgctaccaaaaaaaaccagactgcttcttggagcaggtccctgataccattcttccagattggatgagacttctcaacagaggtctccagctacctcctttagatacaatttgggctggcaacatgtccgtacttccctgggactgagcttctcaaggaagaagcaggctgcaatctttgctgttttgcagccttcactgattgataatacttcaaggtacatgaaaaaccaaggcaactagggtccatagtggacccctagaaaatggcagcagtcctacagaagaatagcttgactgttaaaagtaaaacagacaaacagaaaacaacaaaaacaacatcagcaaaaagatcccacaaaaactcctttccagggtcagcagcctcaaagatggaaggtagttaaccccacaaagatgagaaagaatcaacacaaaaaccctgaaaacccaaaaagccagagtgccttatatcctccaaattattgcagcatctctccaggaagggcacagaacagggctgaggctgagatggctaaattgacagaagtaggcttcagaaggtggataataataaactttgctgagctaaaggagcatgttgtaacccaatgcagagaagctataatcatcataaaacaatacaaaagctgatagccaggacagccagtttcgagatgaacataaccaacctaaaggagctgagaaacataacacgagaaatttacaatgcaatcacaagtatcaatagcagaatctcagagcttgaagaatatctttctaaaataggcagataagaatagagaaaaataatgaaaaggaatgaacaaaacctccaagaaatatgggatcatgtaaagacactgtgcctacaatggattggggtacctgaaagagatgagaatggaaccaagttggaaaacatacttcaggatatcgttcagaacttcttcaacctagtaagacaggccaacattcaaattctggacctgcagagaatcccattaagatgctcccccagaagatcaaccccaagaaacataatcatcggattctctaaggtcaaaatgaaagaaaaattattaaatgcatccagagaaaggccaggtcacctacaaagggaagcccatcagactaacaatggacatctcagaagaaatcctacaagccagaagatattgggggccaatattcaacattcttaaaaaaaatttccaacccagaaatttatgtctggccaaactaagcttcataagaaaaggagatataagatcttctttggacaagcaaatgctggaggaattcattaccaccagacctgccttgcaagagctcctgaaggaagcactaaatatggaaaggaaaaactgttaccaaaagtatttttttacaaaagcacactgaagtacacagaacagtgacactatgaagcaaccaaccacataaacaagtctgcaaaataactagctagcctcatgatgacaggatcaaactcacatataacaatacaaagcttaaatgttaataggcaaaatgccccaatgaaaaggcacagaatctcaagctggataatgagtgaagaagacccattggtatgttgtcttcaagatattcatctcacatgcaaagaaacacatagtctcaaaataaaggaatggaggaaaatttaccaaatggaaaacagagaaaagcagggattgcaatccttgtttctgacaaaagagactttaaaccaacaaagataaaaaaaaagacaaagaagggcattacataatggtaaagggttcaattcaacaagaactagctatcctaaatatatatgcactcaatacatgagcacccaagttcataaagcaagtttttagagacctacaaaaagacttagactaacacacaaaaatagtgggtgacttcaacactccatggacgttattagacatatcatcaaggaagaaaattagcaaagatactcagaacctgaactcggctctggatcaagtggacctgacagatatctatagaactctccacccaaaacaacagaatatatattcttctcatcactacacagcacttcctctaaaatttataaataattggaagtaaaacactcctcagcaaaagcaatgttataactgaagttataacaaacagtctgttagaccacagtgcaatcaaattagaatgcaagattaagaaattcacttaaaactatataactacatggaaattgaacaacctgctccggaatgattcttgggtaaacaatcaacttaaggcagaaatcaagaagttctttgaaactaataaaaacaaagagccaatgtaccagaatctgtgggatgcagctaaagcaattctaagagggaaatttatagcactaaatgcccacattaaaaaactagaaaagtctcaagttaacaacctaacatcacaactaaaagaacaagaggaccaagagcaaacaaatccaaaacattgcaaaagacaataaataaccaagattagaggtgaactgaaggagatagaaaccccccaaaattcaaaaatcaacaaatccaggagcctgttttttgaaaaaaataataaaatagatataccactagttagactaataaagaagaaagaagaatcaaagaaacaagtcagaaatgatgaggatatcaccactgaccccacagaaatataaacaaccatcacagaatactataaactcctctatgcacataaactagaaaatctagataaaatgaataaattcctggacatatgcacccacccaagactgaaccaggaaaaaaattgaatccctgaagagaccaataataagttctgatattgaggcagtaatagatagcctaccaatcaaaaaaagcccaggaccagaagaatttacagctgaattctaccagaggtacaaacaagagctggtacaatttacactgaatgtcattgatcacataaacagaactaaagacaaaaatcacatgattgtctcattagatgcagacaaggccttcaataaaattcaacatcctgtcatgttaaaaactctcaataaactaggaactgaaggaacataccttaaaataataaaagccatatataaccaacccacagccaatatcacactgaataggcaaaagctgaaagcattccccttgaaaactagcaccagaaaagggtgtcctctcttaccactcctattcaacacagtattggatgttctggccagggcaatcaggcaagagaaagaaataaagggtatttaaataagaagagaggaaatcaaattatttttgtggatatcatgatcctatatctagaaaactccattatctccacccaaaagcttcttaagctaataagcaacttcagcaaagtctcaggatacaaaataaacatgcaaaaattgctagcattcctatgcactaaaaacaggcaagcagagagtcaaatcatgaatgaattctcattcacaattgctacaaaaaggataaaatactgaggaatacagctaacaagggatgtgcaggacttctttaaggagaactacaaaccactgcttgaagaaatcagagaggacataaataaacagaaaaacattccatgctcatggataagactcaatattgtgaaaatggccatattgcccaaagtaatttatagattcaatgctattcccattcaactaccattgacattctttacagaattaattagaaaaaaaaatttaaaaattcatatgaaaccaaaaaagagcccatatagccaagatgatcctaagcaaaaagagcaaagctggaggcatcacactacctggcttcaaactatgctacaaaccaaacagtaaccaaaacagcatggtactggtaaaagaacagacacatagaccagtggaacagagtagagaactcagaaataagacctacaaccatctgatctttgacaaacccgacaaatccagcaatggggaaaggattccctatttaataaatggtggtggaagaactggcagccatatgcagaaaattaaaactggacctcttccttacacgatatacaaacattaactcaagatggtttaaagacttactgaaatgtaaaacccaaaattataaaaaccctgaaagaaaatccaggcaataccatttaggaaataggcatgggcaaagatttcatgacaaaagcacaaaagcaattgcaacagaagcaaaaattgacatatggaatctaattaaactaaagagcttctgcacagcaaatgcaactctcatcagagtgaacagacaacctacaaaataggagaaaatttttgcaatctatccatgtgacaaaggcctaatatccagagtctataaggaacttaagcaaatttaccagaaaaaaacatacaaccccattaaaacgtgagcaaagcacatgaacagacacttctcaaaagaagacatgtgttttcaactcctagggaatcatggcagatgggaggcaggactagactgcagctctaactcagacagagcagcatgtggaggcttgcattatgaatttctgctccagaacaactgcaggaataaatcaggaaacctgaaaggacccacagacccctgaaggaagcggattgctcctgcaggacccaggagacatgccaaatactctgctggtattcacggctgacagacctacagatgtttcacatcacaggactctgcagaaaatccccagtactggcccagagcctggtagacttgctgggtggctagatccagaagaaagataacaatcactacagctattctctcaggaagccacatccataggaaaagggggagagtactacctcaagggaacacactgtgggacaaaagaatctgaatgggacaaaaagaatctgaacaacagccttcagccctacaccttccctctgacagagtctacccaaatgagaaggaaccagaaaaccaactctggtaatatgacaaaacaaggttatttaacaccccccaaaaatcacactagctcaccagcaatggacctaaaccaagaagaactccctgatttacctgaaaaagaattcaggatgttagttattaagctaatcagagacgtctttgaattaacccaatccaacgaagacaaagaaaaaagagtaagaaaatatgaataaagcctccaagaagtctgagattatattaaatgaccaaacttaagaataattggtgctccagaggaagaagagatatctaaaagtttggaaaatatatttgggggaataattgaagaaaacttccctggccttgctagagacctagacatccaaatacaagaagctcaaggaacacctgggaaattcatcacaaaaagatcatcgcctaggcacattgtcatcgggttatataagttaagacggaagaaagaatcttaagagctgtgagacaaaagtaccaggtaacctattaaaataaagaaacctatcagattaacagcagatttctcagcagaaaccgtacaagctagaagggattggggccctattttcagcttcctcaaacaaaacaactatcagccaagaattctgtatccattgaaactaggcttcatatatgaaggaaagatacagtctttttcaggcaaacaaatgctgagagaatttaccactaccatgccaccactacaagaactgcttttcaaaaagtgctctaaattttgaaacaaatcctggaaacaacatcaaaacaaaaccactttaaagcataaatctcacaggacctataaaataaaaataccatttaaaaaatgaagtcaaaaaaaccaaggtacacaggcaacaaatagcatgatgaatggaatggtacctcacatttcaatattaacattgaaggtaaattacctaaatgttctacttaaagatacagaattgcagaatgaataagaattcaccaatgaactatctgctgccctcaagatactcatttaacacgtaaggactcacacaaacttaagtgaaaggggtgaaaaaagagacatcatgcaaacggacagcaaaagtgagcaggagtagctatagttatgtaagaaaaaacaaactttaaagcagcagtagttgaaaaagacaaagaaggacattatataatgataaaaggccttgtccaacaggaaaatatctcaatcctgaatgtatatgcacctaacactggagctcccaaatttataaaacaattactaatagacctaagaaatgagatagacagcaacacaataatagtgggggactttttaatacaccactgacatcactagacaggtcatcaagacagaaattcaacaaagaaacaatggatttaatctataccctagaacgaatggacttaacagatatatacagaacattccatccaacaactgcagaatatacattgtattaaacagcacatggaactttcttcaagaaagaccatatgatagaccacaaaatgagcttcaataaatttaagaaaattgaaattatatcaagcactctctcagaccacaatggaataaaactggaaatcaactccaaaaggaaacttcaaagccatgcaaatacatggatattaaataacctgcttctgaatgatcattgggtcaaaaattaaaccaaaatgaaaattaaaaaattctttgaactgaatgacaatagtgacacaacctatcaaaacctctgagacacaaaaggcagtgctaagaggaaggttcatagcactaaatacctacatcaaaaagtctaaaagagcacaaacagacaatctaagttcacacctcaagtaactaccaaaacaagaacaaaccaaacccaaacccagcagaagaaaggaaataaccaatatcagagcagaactaaatgaaactgaaacaacaacaaaaatataaaagataaatgaaacaaaaatctggttctttgaaaagataaatgaaactgatagaccattagcaagattaaccaagaagagagaaaatccaaataagttcaataagaaataaaacaggagatattacaactaacaccacagaaataaaaaagatcatttaaggctactatgaacatctttacatgcataaattagaaacctagaagaaatggataaactcctggaaagatacaactctcctagcataactcaggaaaaattagataccctaaacagaccaataacaagcagcaagattgaaatggtaacgtaaaaattaccaatgaaacaagttcaggaccagacagattcccagacgtattcacagcagaattctaccagacattcaaagaagaattgctaccaatccgattgacactatttcccaagatggagaaagagagacccttccctaaatcattctatgaagccagtatcaccctaataccaaaaccaggatctagcccaaaaagaaaactacagaccaatatccctgatgaacatagatgctaaaatcctcaacaaaatactagttaactgaatccaacaatatatcaaaaagaaaattcaccatgatcaaatgggtttcattccaaggatgcagggtttagcataggcaagtcaataaatgtgatacaccacataaacagaaataaaaacaaaaacacatgatgatctcaatagatgcagaaaaagcatttgacaaaatccagcatccctttatgattaaaactctcagtaaaatcgacatacaagggacatacctcaatataataaaagccatttatgacaaacccacagccaatataatgctgaatggggaaaagttgaaagcattccctctgagaactggaacaagtcaatgatggccactctcaccactcctcttcaacttagtactggacatcctagccagagaaattagataagagaaagaaataaagggcatccaaattggtaaagagggagtcaaactgctgctgtttgctgatgatatgattgtttacctagaaaaccctaaagactcctccagaaagctcctagaactgataaaagaattcagcaaagtttccagatacaaaattaatgtacacaaatcagtagctcttctatacaccaacagttatcaagctgagaattagatcaagaactcaaccccttttaaaatagctgcaaaacaaaaacaaaaacaaaaaacatgaaaaaaacttaggaatatgcctaaccaaggaagtgaaagacctctgcaaggaaaactgcaaaacattgctgaaataaatcatagatgacacaaacaaatggaaacacatcccatgctcatggatgggtagaatcaatattgtgaaaataacgttactaccaaaagcgatctacaaattcagagcaatacccatcaaaataccaccatcattcttcacacaattagaaaaaaaattctaaaattcatatggaaccaaaaaagagtccaaatagccaaagcaagcaaagcaagactaagcaaaaagaacaaacctggaggcatcccactacctgatttcaaactatactataaggccatagtcaccaagacagcatggtactggtataagaataggcacatagactaatggaacagagtagagaacccagaaatgaacccaaatacttacaactaactgatcttcaacaaagcaaacaaaaacatagagtggggaaaggacacccttttcaacaaatggtgctgggataattggctagccacatgtaggaaaatgaaactggatcctcatctgtcaccttatacaaaaatcaattcaagattgattaaggacttaaatataagacctgaaaattaaaattctagaagacaacataggaaaaacccttatagacactggtttagggaaggatttcatgaccaagaacccaaacacaaatacaataataacaaagataaattgttgggacttagttaaactaaagagcttttgcacggcaaaaggaacagttagcagagtaaacagacaacccagagtgggaaaaaattctcacaatctatacatctaacaaagggctaatatccagaatctacaatgaactcaaacaaatcaacaagaaacaaacaatcccatgaaaaagtgggctaaagacatgaatagacaattctcgaagatatacaaatggccaacaaatatgaaaaaatgctcaacatgactaatgatcagggaaatacaaatcaaaaccacaatacactgccactttactcctgcaagaatggccataatcaaaaaatcaaaaaaatagtagacgttggcatggatgtggtgaacagggaacacttctacactgctggtgggaatgtaaactagtacaatcactatgaacaacagtgtggaaattccttaaagaactaaaagaagagctatcatttgatccagcaatcccactactgatacctacccagagtcattatacaaaaaagatacttgcacacacatgtttatagcagcacaatttgcaattgcaaaaatgtggacccaactcaaatgcccatcaattgataagtggataaagaaactgtggtatatatacacagtggaatactactcagccataaaaaggaatgaattattggcattcgcagcaacctggaggagactggggactatgatttgaagtgaagtaactcaggaatggaaaaccaaacattgtatgttcacattcataagtgggagctaagctatgaggatgcaaaaacataagaatgatacaatggactttggggactcagggaaagggtgggaaggggatgagagataaaagactacaaatagcgtgcagtgcatactgcttgggtgatgggtgcaccaaaatctcacaaatcaccaccaaagaacttactcatgtcaccaaacaccacctgttcctcaataacatataaaaatgaataaatacaaagatatacatgtggctaacatatgaaaaatagctcaacatcactgatcattagagaaatggaaatcaaaaccacaatgagatatcatctcacaccagttagaatgggtattattaaaaagttaaaaaacaacagatgctggcaagattgcagagaaaaagaagtgcttttacactgttggtggagtgtaaattagttaaaccattgtggaagacatcgtggtgattcctcaaagacaggaggcagaaataccatttgaccgagcaatctcattacccagaggaatataaataattctattatatagatgtattatgcattatataatacattatatagatgtattatgcattatataatacattatatagatatgtattatatagatgtatatttattacataaatcattctattataaagatacatgcacgtttatgttcatggcagcactattcacaatagcgaagacatggaatcaacctaaatgcccatcaatgatagactggagaaagaaaatgtggtacatatacgccatggaatactatgcagctataaaaaggaaggagattatgtcatttgcagagacacaaatggagttggaagccattatcctcagcaaactaatgcgggaacagaaagccaaacaccatgtgttctcacttacaagtgggagctgaactttgagaacacatggacacatcaaggggaacaacacacactggggcctctcgaggggtgtaggtgaggggagggcaagccccaggaagaataactaatggctgctgagcttaatccctaggtgatgggatgatctgtgcagcaaaccaccatggcacatgtttacctatgtaacaaacctgcacatcctgcgcacatacactgaacttaaaagtggaagaaaaaaatatatatatatataaatgtatggccaaaagaaaaaaaaaggaaagtctccatttcctctaataccttctgtttcaatattaactggaaagtgagaaatctaagtgccctttgcttattgatcaacctcataatattcaatgcagtaagttgtgagatttctctgagaatgtctttctattggaaaaataatggaaatattttgtaagctgtattataatacaactatcatgcaggcagaggcattgtatttcctgtttgcttttgtatctgtatcaaaataggatatctgacccatatagactcaaacgtggttagtgagtaagtcagttgaattaaatttattcaagtggccaatttcatatagaacttttaaagattaatttcatgtgtaaacaataatactttaagtgtagtgatgataatatcaataatattaatacttggaatttacctaatgactttatatttttaaatcatccattcattaaaaaaaatgtattgagaattttctaggtatcaggtcctattcagtgcaatgggaataaagcagtaaataagaattcatgccctcacattctcacattctggttgaagaggagaaatatctcttacatctctaatctaaatgtaagtatgattgtttataatccatagatgaggaaaatgaatttcgtatctctaaaaggtcaatttgccaaacttgtggcacaaaccagaagttacacggcttcaagcatagtaattaatatatttcttattccttctcagagtttgtgacacttgatgaggctcccttcaaatgagcaagtattgaagttcatgccatgtgcccagctcctcctggatctgtgaggaaatatctgaaaccttcaagatgttgtacatgtcttatggaaaatgttgctccatcatccctgcactcccttatctagtatatctacctccataagaaaacataaggacaggcaatcttcataaaaatagactccacctatt
